United States Patent 6,812,339 (POLYMORPHISMS IN KNOWN GENES ASSOCIATED WITH HUMAN DISEASE, METHODS OF DETECTION AND USES THEREOF) - sequence listing, part 25

SEQ ID NO: 12816 - DNA, 99370 bp, Human
aaagtagaaactcaataactgcttgatggatgaataaacttctaagcacacctttaagaaggaatcagtgaaattatatctatgacaacaagtcttaatcaggaaaaaagttattctggctttatggacctagtgtccacctatttctgaactgttgaagatgaatctgaactatgttcactgccccttggtctctaccatccttaagtaggcttttatatgtcctaatgtgacatacttggagatcttgattctgagacaggaccgtttacctttgaaagaagtataaattgtaccatgataataagaaggtaagagagaaaaacatgggtagtctgggaacctgtaaacatttatagatgtaatatatctgtgggccatgtagggaaggggttcatggagaggggctcatactcaatactgagattttcttaagtggaatctacaagttgcccagatgcgctgtgaaccccatgggctgccacttggaggtgagatgggaagggcagatatgagaagagtatggatggagcctacatgggctcatgtagacccaatgtcagacattggaaggaagatagacagtgagagctctgagggaaatctgtgaagaagctcaggtcttgatgaagtatcctaatgtctactctacgctccatgctaggctgtttgtgtattttctcagaaaggaagttcattggctggggacggaggctcaagcctgtaatcctagcactttgggaggccagggcaggcaaaccacctgaggtcaggagttcgagaccagcctggccaacatggtgagacccagtctctactaaaactacaaaaattagctaggcgtggtggcatgcacctgtagtcctagctacttgggaggctgcggcatgagaattgcttgaacctgggaggcagagactgcagtgagccaagatcacaccactgcactccagcctgggcgacaacgtgagactcagtccaaacaaacaaacaaaaaatcaaaaggaagttcattgaagcacagcagctgcattatttttctattgccacataacaaattaccacatacttaagtgatttaaaacaacacccaaaaataaaagttgaagatataacaaataaataaaattaaattaaaaaccacccagctattagcaaatgggtccaaatcagaagtctgagtgggctcaaccgggttcttggcttcaggtctcacaaggctgaaatcaaggtgttggccaggccagactaggctctcactgggaggctgtggtgaagaatttacttccaagttcattcaggttattggcaaaatcagttcccgcagttgtacctctgaagtctctgttttcttgtgaacagctagccaggaatcactctcagcctcctagaggcctcatgaaattctaaccaggtgaccctcttcttcacgatcagccatggaggatttatctcaagtaaaatctcccttgtacttcaaatctctgccttcttgctgtgtcagcagctggagaaactctacttttaaaggcctggtatgattagatcaggcccacctatataatctccttatcaactgtgccacataacatggactactgatgggaataaaaccaccatacttattgtccctgggattatgcaggcacatataccaaggggcagggaatcttggggccatcttaggcttctgcctgccccaccatctgtagctttacttgtcctagtgatacaatgtaataacagaatcactgtcatcaagatccaatatggtcaagagttaccacttgctatttgaggattctaattattttaataacaaatctgtattccaccagcactatttccattaaacctaatatttgaattgtgctattcaattgcaaaaaaggggaagttaataatcttgaatatataaggaaggtgaaaagatttaatctttcccttatatctatttcttcatgggcccatctctattgccattttttttctcatttagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactggtaagcattgctccctccaagtactgggaagaaagaagtgctgaggggacctgtgttttgcagatgttttagtttggatctcccaaaagcagaccctgagaaaatgatttacgtacagtttattttgagagtaatccaggaaggtacgagtggtgagacagagaacaaagttaagacagtacagatgggttaataagaggattactggcggggtgcagtggctcacacctggcagggtgcagtggctcacatctataatcccagcactttgggagaccaagacaggaggattgcttgagcctaggaatttgaaaccagcctgggcagcatagtgaggccctatctcttttttttaattaaaaaaaagaaaaagaataagaggactactgctctgccattggggctttatccagctgaaaaactgtgtggctcatacttgaaaattacttgaatggaagaggaggaaactggttggtgctggagcctgatactgttacctccccagcactttcagtaaacctgctagaggaaatcctccgacagatgcagggaagcctcctacaggtgacctccaggctcaggatatatgtgtaggacacaaacagtatcttctataacaaattttattgtaaatatttaaaatacccatgttatgcaaagtacatattataaaaacacaggaatattacctgggtatccaagagagcaaaggacatcaacaaaccaatcaagtaaggggagggactattatcaaccacgctaataactacaaaaatgtgtgtatgaaaaattaattggccaggcgtagtggctcatgactgtaatcctagccctttgggaggccgaggcaggcggatcacgaggtcaggagatcaagaccatcctggccaacatggtgaaaccctgtctctactaaaatacaaaaaatcagaaaggcgtggtggcacatgcctgtagtaccagctacttgggaggtgaggcaggggaatcgcttgaacccaggaggcagaggttgcagtgagccaagattgcgccactgcactccagcctggcaacagagcaagactccgaaaaaaaaaaaatcaatatgataatatagagcacaaaagtaatacacactgtgattacatctatgtaaaatatttatatatatacaggaaaagaatagaacaaagctttgttgtttaacatataaatgcaaatcaagttgataattacatgggatggagttgagattccttgtagttctgtataagagaatgtgggttttcaaaataaactgtgtattgtataacagtttctttttaaacagaagaggctaaaagaaatcatagttattatacttcgataaagatatattgaaaagaatattgtgtgtgacatgtgtgagggtaaagaagcaccaaaccaaaacctgtggaatgatgtacgtttgcagtgtttcggatctctggctttattaatgctccaaagtatgtgaaaatcaagcttgtatttaaaatactctatttgtaacacctttgtgacaccttatttgtgagctttaaacctgttacatatttccaaatttcagtgttttcattacctgtatattttcataaatgttactattttattttgtttttattgtatactttaagatatacaacatgatttgttttcttttttaatgtgagaatgtctttattttatacgctacatttttatttgagacagtttaaaaactgtaaaatccacaaatattaagtgtacagctcaattattttaacatattcttttttcattttttaaaatttatttcctgtaatattggagttacaatgagcttttaaagcaaattccagacactatatttcatccataaatatttcagtgtagacaaacattttatttatatatttatttaatcttattttattcttttaatggcagggtcttgctctgtcacccaggctggagtgcagtggcacagtcatagctgactgccgcctctaactcttgggcttaaatgatcctcttgcctcagccttcagaggagctgggactacaggcgtgcaccaccatgcctggataatttttacacatgaatagtcttgttgcatcaccatcaccaccctccaagataaaggacatttccctcactagagaaaacttccggtctacccaggtgacaaagcccccttgccaaggtaaacactatcctgaattttgtcatcatttagtagtttttcctgttctttttttttttttgtaaaaatttattaacatttatttattttaaaaattgtttttcctttaattttttacattgacgtattttttctttatacaaacacacacacagtgaaataaatgtcactattttaaatgtcatgaaggttttgtttcatctgtctgtatcaaaagaggaagattcataaacgttccgactttaagaaattcaagttttttggatttttttatactttaagttctgggatacatgtgcagaacatgcaggtttgttacataggtatacatgggctatggtggtttgctgcacccatcatcccatcatctacattaggtatttttcctaatgttatccctccccttgtcccccaccccccgatagaccccagtgtgtgatgttcccctccctgtgcccatatgttctcattgttcaactcccacttatgagtgagaacatgcggtgtttggttaagaaattcaagtttttaactaaactaacttaacctcttcaaatgtttcatctttttttttttccctatgaagcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacaggtattatcaaagggtgaattatcatagtgggagggctggctatcaccaagaaaccctgtgactcaaagtcacagatagcttctattttccttacttcatattctcaatctaactaggaagcagaatttaaattatataacctgcaaaggatcatttgcccatctttggtgaagacaagaaatacaatattcctgcctatatttaaaaggcagtccagatcctctcctgcccctaattacctttgaaaagaaggcccaaagcactccgcaatatgtgcactgacacactcacacatcattataaagtgtcagtcttcttccatggcttcacattgttgattattctaattgaacaaatcctttcctgcagcctcccagaggcagagaagggctatgtgtgaagggacatggactactttaatgggctgaccctctgccctcccattcagtgccatactccttctggcaggatgtggcctttctgccacctgccctgggcaatcaatcctgcaacttaactactgaggaactaaagatctgtggctgcagtgatgtctgtgcaaagtccttccaacttttcttgaaattctcgttgcctgatccaaatagtacagctacctgtgtggacagactcagaggggccacttcttaaggagactggaaggaaactctccactttcggaagaggtgataagatcatttaacatctcttgtaaagcccggagcctcacagtccagaggcagaatggtgttgaatgtttaatagagcctcctatggcaaattactctgtagagggtagtgccccaacctccccaaactaagcaacagaattctttctgtgtttgttctatgtcatttggatttcaccacttgctgtttttccagatcgactctatctcctgtggctcttgcttgtcactcttgcctataactggaactgctggtttataccactgcgcctcgtcttcccatatcaaaccgcagacaacatacactactggcttattgcggacatcatatgtgatatcatctacctttatgatatgctatttatccagcccagactccagtttgtaagaggaggagacataatagtaagtggggttcgggaaaggcagaaactgaaacgtgaataacatctaattgggctacaaaaagtaacagcattgttttatttaatgtttgactggctatctgcatggataattgcaagaagtcatgagcaataataacaagaaaacaattataaaacagccattgagtgttcacaatgtgctggagaacatgcatctccctgtaccttagtttcctcatatttaaagtgaaaataacaaaaacaccatcataatattgatggaaagattaaataagttgaggcctgtgaagtgcctagattgtgtctggtgcctagtgaatgagtattaaatgtcagctagcattattgttctagttaacttatttataatacttcccttaatcctttcaatgacactatgaaaaagatgtaattagccccatttacaaatgaggaaactgaggtttagagagggaggttatttgctcaaagcccaaagctggatagtagctgagccaggatcctaacccaggccttgcctctacaatcacgcaggttcaggttagcaagtgtttcagaatttgacaatacttgagcctacaaagagagtgccaagtctgaaatgttgaaactatccacatattttacctaaataatgttttttaaatagatcaattatcaataccaaaagaagaaaccatttaatatatagtcctctggtaatcaagcctcaaacagtctgtgaagcagttgttttctatcacattacagtctaccgttcacttcaatacttttaaaaataagataggtattatttcactcattagaacctactcaaccttcttaggagacagcctggtgttgtgagaaagtactaggctgtaatattttaggacacggactgtgccttgtttatctttgtgtagtaggaaccaagtgaagtgcctccatgtagtagagaaatcaagcacagggttttaggcctggacactttgggaaaacctaacttacaaagcaaagctttcatgacccttttttttccccaatttttattttatattcaggagatacacatacaggtttgttacctgggtatcttgggtgatgctgaggtttggggtacgattggcccaggtactggacatagtacccaataattaggttttctgccctcccccacttcctccctgcattcctcctccctctagtcatccccagtttctattgttctgatctttatgtccataagtatccaatgtttcacttataagtgaaaacatgctgtatttgtttttctgttcctgcattaatttgcttaagataagggcctccagctgcatccatgttcctgcaaaggacatgatctcgttccatggtgtatatgtgccacattctctttattcagtccactgttagtgggtacttagaatgatttcatgtctttgctattgtgaataatgctgcgatgaacatgcaggtgcatgtgtctttttgttagaaagatttgtcttcttttggatatatacccagtaatgggattgctgggtcaaatggtaggtctgttttaagttttttgagaaatctccaagttgatttccacagtggctgaactaatttaccctcctaccaacagtttataagtgctcccttttctctgcagcctttgccagcatcagctgttttttgactttttagtaatagccattctgacttgtatgagatggtatctcattgtggttttgatttgcattcctctgatgattagtgatgtggagcattttttcacttgttttttggctattatatggtcatgaccattttaatcaatatagattcaccgcactgtccaatatggtgaccgctaggcaaatatgtccattcaaatttaaatttgaattagttacaattaaataccattaaacattcaggtttctcagccacattgttcatattttcagaactcaacaaccatgtgtctggtggacagcacagaagatttccaccattgcaaaatatactattattcagtgtggtaagagaatgaaagagcaatgagccatccatatctccatcaatacagccaaaccacagagaggtagccacacccctcacagatatgggcaaatcacaagtacgtagaacacctccactggtgttttgttttttaatgaatatggcatctacaggtctatctttttattctttacttgccaaattcatcacatcctatttctcatgatcaaatgcagtgcccttcctaagaaattagcattcttacccttaggagaaattatcttctcctggatttattctcagtgttgagggaagtttattgtcaatccaatcaatctaagaaacagaaaaatgtgttttcacaagcacaaacccaagtcttataaccactaccccaagccccttccccagctaactagaaggaagctacctttccaactgtggccaatgtgccatcctcctcccaaggctcagcaagggctgcacagaacatgtcctccaatatcacaataggaagagcagactgactgcctatatggcatcttaggtccatgtagaattttgaagaagacagttaggtcgcttaatctccttaatattttctgttgaatcttcagaaggtcttaaattatcaaaaagctgaaaggaatagctttgaatatttttttcttccttaaaataattgtcattttctgggaagtgttttctatatttgaaatctttcctagaaagaaatactaaaggcaaaagccaaagctatgccaaaagtctattcaaaaaattccttgtgcagactttagagcattagttaaatcaccagcaccatccccagagcaacctggcagcttgatgaatggtgatgacggtgtacaaataagaagtaaacaacaacaaaaggaacactaatttcaacctccattagactcacaaggggggagaaaatcaatgtttgacaaatggaaaatgacaaaatcagtaaagggagacttttattttcaattttctaagaggcttttgcacacaatgaagtgttaaaaccaagaaaaataaccggtaaaaaacacactcaacaggctctatttaaaatgcattatcataagctacaaatatagagcaggaaataattgctttgtttgttcaaaagaagtttaatggtttctttaatttagagtaagtagctgcagcctttgaaacttgattacattttggtaagaagactatgcacattgagtacccaacctgaaggtctcatatttagctatccatgctaccattggtaacaccactgaatcattcattcaagagacatttattaaatacttacagttgctaggtagatacatctacttaatttattaaataaatgcaccataactggaggatggaaatatgaattccccaaggccttgaaggaaaataagcaagtaacagacaacagattgaggtgctaacagctacaatagaaaccaggaggccttacaagtttttcacagcatttatttataaaatcttgctcctaaaagtggtgctacaaagataacagaattttgaaacgcagtcaaacaaaaagtctcttgtatgtaatttcctttatagatagcagaaattgagttggaaatgacagtgaagattatttagataagagacactcacatgcacagccctttgctaaacctaccaatcacaaaattcacagaaatcctcagtgtcatctagttacaatgtcaattaggccttcctttataatcaactgcttttggtacttaatcctctcaattgctctttataaaccaatctgaagaaaaccactcccttctctgtgtttcctacactttactcataattctgttatttaattgtgttaaatatcgattaggctaattatgaagtagtagaaaccaacagtctggggtcaaatttcacttctgaaatttgctaatagcattaacttgaagaaactaaacttacccttttattgaatacaatctttttcatcccccaaaatgggaatagtcgtactgttgcaggacttttccttagttcagctaaagacagggtccttggctctcccatggccatgaaaatttaggctcggagacggtttgaagggtgactgaagcagggctttattgtgtgaaaaggtttaaaaaggggggaaacagggatcctccacaaggtcagagccccctgctagagtgcttgtgcccactgttcgaattccaggttccacacaggaagaggagggaccaggctcctccctactgcaaatgtagcaaactttccaaggctccacctcagtgggcaggctggttggagtttctccagcaaccccctcccacctggctatcgcagtacccacctcataaacctattatgaagattgaataagacacctagctcagggtctggcatatagaaaatacacaattgattgtcaaatgaattaaatgaatggttgtccacacacttcacttttccctcttgtctcctatttgtctatgtatctctctttcttacctgaggataagtttcttgagagtagggacagtattcgattcacttatttatctaccctaggaacttagagtatactcaagaaatgtttgaaggagtgaatgaatgataatctcagttcgaggattttatttctttgaataattatttaatctgcattataattgtttcaggtaatattattttaaaatacttcttccatctgtcctgtgtaaaattatgaagtttctgtgaattgtttatcagaaggagtgaatacgggttgcggtgtgcggcttggcgcaggctcacaaagagctgcagtggcgccccatgctcagctttgcggactgagttggcggcggcggcacggggacagcagcgcaccctcgcagccctgcacctgggccagtctcctgaatatttacacattgccgaatctcctgtggacaagacaccacggaggccaggactgttccatgatgggttgagcctcttctcgtgcctagagattccaagaatcctatccatctttttcaccaatatggtttgtggactgtgatgacccaaatctgacatcagttctggaacgtccagaagatactgagaacaacaattaccttcgtcagcaattgaagtggttgatatgtgaactctgcagattatataaccttcctaagcacctggatgtttgagatgctagatcaaccactacccatgggtcagaatgggaaaatagaagtgacttcagaagaagaggaagaagagatggctggagatataaaatacttaaatcactgtaagatgaagaaagaagaacttattagtgggaaaaagttggaggatgaaggaattgaaaaagaaaatttggcaacattagagaaaattaggaagactcaaagtcaaggccatttaaatgtgatgtggtgtttgggtcagtgcaagtttcagatagacttatgaaagagctcagggacgtatgcagatcatggagttataaaacataaaacaggtctgctggaatttttttgtcctcttcctgatagagaattaactcttacatgatttttatcttctggcaaaagcaaagcaatattgcttgaaaaggatttattcagtggaactcgtaaatgacagtacatgactggcatgttaaactgcagaaggtcgaccctgatagtcttttgcacaatgatcttcagatcaaaaaagaaaaagaaagcatagaatatattttgtttaacatgtcttttaagaaactgttgtggttgtcaactgggttgtcgtcctaaagtatgaatctgttatatattaactgaagttgctaatggctacatttttactgactcatatgggggaacgaatgaagaaccaaggccaaacacaaaacacaaaaaaacccaggaaagtagaactttagggaggaggcgatctgagaggtaaatggctgaaatgctactggatttgtgtttctggaccatggctcctaacaccagaaagaagggccttttctggggtaggagtatttcttaagaggcctgggaagaatgttattgccttgagctaactggccttatgaagaggaccttaaactgaattgccaagttattagtattggtattcatagactttggagggtagcaggacaattttccattttatcctccatttgtttgagtggtgttacctgttctctcaggaggatatgtattggatgggggagcactgtgtatggaacttctcacaaaacagggctgtagctgtgcctacacaaaagaattggtcattatgcaaataaatgccatcttagtcagaggcaaagccagagtgcagtttggagctaataagaatcaatataatctagcaagagcccaacaatcctataattccattgtacagatgcatgagaaaaatcgtccctctggacatgctgccacctggccatgcttcctttccctttcatctttctcattgaccaatgggcttggagcattgagaccacaccctattctgagttctagtgtggccctggttaactctcctctggatcagttgcacatctgcccggtagatgactggatgtgtttagcagtggttgccaggatcgtgctgatatggccccaaccccacctcccaccctgcctgtgatgtctgaagaaaccctacagagcaaattggctgtggccaagaaaacattgagagaatatcagcatacaaacaactctggtgtaggtacaagagcaaaaaaggagaaaatgaaaaatggcagcaatcctgagacaaccacttctggtggttgccattcacctgaggatatgtgcaaagaccatgctttctcctctacaactgtctgctcatgacaccatgttagctggtggtgtctcttcccctggtgccagtctcactagcatggcggcacctcagaatcatgatgctgacattggtcccaatctcatggatgaaaccaagactttctcattgatcaagagcccaggacaactcttcaacagctcaattgtcttgcctctgagtctacatcctttgtcaatggggagggccctgcatcatctgctaacctgaaggatctggagaaacaacaaaaccaagaaattctggatcaactggaagaagaaaagaaagcaagcaactgaaagcagggagccaaagggagtggttacaggttcaaattcagaccatagggatcctcatgtccgagaaggcagagttatggacagctctgtattacactcagcatgctgccaggcagtttgaaggagagtcaaaggatctggccagctgcctgcagtattcctggcgcgtgtgggagagttggagtgggctctctctgctgtctctacatagcagaagaagacacaaatacaacaaagagttaaccaaggagagagatgccctcaggctggagttatatgaggatctgaagccacagaactcagaattagaagagaaatttgagtcctagtgacagagaagtcaggaatccagctcaacttggaggatctgcaaaagaagctggagaggccaagctcctgcttcaatagtcctcaagccagtgtgaaccccctgatgctaaccagcagttacagcaggccatggaggagcaggcacagctggaagcacacctggggcaggttatggagttgctgaaacagctacagatggagaaagaccaatatactgaaaatctgaaaggagggagggccatgcggtagcagaggatgcagccgatgtcagagcaggtgcacacattgagggaggagaaggagcacagcatgactcgggtacaggagctggagaccagcttggccaaactgagggaacagatcgctgaacccctgctcctggagcccccagcagggccctctgaggtggagcagcagctataagtggaggccgagcacctgcggaaggagctggagggtctggcaggacagctccaagcccaggtgcaagacaatgagggcttgagtctcctgaaccgagagcaggaggagaggctgctggagctagagcagaaggctgagctctgggaggagcaggtggaggtgcacaggcaaaccctggagaccatgcagaatgacctcaccaccatcagtcatgcagtcttccagaatggtgagctcaaagagcagctggccaagttgcagactggcttcatgaagctgaacaatgagaacatggagatcaccagcacaccacagtcggagcagcacatcaagaaagagccgagcgagaagctgggtgagctgaaggagatggtagagctgaagagccaagaggctcagagtctacagcagtagtgagatcagtacctgggtcacctgcagcagtatgtggccacctatcagcaggtgccctatgagaaggagctccacaagcagttactgctgcagacccagctcatagaccagctgcagcaggaggaagctcagggcaaagtcgtggccaagatggcctgccaagggttgcaggagacccaggagcacctggaagctaccagccagcagaagtagcagccacaggcccagctgaccctcatggctctccatggggaaggagatggactggacagtgaggaggaggcgcttccgctcatgccaagcatcccggaggaactggagagtcgggaggccatggtggcatttttaaactcagctgtggccagtgccgaggaggagcaggcatggccacgtgggcagctgaaggagcaaagggtgagctgtcaggctgtcagtgtctggctcacctggtggcctcagtccagaaggagccagaggcagcagccctagtcccagggactggaggcgattctgtgtgtggggaggcccacccggccctgcagggggccatggagaagctgcagagccactttatggagctcatgcaggagaaggtggacctgaaggagcagatggaaaaactggaacgtcgctgcatccagctgtctggagagacagacgtcatcagtgagggggaggccagggcatggcagggggagctgcacggtggtcagaggggtcccagcgtctgaaccctgtcctcccgcaggaaagtacatcacactgtaccagagctagaggtcagtgctgaagacgtggcaccagaaggaatacatcagcagcctggcccaggacaaggaggagatgaaggtgaagctgctggagctgctggagctacaggagctgcaggagctggtgttgcggcttgtgggcaaccacaacaagtggcatggcaaattcctggcagctgccaagaaccctgttgattagcccgctccaggtgccccagctcccacaggagctcggggctgccaacaaacagggtgatctttgcaagatgagcctcgcccacagcgtggagcctgcacaagaagaggccagggagggttctccccatgacaatcccactgcacagcagattatgcaactgcttcctgagatgcagaacccccaggagcacccaggcttgggcagcaacccctgcattccatttttctatcatgctgacaagaaatgaggtgaagatcaccatcatctaaaagccggccactgtcagcaaagcttggagaagtggggccagaggctccatccccaccaggtccttaccaccccttcccagtcaccccattatccttagaggagcaaggtaagacccctgtgtgatggggggagacaaacaagtgcagaccctttgccaccttggccagggctgagtccttaatttctggatgattatgttgttatttaagagccagaggctcatagggttgatttatttgcaggaggcctggtggcctccctgatggcctgactcactaagcaacttttccttcacgggggctcccatcttcttactcagagaggcagctgaggcaggacaatggggctaaatgtagaccaggcaagagaacaggctgctgggggtggctccccttccccagtgtacatattctatctgtgtaaaattttgtatattccagggtagggccaccccctgtatcatacatagaggaggttgaagctggtacatggggaggaggttctagtaattatttgggactgggaaacttctttattgatagtacgggacagagaaaggaggcaaggatggggtcatggtgccctggtgatgcaacttctgtttattttgctttttcttttggaataaatggatttagccattttggttgggggggtgggagcagaaagaagaggtaaatactaagtaaatatactaacacctgagtagatcttcttcaaaagctatctattggaaaaggatttaggtgcaattagcatatccttcctaaagtaagcctcccctgaagaaatgtcactggtataatcatgaggcttaaaagagggagagataattaagtggggtgacattttaaaaataagtacctaattgttaccggtaagcatgctgatcctcataaggctaatgatgccaagtttatttactgctctaaagaagatagattttaaaatcactaaatcacatttcatttaatctagcaagttttagttgcatttacatttattcaatcatagaatcatagacaaccttgaaagtaaacagacaaatatgctaagaacattcttcctgagtgcagggtggaggtagtattttaacttaactgtctagcacttgatatctatctggctgtcccatataaactttgagggaagtgactgattttactcttgtggtacatgatttataacactatttatttgaagccgtatctatgtctacccatggctcagtaagccattttgtttcacagtaaaaatcattaaatgagcatgtcatatattttctaatatatttctgtaaaatttagtacatgtatatgagtaaaaattatagccaaaaaagtcagtagtgtggggagtaactagggagttgactaaccaatctttaacattgatcaagcagcagtttaaaacttccagacagcctgaatgataattgttagaagacgctacttccatgtgtccaagttataatgctttggtcaactaattaagagcccttagaaaatcctttactacatataagtgaaacataaaagtccaatattcaaattaattattttaggtctgaatattaacaaatgccactctagtcatctatcactcgtcacacatttattgaacacctactgtgtgttagacactgtgttaggaactgaggaaatagaggacaaagattggaccctactgtcttacatagctcagaatgtctaggacagaccaacaaaagaaaaatggtgggattttatgttgtgagtcatgaaaaggcatgcccagggtgctataaggctcagagaaaaccatctgacagagaagacccttagtccaaatcttgatggatgagttggagttacctgcacctttttcctccacaagaaaaaaagaaaaacatgttctgagctctgggacagcatgggcaaaggcatccctctgacgcatttgaggaaatgctgaacagagtgggttctgtttctgggatgctccgggaagtgagtggaaaacagaaagtagagctttgtataccctgaaaaggtgcttgcacttttttccttaaaatcatgtggagttgcaggatttgacataaatgaggattttaagtgatctgatttagagatcatctggcggccactgtagaatggatcaaggggaacaagactaaaggcagagacagcagtgccagaaagcagagaatggccatgagaaaattttaggaagaatgagtagaacttggctattggttgtatcagggctgagggagaatgtgcagtgtaggaccactaagcagtgtagatgagattgctcataggatactcggaagcaggaggagcagcagtttggctcaaggagaatgaagaatgatgatgaattcaggtttggtgcagtggatctgctaagtgaagaggacaatgggcagttgcttacccatcaacagctcaagaaagtgatattagtggaagtagagatttggtagcatcaacccgcacggtaatctctgaaactataaatgtgggtgagatttcccaggaagcaagtatgatgagaaaagagaagagagctaaatcctggggaatgttgacttttaaatgactagcccaagaatccaagaaaactgaaaagtaggaagtgaagatataagtaaactaagagtgggattacagattctttgaaaagaaaaagtttcatggaaaaaaattgtccaaaaaatttttaatgcttcagaggttttattcatctctccatttctttattcattcagttaataaatatttattgggcttttagtatattctaggcactagttaaatttagttgctaaacaaaatcaaacctgtcctcagatagattaccgtttaatggagtagactaattttaagtaaatgagccaagcagtatacgtgtcatttcaaatcatgatgaatgccataacaggatgctaagtgccataaaggatatcctgggcatgatcattaggagatcattggtgacctttgcactgttagccttgatgcaatgagagaagcaggaagaagccaaattgccaccaaattgccatgagttaaggatgaatgtgagggaaggatatagagtaaagcaggtaggcaactctcttgagaagcttgattgtggcaaacaatagggcaatagtaagaagaaaactaaagccaaacattttttgttttaatacctgggaatatggaggatgtttattggctgagattggaaggaaccaaccaagagaaacagttataaatttaaaagtgagaaaaaaataattgatgaaattggctaaaattaatgaaaatacaaatatctttcaggtggattcaaatgagctaaggaaacactacaggacttctccaaaatttcaggtaggtgacaaacaatttcaaagttgctcacgtgatctattaccattttgactttaaatcccatctatagatttctataaacaaagtttgtacatacgaagttttattagacaatgataagcctgaagtttctgcctctcaataattacctgatatgtttccttgtatgtgcaagtgggtaattcaacatataagcccttattaagcagaccaaaataagttagtgcccagatttgaattctaatttacacatcagtaaaggaatatgggttgtatactttgtcttgtctacaaaattctagcccccaattcatgtagcatgatgttgtaaaggtttgcaaaattgtttttactcccgcttctttcttgttctcatatattcaaaataaaaattattaatagaagagaagcaattgtttagataacatggaacgttcctttcctaaaacataacgttttattgcccataattattttctaagtactttgttctctgagaaataggcagaggtcaggggttatttaggtttacccaattggagtgaactctagcctctcacttcaaagacaattctttagtggcctcagagtttgtttaaaaatacaaatctgggtttaggtctcagactatccttgttggaaatctacaatgattacatccctttcaattgttttttttttaatctccgactaattttctttattaaatattgccacatacttaggcatattcataaaagatctctatgctgctttgatgaattctacaaagaggataaatacttttgtaatgccataaagcttattccaaactcttactttcctgagtttgaataaggactaaattaatttatatatttaatatgtgttagcataatggcatttcagtcaatgacagaccacatatatggtgatggtcccataagattataagggagccgaaaaatccctattgcctagtgacatcacagccatcataacattacagtgcaatgtgttattcacctgtttgcagtgatgctggtgtaaacaaacctactgggctgccagtcatataaaagtatagtacatactaatatgtatggtacataatattggggataatggcaataaacaactatattactagcttatgtatttactatcctgtactctttattgttatttcggaatgtactcctatgaatttttttaaaagttaattgtaaaacagcctcaggcaaatctttcaggaggcattccagaagaaggcattgttattataggaaatgacagctccacccatgttatggagcctgaagaccttccagtggggcaagatgtggatgtggaagacagtgatattgatgatcctgaccctgtgtaagcctaggctaatttgtgtgcttgtgtcttggtttttaacaaaaaagcttaaaagtaaaaataaaaacattttaaaatagaaaaaagcttatataatacatatataatgaaaatacttttgtatagctgcacaatgagtgttttaagctaagtgttattacaaaagagtaaaaaagtttttaaaaattcaaaagcttataaagtaaaatagttacagtgagctagggttactttattattaaagaaaaaattgttaaataaatttagtgtagcctaactctacagtgtttataaagtctacagtagtgtacagtaatgtcctaggccttcagtcactcactactcgctcattgactcacccagagcaagttccagtcctgcaagctccattcatggtaagtatcctatacaggtgtaccattttttatctttcgtatcatatttttaactgtaccttttcaatgtttagatgtgtttagatgcaaagatatttaccattgtgttacaattccctacagtactcagtacagtaacatgctgtacagtaacatacaataatatactgtaatatacagagcatgctgtacagtaacatgctcctaggcctgtagcctagaagcctaggcttgtatgtctataccataccacctacgtgtgtagtaggcaatacatctaggtttatgtaagtacatgctatgatattcacatgatgaaatcacctaacaatgcatttctcagaatatgtccctgttgttaagtgacaaatgactgtatttttgtacctgatcattcactattagcttgttaacttcttgtgaatagaaacaatatcttactcctatttcaaccccaacatgctttgcaaattgtcttgcacagggtttagtgttggtcaatacttcaattcaattttctacagttcaatgagaaataaattatctctgtctacacaaatctgtgccaaaaatggccaatgattaatgactgtctgcctagagaagttgagaggggagttgaggaattgaatagaaagcaagcaaaaagatcgttatgatttaagccaaaaactgtaagttttagggtagcactatgtcaacagtgtatctgcttttttattttaaatacattattttaattacgttctgtacacttaacttgttacaaagatcgatacctctacagtgaaatcaatgaggtttgatgatatgatgcaatttctaagccaatacttttagtaagtaatttgtttataatagctaatctggttaattcaaaccagaagtccctattcttgttcaatatcggcaggctttgaaattgttaggcaattaattatctcaactctatgcttttggggtacaagtggtttttggttacatggatgaattatatagtggtaaattatgagatttcagtgcacccatcaccagagtagtgtacattgtatccagtatgcagtttttttgtcccaccccaaacacacccccccttctggtcttcaaagtccattatatcactctgtatgcctttgcatactcagagcttagctcccacttataagtgagaacgtatagtgtttggttttccattcctgagttacttcacttagaataatggcctccagctccatccaagttgctgcaaaagacattgattcctttttatgtctaaatattattccatggtgtacatatgccaaattttctttatccactcattggtcaatggccacttaggttagttccatatttttgcagttatgaattgggctgaaataaacctatatgtgcgtgtgtctttttcatataatgacttcttttcctttgggtagatagccagtagtgggattgctggatcaaatggtagatctacttttagttgtttaaggaatgtccatactgttttccatagaagttttacatatttacattcccaccagcagtgcatacacactccccttttaccacatccatgccaacatctattgttttttggctttttaatatggccactttcaggaataaggtggcatctcattgtggttttaatttgcatttccttaatgactagacaggtcactaaaaagcagacagtgtgtctgcttttttatttttaatacattattttaattactgttctgtacaaatcttgttacaaagatcggttggttccatattttttgcaattatgaattgggctgaaataaacctatatgtgcatgtgtctttttcatataatgactcttttccttttggtagatacccagtagtgggattgctggatcagatggttgatctacagaaatctgtgccaatgtgttaatattaaaatggctaatgactaatgactgtaatcatagaggagttgagaggggagttgagcaattgaatagaaagcaagtaaaaaaaatcattatgatttgagctgaaaactataggttttagagtagcactagacaggtcaacagtgtgcctgctttttcattttaaatacattattttaattactgttctgtacacttcttaacttgttacaaagatcaatacctgtagagtaaaatcaacgaggtttgatgatatgatgcaatttgggcgggggggcatttttttcatgttttttggccatttgtataacttcttttgaaaaatatctattaatagcatttgccaactttctgaagagattatttgtttttttcttgctgatttgtttgagttccttgtagattctggatactagtcctttgtcagatgcacagtttgcaaatatttcctcccattctgtgagttgtctgtttattctgatgattatttctttttatatgaagaaacatttttaatcaggtcccatttatttatttttatttttgttgtatttgcttttggggctttagtcataaattctttgcctaggccaatgtccagaagagtttttccaaggttatcttcaacaatttttatggtttcaggtcttagatttaagtctttgatttatcttgagttgatttctgtataaagtgagagatagggatctagtttcactcttccacgtgtggcttgccagttttcccagcaccatttattaaacaagatgtcctttccccaatttatgttttagtatgctttgttcaataccagttggctataagtatttgactttatttctgggttctctattctgttcctttggtctatgtactacttttataccagtaccatgctgttttgctaactataagtctggtagtgtaatgccttcagatttgtgctttttgcttagggttgcctgggctgtgagggctctttttcagttccatatgaattttagaattgttttttctaattctgtgaaaaaaaagttggtattttgatgggaattgcattggatctgtagattgcttttggcagtatcgtcatttttacaatattgatccttccaatccataagcatgagatgtgtttccatttgtttgtgtcatctgtgatttctctcagcagtgttttgtagttccctctgtagagatctttaacctcattggttaagtatattcctagggatttgttattgttgttgttttacagttgttgtaaagggattgagttcctgatttgcttctcagcttggtcatttttgtatgtgtattggtgtatagcagtgctactgatttgtgtacattgatttcacaacctgagactttattgaatttgtttatcaaatctagaagtcttttggagatgtctttgtgttttctaggatacgatcatatcatcagcgaacagtgatattttgatttcctcttttttgatgtgaatgccctttatttctttctcttgctggattcctctgtctaggacttcctcagctctctattttatatgtgtggccttacaatatgttcttaactgctcttaattgtcttaaaatgtcttaaagtttttcatataccctattaagaccatgtaaaatttaataaaaatgaataattattttacacaaaagaatttcttattgttgttgccatcaagaaagtatgaagtatgacattgtcatttcataatgaccagggtaacagaaggccaaaataattttaatacatgacaatttttgaaaatttcttagctataataatattttcaataccttctcccatcagagctgctgattaattgcaaacattattgatttctttgctctcctctctcagcctgcacaggctctgatagatacttttaaagcagtttattggtagcaaaatggttcgaagtagacaagagtagaaagcattgaagagcctaaatgaaccacaatataatcaactgtgaacacaggagaattggctgaaacataaaaatatatcactacaatgaaagtacaatgctttcaaataaaatcaagaatggacttgatttttagtcgaagagccccatgttaaaaacactgttaaaacgtattttaacattagcaactatgcccattgtatatgtgacagctcaataaaaatcccagtaaatgcaacgcctaaggagagatcagatgcatggaggtggaaatgaaatatgttggaagaaggctacaaaatagttttcatggtgctaatacgccttaaaaagccccatgcatagttaattgaaagcagttttggattaaacaacaaataatatattgtgattggtcaacttttacagacatcagcgtaaatccatccattcccagaaaggcatgtaaacacaacatatttgtgaatgtgttctttcaacagttggatgtcgcatcaataataccatttgatatttgctacctcttctttgggtttaatccaatgtttagagcaaataggatgttaaaggtaagataactatatttaattgtcttttcccttataatggaaatatttctatttccctataatggaaatcttgaaacaatttaaagtatcttaaaatgatcaatattcttaatttttcccaaactcttctccatctttctgccctcatcaatgctataattttttttaatgaatgaagaaaaaaatgtctactggtgaaagttgctcctggtttttatttcatatctcataacagatgtttttataatctaaaatagggatgctttgtatttctaaatttagctataattacaaatgagtattttatactttttgtttttttctatttgtcctttttcagttgctgaatgcatggtgtatgggatgtaaaattaaggggttaggttagattaccctaaattatcttactcatcttaaattttgtaattctaaaaaaaaatgtaaacatacttttacatcacagacatgctttcacaagtatgtgagcacatactttcacatcacatttacttacatacttgaatataactcaaatgtttctcaagagggaattagttaaatataccaaaatatatttatataatttatatagtagaacattttgtagctttaaaacaaagaagaggaagctttttatgtactgatatggaaaaaacttcaagataaattgctaagtaaaaaagctagttacagaacagtttatagaacaatactaccttctgtataacagaaaaggaaaaatattcaatttttgtgtatttacataaacactgaaaagctacaaaaagaaactcatcaaagtggttacctgagatggcaagggaaagcaggaaggaaaatcaggacggataggggcaagagtaagagtgagactgttggaagcatatatttcatattgtttttgaactatgtgaatgtattacctattcaaaatggttataagacataaatactttataactcatagcttcatttgatacctaaaaagaatttgaggagagtcagaaattgaaatttcatgtaaatctttaacaatagcaacaatatatttccaaaaacaaccttcttaaagggatcacaaaagactttataaattgtaggtaattatctattttgcatcttgggaagacaagataacataacctggtaacaccagcagatcctgacaacaacaacgacaataatagttgcagctgtctgttgaatacacacttgaggctacacactttgctaaaactttatattcattatctcactgattcctcccaacaacttcattttagagacgaagaaaatgagaattagcatggcggaaaaatctgtccagacacactgcatatgaggggcagtgtctgaactctatcacatttatctaactccaaattctttattataatcagattgactgggtaggcctcaggctgaaagggtttttttttctctgctctgatatttaaacttcagaggttctttatcccatatttccaaacatctgagacaactctagagacttctggtttgaccatggaatgtgagaataaatggaggtggaacacaataatgttccaagcaatctagtggtcaggccatcccttatcaaattttcagtctcacatggaaatttcagaaggtacctgcttggacataaacaattttcagaaattctcaggtttctatagatttaggagtttatctggcattatgataaaagcttataaaatgccaactcttcattccccatctctgtaacctaaaatgtccaaaagccctctctatccattagatgtttaaatataggagatcctgacagtcaacattaatcttcttttcaaagccccatagtccattcatataacttatttttaagggtgtcatcttaatgcacaattccctaggataaatatttatcatctatatgtctccaagttataaatgagaaaacaaatgaatatacattttatttttagtgaacacttaagctaaatttaaaatcatgcctttgtgcaaacttgtattaagagcacaataaacaaattaccacacatttaaattataatctgagtgtttaagaagttttttcctacttaggaactctggaaaaaacaaatcatttgtgtatatttctagttaaatagtcattactattacatatactatttttaattctaaacgttctattgcagtcatatctacgttgggcaaaattttgaactaagtaatctctgcagtcccttctatctgtaagagtctatgatttgaagcacattaaatatattaactcatgtatgcacacaacccttttggggggcatcttttcttattgatctcattttacagatgaggaaaccaagacacggaaatagcaagagacttttccacagttacacagtagtaagtggtagagatagaactggcattttgctctggattccatactttactgcctatagaaacaaaagaggaagtaggaagtaggaagtaggaagtaggagtgcatgcaggcagaaaaggttgagataaaagtagaagcaagcaagaaaaaaccttgagggaaatagtaactctgcttgtatcagatgcacataaactctttgtatctttgaataatgtcaagaacggccaatgctaatacttactgaactttaaattttgtttaaacaaatacacatttaatgcaatttactgaaaaataatgctagtgttgagcaataagacttaacatctatttataactttaatgcattatacttttcctcttttatgtatgtttttggagagtgtgactttaattgttgggaaacagagttctactacatgctttcaaaacaaaaaggaaaacaatgttttttaagtttcattttcaacaaacattaaaaataagactataactacagggtagcaataaaataaagcaaaataaagctctggaagtataataccatgctataaaatgtactgtccagaggaaaatatcactaaacaggatcttggtttttttaaaaagacatatgaatgaaattattttcagtaataaaatctatttcatatagttttatttaaatatatatatttaagactaacatgcttttggatttcttttgcttttctatatagtacacttcattttttgaatttaatcatcacctagagtctataatggacaaagcatatatctacaggtaaagtataactcagtatacttgggggaaggggaaaaagcaatggtacaacattttagacggaatttggcagggatatgacccccctcttcaaaaaaaggatataatttcagctttggctatataaaatataggactatgttctagaacagatgtggatattttaagtgaaataagagtatgaaaatcatatcagattttagaatactggactaagaaaataggacttattatctgcctctgtcaaaacaagtacagaaaaacatactcttttgcaagttaactttaaacctttctcatgataattcattcctaatctgaatttcattcgtttgttgttctaaattttacttgcaccgaaacctctagttgccattcatcgtagcataaagtctcatgagcttttcagagatatccagttaaattagcatagtgtattttatgggacttaaactgaagaagtgacctttgaggcatgtctttcacggagttgactcacaacatctgtgaaaagagaggaagttttctttttcttttttttttctttacactctgtcaatcccagtcaagacattgccatcagaaaacatgcaatggcaccatcactttgtactgtactaatgagagttaacagttcacaaatccaaagcaaggggttcgctggtgactttaaggaaaagaaaatgttaaaataggctgtatttcagaaacaacatgaatcttactttgcatctattctctctgacagagttattcgaacaactggatacttgctgtttattctgcacattaatgcctgtgtttattactgggcttcaaactatgaaggaattggcactactagatgggtgtatgatggggaaggaaacgagtaagttctgattttgaaagaaacctttattgattatttttaacattctgtttcattgtatgaatttatgagagccagtgtttttgaagctgtcataacccattcaatggctggtaaatgctatttggccataaaaaaggataaaatcatgtcatttgcaccaaaatggatgggactgaaggtcattatcttagtgaaataagccagacccaaaacgataaatatcacacgttctcacatatatgtgggagctaaaaattttgatcacatagagacagagagtggaaagataacagagactgggaagggtgagtggtggggagaggagcgcataaagaaaagtggattaaaggatacaaacatacagtaagaatatattcaacgtttgcaacagagtagggtgactatagtttcaaaacatgtattgtactcgagtaataaacaccctaaacaccctgacttgatcactatgcattgtatacatgtaacaaaattgcatgagtaccccatgaattggtctaaataaaaatttttaagctgaaaaacctctttagtaagtcaatacatttttaaatgaaagaagatagagaataatagaatagaaaatatcagagtctgatagatagtaggggagtgtgtgtgtgtgtgtgtgtgtgtatcctgagttggcctgtgaaatgcattttttactctggatcatgatcaaaaaagtttgaaagcctctagacaactgagcagtaaggtaacttttaataactccgatgccgattgttagtaatgaacaatgttaattatttaaagggcaggtgcagtggctaattagtttaccagtgaagggttttatgggtttatgagtcagctataaccactaactcaattaaacacttagagagtaacgaggatcataaattaaacttgacaattaggtatgcaagtgtcccagaaataaaaaaagatcacttgaaaaatttagaacagtagaatcaggactcagaaatggcaactgggttatttaatagtgaaatttccttttggtaaaatacaaagacctggcataaagttgacttcactaactttctgctccagtgaaatgacattgaacatataataaggcaatgtccaaactggaaaaaaagcaggtcccagcattactttgaagggcaactcactgcagccttgggatggagagcaattataggatagagcaaagagagggaaaataacttacaaaattacatactacctagagtgagttggatatgcataagggattataacaaccagaaccgattttaaagaatttaaagtcagaaggaccactgattgggaaacacacacacacagacactcaatttccagaaaatttactaaataaataattccctttagaatgtgaattatttactttgatataaacaactaatttatctaaaaattgactaaaataccagctacagtaaaattgcctcaaagtgaatatgtaatccaacatcattagatgactgtggctgatagctgtttttttcaaattagcaaaacaatataggattgcatcagaatgccttccagaaagtgaagctatttctccttttacacctagacgcctctctgtggagtttctagggactatatcttgttcccagtgttaagctcagtgttaagtatataataatagacaatatataggtatataaaagcaggaagagagagggggagtaaggaaaaacgaaaggaatggccaaatctgcattgtaacaagaagaaagaaatctcagctttagcccataagaaacttcaagtgtgctagtgttttggatttctaattccagctacatcatagcccaggtagccaagatactctctctaaaatgcaagataaattacctgttgtaattttgttaagttacttattataattatttgttataagtttctaaatgaatacaattacaacagttttcagtgattgctgagttccctagaaagtaagaagtatctccaaaggctaaaacacaaacatatgtaccaaacctggagtacaatagaaaatgagtgtgagtaaccactaaagaacagaaatagagagaataacttctaaattagtataaggggaaaaaaaaatgaataaggaaatttaaaaagcaaaccagtccaaaaaaagacacaaagataaggagtggcagttttggggagaagtacaggaaaggcaggacaatagaagacacaacataagatggtaaggacaatttaaaatagatcagtatgttaccagaaaggggtcctgatccagaccccaagagagggttcttggaccttgtgcaagaaagaatttggggcaagtccatggaataaagtgaaagcaaatttattaagaaagtaagaaataaaaaaatagctactgcataggcagagcagtggcatggactgcttagaatacctacaattatttcttgattatatgctaaacaaggagtggattattcatgaattttcagggaaaggggtaggcaattcccagaattgagggttcctcccctttttagactatatagggtaacttctggatattgccatggcatttgtaaactgtcatggtgctggtgggagtgtcttttagcatgctaatgaattataattagcgtataatgagcaatgaggatgacaagagttcactttcatcgccatcttggttgtggtggatttgggccagtttctttactgaaacctaatttatcagcaagctctctgttacctgtatcttgtgccaacctcctgtttcatcctgtgacttaggatgcttaacctcctgggaaggcagcccagtaggtcgcagccttattttacccagccccttttcaagagggagtcactctggttcaaacacctctgacaaatatgtgcagtaaattaatgtgaactaaactcacatgctaatagagattgtcaattaacattagtcaaaataagctttaaaacaaaagccattttagagaaaaagttcaccatataatgataaaagttttgattcatgattgtcaaaagacaaaattgcaacaaatttattttaatgatcttaattggcttttatttgcaattctagaatcacgcaacacctcaattctataaaataaaatgagtgttctgatgagctgagcaaaggaggttggcttcataggcagaaaagggctgaagaaagcagaaacagagaacaaaaacggactggtcatttcaaagttactttccctctaaaggttaaagtagaggggacttccttaccatgctggataaaactggctagtttggggatttagctatctctctttctctctctcctgatttcttggaatggcagataaacaacttagtttcagtttggtgacatagaacttcagcatgagtaattccattttgctttggtctgtttggcctagtgcaagagtttagtccaaaccaatggcctcctataaattttatttactaccatcaagatattccaattctaaatgtgtatgcacccaataaaatacttacaatcattcaaagaaaaccataaagcaaaaattgatagaaggaggagaaattggccaatatatcatcaaagtgtgagacaccaaacataattattgacaggtcaagtaaccagaaacaataaacatataaaagatttgataacccaaataacaagcttgatttcatgggtacaaacagaatcttgcacccaaggattagaaactacccatttttcttaatcactcacagaaaaactactaaaagtgatcattttctaggcccaaacctagtttcgataaattccacagccttgttatcatacaactcacattctctgactataaatattaccccatcagctctgctctgctcatttagactgaagcattctcactcaaaaccaaagctccaacaatcctgttaccaactgtcagggacacaggttgccacccttgcaatgaaaatgcttttaaaagcagcctctttacttatctttttagataatttgcatatgtcagttactagtatacttatcctaatagtttttttaacatcaatttctccttctattgcttcatgttaccctttgatcttgtaagccaagtttttgcaataattacctattttttaacttaacccttgtgatggtcctggtgacctataaattgaaggttgctcattaggcctttggatttgcaaattttgacctagttagaattaggcagcagactgtggggcataaatggaacactgtgaacatttaaaataagtcaagtttattatgattccattaattctcatcagaacagcaatttctattcacatcaatagaaggcatttttatttatattgagtgaataacatccttctttagactgtaaaatgtgagaaagaatgcaaatatttagttcaaaaggagaacacaagtaagtacctaagattatgtgatacttaaaaatgttcccaatgtatttttgtccacatatatcccaattttatgtattttctgacataaatttcccactgtgcacaaattttttaacaaatccacagtcccagtccctaatgtatcttttctttgaaaaaaagagaagtaaacaaggcatcatgggaattattgactttagttgatgtaaggaaggaatcagaattactataccatagtgctagaaaaatttaggtaatccaccttctcaattttacagataaagatgatgagacttaggtagatgaaaatatttattcaggatgtcctagatacctcatagctgagatcagacaatggcagagagagagaaggaaagggaggaggggggaaagggagaggaagagggaggatatttatattacaattcctagagggtcacccttggaatataacaaaaacaaacaaacaaacaaacaaaacaaaaaaaaaaacccagagcaaagaatcagtggatcagaaggaagtgaaggtcagtgagaagcatgacaggggagagttcagaaggagattcaacagatgtgttcacagatacagtcttcctacattctcatttcagtaagtctaggtatgcattcactcatccattccagtcattcaacaaatattagtgaattcctattgtgtgctactaggcccataaacacctacctttgtagcacttacattctaataagaccgttctccctcatagccattgcttccagtaataagtttacagaaactagggactaagatggattgaggtagttaggaaggtccacacagaaagataagtatagaaggggtacttttaaaaattgcatgtcccactacagatttaccacaatggctgaaatttaaaagactgacaataccaagtgctgggataatgacaatgccaggtgttaggataacatggggttactggaactcacatattgttagagggaatgtgaaatgataaaaccatattggaaaaagatctgacagtttattttacaactaaacacaactaccctacaactcaaaaattccaatgtaggtattttacccaaaagtaatgaaaatatatgttcacagaataaaacttgttcaagaattttcacagaagctctattcatcaaaaccaaaaacttgaggcaggctaggtattcatccataggtgaataaataaacaaactgtggtataaagatacaatgaatactatgcagcaataaaaaggaataaattaccaatacacaacataaataactctcaaaaccatactgagtaaaagacatcttatacggaagcatatatactgtacgatttcatttatgtgaaattctaaaacaggcaaacttatccacggtagaaaaaaattagaacaggtgattgcctctggcgcatttgagtaaggattgactgggaaaagaattgagagaactttctaaagtgatggcaaggctctatgtcttaacatgtgttttgttacacaggtatatgcatttgtcaaaatttattaaatgatacaaaaatcagtagcatttctacacactaacaataaactctctgaaaaggaaattaagcatcaaaaagaataaaatatttggaataaacttaaccaaaggggtgtgagacttgtacactgaaaactgcaaaatgctgataaaaaattaaagtagaaactaataaattgaaagacatctgtattcaagggctagaataattaatattgttaaaatgtcccaactactcacaatgatctataaattcaatgcaatccctatcaaaatctcaatgatttttttacaggaacagaaaaaaatccaaaaatttgtatggaaccacaaaagaccccgaatagctaaagtaattttgagcaaaaaggacaaagccaaaggcatcccacttcctgatttcaaaatatatcacagagctaccataatcaaaacagtatgaaactggcataaaaacacacatatggtccaatgaaacaaaatagagagcccagaaataaatgaatacatagatggtcaactgcctgtccaagggtgctaaggatatgcaatgaggaaagatagtctctccaataaattgtactgggaaaactggatatccacaaacaaaagaacaaaataactaccatatgacccagcaatgccacttctgtgaatatacccaaaggtattgaaatctgtatctcaaagagacatctgcactcccatgttcattgcagcattgcagcattattcgcaatagccaaaacatggaaggaacctaaatttctctcaactaatgaaaggataaagataatatggcaaatatgcacatatataatagaatatcattcagccttaaaatgaaagaaattctgccatttgtgacaatatagatagtgctgggggacattatgcctagcaaaataaacaagacacagaaagagaaataccgtctgacctcatatgacctcacttgtatgtggaatctaaaagagtcaatttcgtagtagtagagagtaggatgggggttaccaggggctggaggaaagggataatggggaagtgtaagtcaaggagtacaaagcttccattatgcaaaatgagtaagtcctagaaatctactgtatggcataatgcctatagataatactgtactttctttaaattcaccaaatggtcttacttaacattagtgcctttttttttttttttttttttttttttttgagacagggtcttactctgtcaccccggctagagtgcagtggcaccatctcagctcactgtaacctccgcctcccgggttcaagcgattctcctgcctcagccttcctgagtagctgggattacagacacccaccaccatacccggctactttttgtattttaagtagacacggggtttcaccatgttggccagactggtctcaaactcccaacctcaagtgatccacccacctcagcctaccaaagcactgggattacaggtgtgagccgccatgcccggcctcattagtgctttaactgtatattcaaaataaaacataactctaaacaaatactgaactccagttaacatatatattctgaagtactgtttttaggagaaagtttctggctgtctagaaattattttgaaatacatccaaaaaataagaaggttttattgataaataagtggaggaatatgtgacgaagcaagcatagtaaaatgttaatggtagaatctaggcagtgggcatgtgagtgttcactgtaaaattcttttaatttttctgtttgtttaaaatgtttcataaaaatatattgggggaaattgcatgttatgtttgtttcacagagaaaggctttctattttcatactaaatatttttatggctttatgtcaaatcctgccttactgctttaagtatgcctaagtatatgtgtatgtgtatatatatatatatatatatatatatatatatatatatatatcatgtgttatacagttgatgcattgtatagctaataattagatacttcatgtgttaatccagccagatagaatctctttgaaaagatctatctgactgggatgtagatattagagatggacacacttgactaattaagctaatcttaggaaatccataagaggtcatctaattaaattacaaatcttacctttggttatgcatgtctaggtgtaagatgtgactgagaaaagaatcctaaaataaatctcaaagcatcagggcagaaaacttccaattaacatagcagactatttaatataaaaaaaattgttcaagccaaacccttgagatttggaaaatccatgccaaaattttacatttgattgttattttttaaaatcataaaaaagaaaatgggagaaagtaattcttatgtttgttcctgttaaagtaggacaaacttttgagtgactttggaggggaagtaatcccaacacttatcatggaattgaccatgttgggagagaatcttgtttctcttcactcttgggtaatgtcaggtttaataaatttccttaatttaaagagacccacaggtccaaaaccggtgaccaaaataaatcaggtaataggaaattataaattggaatttgaaaagttaaaatgcaatccataaaattaattccagacttcttcaaggtggttctctttgacatcaagttcactatgatattagtaagtccaaggaagactgctagaaaaaaattatacagtggtaacatttttattctcttggcatagtggttttcaagccctaccaaagagttcattattttttctgttcctataacaaggaactaggttaaaaaaaaaaaagagtcctatgtccttcaaaaggtattgaatttcaaaatgagtaatttctttctagatctgtttttatttgaatattaacttcaactgcagtttctttctttctttgtaaacctcaacttcttactatttgaagatcttaaaatctcaaactatttttacaagaaaagaccacccttgttcaaagcttagtgcccagttacccaaagtgctaatgttatatgtggcatacctagataagaaataaaagctcgactagggcaggattccgtaaaaagtactccttttctgtgtctgtacaagatgctgaaatagctagttgggacacacaaaatcttaatgtccctctgtaacaaaacctggagacgttctttatataaatgacatttttaaaggattcagtggaaatgcttgatacagaccaagttatcagagctatgtagaattaccagatagtatgcctaagtgcacaagaattatgaaatatatatacagatgtctttgacttctgatgaggttacatcacaataaacctatcgggaaaatattgcaagccaaaaatgcagttaatacacctaacctaccaaacatcatagcttagcctaacctaacttaaatgtgcacagaacaattatgttagtctacagttcagcaaaatcatctaccacaaagcctagtttctaataaattgttgaatatctcatgtaatttattgaataccatactaaaagtgaaaagcagaatggttgtatgagtatgcaaagtatggtttctactgaatggatattgcttttatgccatcataaaatcaaaccatagtatgttaaggactctctggatagctaagtaaatgttatatgttctttactaatccttatcatattcttttctcatcctgttcctatctggtctgtaatgacctcagcctcttcatttgcaattgttcaagtacagaaattttatcaagtacatttctgagcatacttgattttcttcaataccaaatttctagatcagttgcccattacaatcaacagtaatttccctattaagatggagctcagctctcctctgtctctgccatggtttacgtattcaataatataataatatgtgggtgaaaaatagaagagatattcatctgttctgttttccactagtaaaaacaattggatctaaactatagaagattctctcatctgcataaatacatttgatctctataatattcccacaaatcaatagtgtagtagtttaaaaacagcctcaaatttttgctgcttctctcattgagaggtggattcaaatgtctcttcccttgaacctgggttggccttagtgacttgcctgacaaatacaatgtgacaactataagatgatatagggcttctaagttataggaaacctggcagctaccacctgggctgctattgctctgggggaaaacagctctcatgtaaaaatccatctaccttagacatccatgctatgaggaagcccaagctagtcacattgagaggctgaatgaaaaaagatacccagccaccctctactgttccaatcttcccagctcaggatcagacatgtgaggtaagcagctaccttgggcattccaaaaggacataatgtggaaaggaacaggggaacccagccaacagtcagaatcaaggtttcagacatttggtttcaatcaaatctttccagatatctccagccattcaactcataccagctgagggcccggtcatcatggaacataaatgagtcatctctgttgggctttgcacaaaattctgacccataaaactataagcctaataaaaatggtggttatttagactaccaaattttggtaacggctagtaaacaccctccttgggcttgtttcatcatttcacagcatttattaagaagtttacattagcacacatgctgtttgccagtgctgtctagagaaagaaaatcttgattagtaggaaatttgttataatttaatagtactatattctcccaagaatagtggtctttcgatgatatagaaaaaaagcaaaatgtatatcttctgttttcacaggtatctgagatgttattattgggcagttcgaactttaattaccattggtggccttccagaaccacaaactttatttgaaattgtttttcaactcttgaattttttttctggagtttttgtgttctccagtttaattggtcaggtaagctgagtatgaatcactggatacacagtgctgtcattttgaaagactaacaggtctttgtaaactttatggaggaaaaattaaaatctgtctggttcttctttttttgaactaactttcttctattttaatgagttgaaggaggatgtgattagatcaacagtgcttttccatttttaagccattaaatctatcaaaagacctgtcagcaaatagcatagtttgaactctcagagaaagttgtttctaagttaactttttacttggaccctaatgaaaaccattaaaatctcttttatttacttaaatttcaaatattgttataaaatcactgggttataattgacttcagaggtcatttaaaccagaggctacaaaatgccatataaaataattaataagttattgtttcacaaatgtttactatagcatctccttgtatttattctcaaaaaagtcagtctagtaagaaattaaatacataaattattatattgaagatagttggcacttacaaaggatagagccctttttttttttttttttttttgagacagggtcttgctctgtcacccaagctggggagcagtggcacaaacatggctcactgcagcctcagcctcctgggctcaagggatctacccaccccagccccccaagtagctgcaactacagttgcaccccaccacaccaagctaattttttttgtaggacaggtggatagtggcctgaatgtaggagcccatgtaagaacctgatacagaaggcagttgggctatgggttccagattagttagtttacgcatggaagacacactctcaggagatttggccaccatctctaaccgtgggagaaacaagcaaggcctcagtcagcaaagtccctgatattaacatatcaaaacatagaaaataaaacaggttaatacagatacacggggatatggcagttccagccttaacatgttaatgaaatacagagaggggtagtaaagtaaactctatgtagaaaatatttaggtttaggaagatgaacactaagagctaaaaattgttaagtataaaatatcattatcttcatggctggggagattatattaacaatgaaataggaagctggtttgagagatactaaattcaaatccatttgaatataaatagcaaaaatcacattattttataatttctagtaaaatcaacgtgaagttgtcatatcacagtcaattttttctctgttttacgaatgagaaaactccagtttaaagagattaagaggcatccctgattcatacatgtagttcatagggtcgtatggaagaaccatatataataacactgataataacagtaaaatttaacatgtattgagcacttactatgtgcaagacgattttcacatcaagactaaaatactatttctagcaccagttcaattatcttgttactcatagtgtaatctttggacaagcagcagcagcagcacttgagaaattcagagttcaagccccacctcagactagtgaatcagaacttgtattttaacaaaatcgtcaagtgattcatacacacacgaatgtttgaaaagtgctgttttatacaccacaccacatctgcttttaaattggatttgaggttccaataggaacaagaaggaatatcaagtcactgaaaatgtggtagtagaccacaagagaaagattgaggctagagatacagatatgtgcctcaaactctcatagtgaataaaagatgctgagcaggggaacagatagaaataaaagtttaaaagcctgggacagaaaaaaaccctccactcactcaaaattcccacatagagactatacgatggaactaatcatcactctttttttattaagagacagggtctggctctgtgcccaggctagggtgtagtggcttaatcatagctcactgtagcctcaaactcctgggttcaagcaatcctctcacctcagcttcccaggtagctgggactacaggtgcgtgccatcatgcctggctaattcttttcttcatttattttttgtagaaacagagtctcactatgttgcccaggctggtcttgacctcttggcctcaagtgattctcccacctcatctcccaaaatgctgagattacagacatggagccactgcacccagccaatcatcacattttaactacaatattctattttgtgatgcaactcacagaaactgacatttttcttcctctcatactctcatgtacttccctagcctgcaatccattatagaatatacatcttcctcaactcctgcaacaacaaaacccaacattgctgaaggatatcacacaaaccattcaaattactgtcactacaaattattggagcctcaacagcaatcaataatgcttttaatagtccttgcttcccaacttaatactctattaaatctcccaagccctctcctaacataccaagtctcccagccttaggtgactaggtaatgtaagttatcagccaagaacagcatggaaaagtgagatctaggaattgaggttgttgaggaatatttggaagagccactgaggagtaagagactcaaaaagatatatacagttggactagctgcatagctcctctgcagatagttttaatatgtagaagaattttttggctctaaaaatggaaactgaggagggcatcacaattaaaaagagccatttgagctagactccaaagaatgagtcgtttttccataagcagaaaaggctcaaaagctactaaaatgaatgagcaaagtcttaggagtgtgaaagtgaggccctggttttcctccctattataaacccacagtcaaagcatatttacagccacttgcctccctctatgtgagaggaagagtcgagctatatatcttttttgtgctgagaccttaaagatcagcttttaacctagagtgggtttttatgggtgagttataaacatccaagaactaaaacctgacagtttcttaagaattgtcacagcagtagatgatgcttcagtaatttcagcacatttcaacttctgctgaatactgtgccttaagcatgatgagatttgattttatctgtctaaacaacacaaagggaagtacagaggttgcaatttcatgatgaattgagtctatatagccagccacactggataatctatgaaggatgcattcaaagtaagactcaccaaaatggactagccattctgccagacaattgctcaacttttattgcacactccttgcataagcacagctgtataattttttcaatgtatactaacatttctgcagtaaaatacaagtttccaaagaagactatgtgtagtcctatgcattacatggctgaattctcacttggtttgtcctacaggtcttattgttgtccttattggatcagagagagaatataatttgcccaatattttatggaagtgggtgatattaggacccaatatcagtatgtttaaaatcaatccactgctgaaaagttgtctgggcaagaataaataaaataaaaatgaatgaatgaataaaatcaagtaatcagggcattagaaggaagtatatcatgtggaaaacatgtaatttgacttttattaactcatttcctctgctgggcgtggagtgaccatatttgtggttttagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctaggtaagcatggcagattaccgattaaattcctgtaaaccttgtcatatgatgaaaattctgtaaggtagcagagactagttggatttgaacaaaaggttgaaaaacaactaaatgatccttaaagcattcgtttaatgctacaggttttttttttttcctgaaatataaatatcttactggttttgaaaaccttggaagagaaaaggctaaattttaatcagcatcttctggatgctcggtattacacacattgtctcatatagtcacacatacaaaaaaggaagtgggaaaattaggcattgtctatccctttgaagggtagaaaatggaggctcctaactgagaaatttgggcgaagacacagagccagcacacagtctaaatagaactcagacccgcatctcttctcttccaaactcttgctcttacttcaatatcactctcttacccagaacacagtacagttgacccttgaacaagtgggggttaacaatgccaaccctcactccacagtcagaaatccacatataacttttgaggctgggcatggtggcttactcctgtaatctcagcattttgggaggctgaggcaggcagatcacttgaggtcaggagttcaagaccagcctggccaacatggcaaaactccatctctactagaaatacaaaaattagcagaatgtggtgatgcaccactacactccagcctaggcaacagagccagattctgtctcaaaataacagaaagaaatccacatataacttttgactcccccagaactgaactactaataggctactgttgactggaagccttactattaacacaaattttgtatgttatctgtattatataccatattcttaaaataaactagagaaaagaaaatgttattaagaaaattataaggaaaagaactatacttactagtaattaagtgagactagatcatcataaaggtcttcatcctcctcatcttcactgtcgagtaggctgaggagaaggagaaaaaggagttggttttgctctcaggtgtagcagaggcggaagaaaattcttgtataagtggacctgtgtagttcaaacacgtgttgttcaagggtcaactgtactaatagaaagcagcaacctttcaggccactcccatcctgcctcagggcacacaattgcttccatgaggtgctaaataattaatggtgtctacaactataccactatactactgcagttaaaaataattgttactgagggatataaaataagtcgaagataatgcactgctagttgacaataatgaaactcaacttttagtttgttcttaccatatgaaataggaattagtgccactaagaagccaaaaatgctccagagtgcaaattacaatgaaattctcaaatcacaaaggttcctaagagcagacagaaaccactggttattatggtagggtcttttcttcacctttctgacacttttaagcctcttaaaactccagcctcgtgtttagaatctcttcctgaatgaccaaaacaacatgcctctctctagaacatctgcagctacttgaaggcatctgaagtgggcaggcagagcaacaaaaggagtggtgccaggcttcttgcctcgcaccccttagcgaaggcagataatgattcaactccttggcttaggaggtaactagagacagccctcggaaacaataaactgtgtttatatatgaaggattttcatatttagaatctatatttgaatcaaaatagggatgtaatacagcaatttctctcttttctaaataatataagaaaacattaaaaaaaatcaactctcagaaactcttggaattctaaccattaagaatagggaattttctggaggggaacaaacgtgacccttggcctactggagggtggagggtgggtagagggacaggatcaggaaaaacgatgaataggtactaaacttaatacctgggtgatgaaataatctctataacaaatccccatgacatgagtttaccgtataacaaacttgcacatgtaccccagaacttaaaatacaaggttttaaaaaaagaaaaaaaaaagaataggcaattttgtttacggaacattttatcagcctgaagcccatcatttaattcacatgtagaaaaatctgtaatgtattcacattcttcatcgagttaataagcaagtaaataacaataatttgaatttactctcttagcacattttttctttagattccatcccagctgagccacctactaattatgcacaatggagcaagtcacttacagcttctcagggcttcagtcctttttgtttttcttctttctgcaaagtaggaatgagaacatttacccttggggttgtcacaagggtcaaataagataatgggtgtgacagagctctgtaagctctccagtgccacatggtgctcattattatttgccatcccttgaatgctaaggctggaatcaatagaatcagaaaataagaactagatccttcagccatgctagcttgttcactagcctttgtgctatgatcattacgtttcatagctaaagtttcagcaagcataatgttctggaattattcagtatgtcatccagggttaaaaatacttcttttattgcataagcataatagtgttattgtaataggtatggaggtccaatagaagtaatgaaaatatagaatctgatgcatctaattatgtataaaaagtgtttgcattttgtttcctttattttaaaaatttttctacttgtaccttggtgacttatttcattaattattctgcatcggggtttgatgtgtttatctttataaagatgagtctgatttgcttaagaccctaccaactacggtccagttagccctcgccattgatgtgaacttcagcatcatcagcaaagtcgacttgttcaaggcaagtgcttttacaattaatagactctgtatctatttctctatggaatctaagctcttgatttatacagcatttatgagtttttttgccttatgttttaacaaagtcaaaataacctagagaaattatgtggaattaaagagtcaaataaattacaggtctctcttcagccaacggcttattctttagaaccctctttctcttctaattggtgtcaaaaaagaagagttcttcagactcttcttgcattaatttaaatataatttaaattacatggctctatgtctttgctagtacatgtatcacctcccatctataaatgtgccttggcaattcacaacaaatcaggctccagaatagctctgtaatggcctgacaatcagagaattatacctaatcatgtcttctattacaaatactttggatttagactcttaaaatggccaaattttaatttagaagctttttgtttcaggaaaaaaaaattataacaaagaaatttttaactttttgagtgttttaagtattactactctttttgtgcattatatcacatataaatttttctcacctaatatttccttctgggtatagcattcaccgactcatccattcaattaattcattcaacaagtatttatgaagttcccaccatgtttcaggcaccactttagccactgggaatataatagctgaaaacaaatacttactcaagtggagcttaaattccagaagaagggaatgaaaaataaacgcataaaatgtgtggaggtgataacgccatgaacaaagttaagcaggttgtataggttgttctcacattgctattaaaaaaaaatacctgagactgggtaatttctaaagaaaatatgtttatttggtcatggttctgcaggctgtacaggaagcacagcagcatctgcttctggggaggcttcagggagcttttgatcatggcaaagggcaaagcaggggcaggcatcttatatagcaggagcaggaccaaggcaggtgtggtcagtgtcacacacttttaagcagccagatattatgagaactcactcactgtcatgaggacagtaccaaaggggatggtgctgaaccattcataggaaatccgcccctgtgatttaatcacctcccaccaggctccacgtccaacattggggattgcaattcgacaaaagatttggtggagacacagatcccagccatgtcacaggttaagaaggatgagggtggtactggcaagaaaggcctctctgattaaatgcatttgagcacttaagcagaggactgcaagaagcaagggagtgagctacgcagatgggagaggagagagaggaatgaggacaggagggaatattacgggaggatggatgacacgatgccctgagctggaaacacactgcaaggaagccagagtggctggagcaaaggcagagtggtggaagcaagagtagtcagagaagagtgaaaaaaaagggaggctgaggcagtcggcagttaatggaggggcttggaggatctgtagactttatttacttatttatttatttatttagagacagagtcttgctctgttgtccaggctggagtacagtgacacaatcccagcccactgcaacctctgcctcccgggttcaagtgattctcctgcctcagcctcccaagtagctgggattacaggcatgcaccaccacacccagctaatttttgtatttttagtagagacggggtttcgccatgttggccaggctggtcttgaactcctgacttcaagtgatctgcccccctcagcctcccaaagtgctggaattacaggcatgagccactgcgcccagtcatctatagactgtaaattatactctgagttgcaaagacactgaggctcttgagcagaaaatgacctattcaagaccagtttgaacaggatctttcctgctgtgtgaagaaaaggccttaggaagtaaatgtagaaggcagggaggccaaatggaagttatcacaaccatctgtggaagagatgatggtgaacagacccagggttattgaagcagagtttttgagaagtggcgaaatattgggtatattcaaacccaaaaagcccatagtttttcctgtttgattacatgaagagggtaagagacagaaagggaccaaaaatgactccaaggatttaggcctgaggaacaagaagaacaaagatatcatttgcaaaataggaaactttaaagtaagtgtaggttgggtgggctggaaaccaactctttgtttttggatgttgctatgatttggataatggtgtcttcttcaaaaatcatgtggaaactcaatccctaatgcaacagcatgaagacatgtggccttttgggaagtgattgagtcttgagggttccaccctcatgaatgggtttagcaccattataaaaggtctcaaggggaaggaagaactctcttgccctcctagtcttccactatgtaaggacacagtgttcctcccatctggaggatgcagcaacaaggcgccatcttggaagaaagagcagccctcaccagacaccaaacctgctaatgccttgatcttggacttctcggtcttcagaactgtgagaaataaatttctattatttataaattacccagtctgtggtgtccttttaatatcagcacaaaaacagatgtgtttgtttgatgaggtgactgttagattccagttgaaaatttcatgtaggcagtttggtttataaatctgagttcgggggagacgtccaagctggagcaatccatttggacctgtcagcatattggtgtatttcaagccaaaggactcaatgtgatcacttaagatgtaagtatggaaagaagaaaaaatgtaatccagacagaaggatatgtcttaaaattatataatcaataatattagaaacaagatgaagaagcagaagctgtatagtagaatggttaggcatagtcactcccagcattaggttaacccatgactctaagttattagagttaggtcagtattctaggactcttttcttagctatggcctgtgctagatttccatcaatattttgatgatcatataaaagatgtggttttcaaattggcagatgacacaaagaaagaaggaatataataaaatgtattacaaaatttaaaattactgaatactttgaaacaacaagcaaagccaacaagattaacgtcaacaagcataaaagtaaaattccaaacctaggtccaaaaggaaaatattgcaggccaggttccatggcttatgccagtaatcccaggactttgggaggtggaggcaggatgatagcttgaggccaggagttcaagatcagcctgggcaacataaattattctgtaatggtggaagtcagattaatgattgcttctggtggtgaatggggatgaggagattgattaggaagaagcataagggaactttgtagggtgatggaaatgttttttgtcttgccggggaaggtacataagtgtatacatttatcaaaattgatccaactgtcccttaagatctgtatatttcattttacgtaaattattactccattttcaaaaaaaaaaaaaaaaagaagaatggccccaaaagaaaatgtgtagatgctgaggatgtttagttgtgagaaaaataaataaattcaagggcagcagaagtttcatatactaaagtctgttatatgaacaaggaatgagacttactctacattgttctgcaaaataacactcaactgtaaactccatttctaagttgcagacacctctactacatattgatgtatttgtatatacacaccaatataccacggaatacccatcagccataaaaaggaacaaaataatggcatttgcagcaacttggagttggagaccattattcctttttttgttgttttttgtttcttaaacaatgtctcgctctgtcacccaggctgtagtgcagtggcacaatctcggctcactgcaacctgtgcctcccgggttcaagcgattctcctgcctcagcctcctgagtagtgccaccatgcccagctaatttttgtatttttagcagagacagggtttcaccatgttggccaggatggtcttaatctcttgacctcctgatctgcccatctcagcctcccaaagtgctgggattacaggcgtgagccaccacgcctggctggagacaattattctaagtgaagtaactcaggaatagaaaatcaaatattgtatatactcatttataagtgggagctaagctatgaggatgcaggggcataagaataatataatggactttggagactcagggagaagggtgggaaggggggtgaaggataaaagcctacacaatgggtatagtgtatacacagtgggtacactgcttcggtgacaggtgcaccaaaatctcagaaatcaccactaaagaacgtatctgtgtaaccaaaaaccacttgttccccaaaaactattgaaattaaataaaaattaaaaagtaaataaaaaattttaaaaacaaaatagcagactgcctcatacataagagtaggtattataaaatttttgtatgttttatttttaaaatcacatatacatatttatgtgtgtactaagcacaatgaaaatgtatgtcttattataggtatggtcagaaatgtatgaaagtcactaagctaaattatcttaacagtgttttaaaatattataaaactcgttatacctgaatgacgaacttaattgagaataagtgacagtaagtaactcttttctaaaggaaaacaaatgctttaaattagataccaatgacttttatgggatcatctcctatttgagaagatatcagttttttgcctcatagtttttttgctttctatatgtactttttggtactccaccaaatcagcaacatctgattgagaaaaaaggttaaatcttcacatcttgctaatgttgtgtataacttagattcattctttcctgacatttctgttaaagatacagttctttccagaaagaatccatttacatttatatttctgttacatgaaaaaaacttttttttttgtaaagccaagtgaaatagaaaatatgtaggtatggaatctttctaaatttattttcatagaggtagtcttagcaatttacacaaatttattttcttaggaaggaaataggatgaatagtgatcctccaccctacatctcataatttatacctgactgatccttgcactgcttctgaaccagtctcctcccttcactgaaagccacctatgcacccagggagctgagtgcacaaaggagggaatggtccaggtgtgggacctagaaggatgcgtaggagcccatggagtgaggaactagaggcacctgggtgaaagctcataagcatgtaaaagtattaacctgtttactgaaacaggtgattcagttaaaatgaggctaggaggatgggtcctaattcaatttgactggtgtctttataagaaggggatatttggacacacagagacaccacaggtgcaagtgcacagaggaaaagccatgtaacgacacagtgagaaggtagccatctgcaagccaagcagagaggccacagaagaaaccagacctgctgatgccttgatcttaagcctttagcctccagaactgtgagaaaataatttctgttgtttaaagcacacacagcctgtataactttgttatggcagccctaacaaactaatacacttccaatgaaagctttgttactatcccattttacggagagcaaacaacttacctgactgaggtcattgagctctaagcattgggacagtttgagcacggctttcttcacaccactctatcattcttaccttcagttctctaccaaccctatccggatcactgataaggtgggaaggaactggaaaagtttcactagagtccaaagtcaagctggcccagtgcggtagctcatggctgttatcccagcactttgggaggttgaggcaagaggattgcctgagcccaggagctcaaaaccagcctggcaacatagtgagacctcatctttacaaataatagaaaatttagccaggtgcctgtagtccctactactcaggaggccaaggcaagagtatcacctgagcccaggaggttgaggctgcagtgagccatgattgtgcctctgtattccagcctgggcaacagagcaagaccctgtcgcaaaaaaaaaaaaaaaaaaaaaaaggtcaagaccaaggcaatcctttggcgatattcacagactaagacttggcacattagatagatacctacagtcacatacacttttctactttcctgctaagaaaaggctctgaatctcatgtaggttttttctcctcttaatcaaagcaggtggaattagagtcacagattttcactaaaactttgcttcaataaattgtggttaattagtaagatttgctgcttcaacatgggtgatcagagatttgaaatagctcagagatgaatagtcaaattatatatatatattaatttttcacaaaaatgattcctcttccttgcagatttcacgttattccaggcccaagcacaagtattaagctaataagcagcgattcatttctatgagatgggcaatttcccctcatttctgatgatttattatttcgatctcgatttttaaatatatgttatcatattaaatgctggggaaatcacattttgcctctactactgcattaccagaaacgggagaaactttaataaaagttctgttgcgccacctagtggcgtgcattagaatcgcatcctttagaaacagcccccagttcagtaggaaaccagagacccagagataccaaaattgaaatgtaggtactacagtccgacaaggaaggcacaatatgtctatttgctgctctggtaattatgcagaacccatcccaacaggacacctcactgggatctttgactcattgtttgcgattctgtggcaaagagagcctgcaaaggctgtgacttctgtggacggaaggatgagaaggaagtgttttgtgtgtgagtgacagactgagccaagaagagaaccggaatggcagcatgctttctagcactcacatgcagatccccagcagtgacatcctacttatctgatatgtcatcacatatttactccacagggcctgaaatcagaacgtgagagtgagactacagtgagacttgtgtttcatttctaccaactttatttttaccctaatggtattagaaatgaagtattgttgctagacttttaaaaaatattttgaatagtgagtttataatctaaatgaactccattcaactatacatcctcagcagttgacctgtctaaagcactgagccagacatggagggctactgcccagctactgcagccatgttgtttctgccctctggagccctccgataggaggggagatactaaataaatgagataacatacttggttgtaagggactcaaaacatatgaagcacttatatcagtacctggcatatagtaaattacatagttattattaaatggagaaataaaactgatgcaaccatgtgggagtttctacacaggtaaaatcagattcttcctgtggccctgcctgatcatagaaaaattgattagatcaggggtccccaccccagggccacagatcagtgccagtcggtggcctgttgggaaccgggcagcaaagaaggagttgagtggtgggtcagtgagagcagcttcatctgtatttacaaccactgctcattgctggcattaccacccaagctccgcctcctgtcagatcagcagtggcattagattctcataggagcagaaccctattgtgaactatgcatgcggggatctaggttgcacttgccttatgagaatctaatgcctggtaattcctcactgtctcccatcacccccagatgggactgtctagttgcaggtaaacaagctcagggctccactgattctacattatggtgagatgtataatcgttttgttatatattacaatgtaataataaatagaaagaaaatgcacaataaatgtaatgtgcttgagtcatcccgaaaccatccccataactgcccatcagtgaaaaaattgtcttccacaaaactggtccctggtgccaaaaagactggggactgctggattagtttcatcctcagagttccgtctaactcatgacttcccactttgacccaaactcctagaaaattagaactattgccaattttcagagaaagtttgacgaagatgatttttactagtgttgcaaatattgactgtaagtttaggtctaatattacttagaagtaatattaaaaattatgacaccacagcactttgcaaattttttatcacatttgactttgctggtcccaacagctaccaatcagtatcatgcctcgcatagtcaatggcatgaagaactgaattcagaattccctgccctagtcatatcacctataacttacttgtttaatgagaatggggtttaaggtagaacaaagcacgtctttttgtaataagcaggctgagatggaaaaagccctgaagaccattgcttatacttgggagtgacttaaattcacagtgagttataaaatactgatgctatcttaagttctgtttcaaagaaagcagaaatgagcctagaaatggagaaattctataggactaagagggtacgcattccaaggaaacattttaccaactttacaattgtattcggagcttgccattattaaaagtggaatttcctgggtacaagaaccaccatctaacctatggctctgttgtgaatcaaaataacatttctcccaactccattcaaatctccaatatcctcattcaaatcggtaacacagctatacagcactgaatttctcattgtccaaaatggaataatttctaacagcttcattctatatgtcagcccatttttatttaccatccaacatgccctaaaccctgatgagacactaaggatacaagagtgaataatacaaacactttgatctcaagttgctccaagtgtagataaaaacacacactctggtgatactcttcctccaatacctaccgcatgtgtgaccttagagaaagtcgacaggcttcctgggactccagttcttatctaaaagccaggagtgatgaccatatattcattaatgccaggcatcagtgggaggctggaagaattaaacaggtaaggataagacagtaaaacatagtataaatattatgtactaatataatgttaatgttgatactttctcagttactctcactttatagaaaaaagagacatttacaaagcaatcctgtcttttcatacatcagaaaatttcctaactgtaaacaaaatggagctgggttgccgagagaaaaagccccaggatgtaattctttttaatcacacaataatgaagcaatgtatatctcaagaaaataatcattttctggagaaaaaaaaagaataataatagttctcaaacacattttaaaatataatgacatcataatgcaaactttatttcactaggcctaaatccaaataagaaagatttagtcctaaaccaaagctgccccaaagctagtggcatcttttcataaagtaatcattaggggacaggatcacttaattggtgaaacttaaattctaagtttttactatatacagctgctaaattcagtttgcatgacttgatccatgtgctatccaagtatgttaataaaaagtcatatttagattggttcaaatgtttttctctgagaaaatccaagccgtcagctgaaagctatcgatgtaagtgcttgtgtgtattcctgccaagaaaagtgctaattgtttgcttatctatgttcaggcttgtctcctaggttggtctcacgtttcccattgatccgacttccttcactgctgctatctgtccctgagcccacctaaaggataaaaggggaaagaaggctaaacacatttctccacaaagggagacacttattttcttaaaatttaaaattaataaaaatgaaagttgaagtttcatcagttctccccaaacccattctccttcctccctccctaaggtggccactaagatgaccctcatctgaggatatcccgccactcctcatcttcaccattttactttatggtcatataaacataaactggtagtagtgtgtttagatttttgtaggtggaatcatactgaatatattctatattcagaccacactattggttgagtttaatcatatatttaaatataaatagtttattttaatctttattttcattttttagtcaattaatttatttttttaagacagggtctcactctgtcacccaggctagagagtaatggtgcaatcttggctcactgcaacctccgcctcccaggttctagcgatcttgtcacttcagcctcccaagtagctgggattacagtcacgtgtcaccatgcccagctaatttttgtatttttagtagagatggggttttgccatgttggccaagctggtctcaaactcctgagctcaagcaatccacccacctcagcctccaaaatctgggattacaggtgtgagccaccacacccggccgatctgtagtttattttaactactttgtaatattccaatctacaaatattcaatattttatctgcccatagattgacagtacgttgtttccaattttttcagtattgaaaaaaatatagtctaccccatggtatccacaggggattggttccaggacccctgaggaaaccaaaatctgtggcatagtatttgcatatcacctacccacatcctcctgtatactttaactcactatagattacttatagtaccaaatgcaatgtaaatagtagttataccgtatttttcgtttgtattttgttattgtggtattgctattttttttctgaatattctccatccacagttgtttgaacccgtggaggtggaatccatggatacggaggccaactgtgctgccacatttttaggatttcctctcatttggtcttgggttctgtcttgggagagtggctgtactccagccttgccctcacggggttccagaggatgagtggtggctgttcacagtgtgcctttcatgggatacttcttgatcccggttggcaacctcatgcctaggtggtcgaccatgaacagacatttctttcacagggaatttgtttatattggccgatgccgttgtggctttcgtctgacccgtgtccagtttattcctataagatagccactccctaggaaaaccctctactggaaaaaaaagttaggtttggatatgtcagtcaggcgagacacagaagcagcagcacaacaaaacccatgaagtaatagaagcattttcattacctacagatcccagacagaaaagggcagcacgcctcacagggccaatgggaaggggtaacactcgtgctcaaccagtggggagagagagagaatgggccaaagcctttttgggatccagggtgttacccagggaggtttcccaggggaagttctaacaggttggtttacagcaagcagacatgagttccatggggccttgctgtgactgacaggtagttactgtggaatatctgctcgtctacgtgggctctgggggtcagtggggcaattctagtcaattgcatccagctgtaccatagagcggtggtcaccaggaggcagtggtataaagcaggtatctggatcaaccacactgaggaactgggaagaggtagagaactggaaaccttgtcaagtgtgactgatcccacttccagtatgagaaagttaaacttatattcaaaattggtgccaaggcaacataaaattataagaatttactatacacacacatatttgtgtgtgtgtatatatacatatattctgattactgtggcagtatttctattttatatgtatataattatatataaattgtatataatttttataatatatattttatattatatattatatgtacatattatatatacatatataatttttatattatatatgtacttatatgaaatcagaattactgccacaggaaaacaatatttaaaatcactaatatttcccatgaatataacttaatatagttgggaattttcatcaaaatacattctgataggagttgttcaaggaataaaaatttcatttttgatttacaaattataattaaaaccttaaaaattagtgccaaaaattaaaattatttatatgaaaacgaatataagtgggtcttttgagatcttctatttctgatcatttacaatgtaaatcttctccatggacatgagtgactgagagttaccttcattgcagaaatattccagacatgtacatgttcaagaacttccaagcatatttcaagtggattttctttaccatatcaaagacacaaattttctttagtggagaagatccaaaaatcaatccaaagtctatttgcctttttctaagtgagttttaaatgaatcagaataccaatttctgaagtgaaattattccaaaatgatgacagcatttaaagaaattaagcacttgggacatttatttaatttttagtaaaaaagaaccatgccttttagaaaaaaaattatgtttgtaatttgctttagcaaatatggtaacctatcagacatagtaggactaaaacaaatataaataaaacgtgtatactttgcacaaagcaaatacatagcagccaaagaaaaggtaaatttccctctgcataaaaggggctttgtgcatctttgcaaatacaaatcatcctcatcctcaaatgattcaaattttgttacccaaatgagcactttcctggtgcttcccatctctcccatcccactcccaagcaaaattaactctctttatcttataagttttatggatatttgtggaatgttttatgacatgattatcttctaccatcaattacagcttttctgcttacttacaagatcaccccaactagacttactttctttcatctttaattcctccaaggttatcatacaaagccttgctcaaaacagcttctcatcagtatttgttagactgtattaagaagatatgtcttctggccttggcctttttttctatcctagagaagcaaaagctatactttctgaagtgatttttaaaaattctaacagcacattcatctgaatgcttctcaccaatggctacttggagatacttcaatcataaattattagcttgccttatcagtcaagcaaccctgaagtctaaatttcatatggatctaggtcaagtgtctgctactgaagctgttacagaaaactggtgattgctaaaggaatgattgtctgatccacaaattggaagcagaccctttgcttctcctttctctgccactgactctacaattagttcacagcaaaatcataattccctcaaggggtggacaggaccacccacaagaggaaagctgttacatgttagcagctctgagagaaaatgaaaaaatatatatttgttgaaagcaaaagattcaaaactactatgtaagtgagttttttgtagcacctaaagattttttttagctcatatagatatagttatttaaacagatgacaaatacagacctatagccaaacagtgtttcttacactattaaagtgaatatgaacaatcattcactcaacagatattgcttttgtatctattgtgtactttttttttccctgccttaagaagataattgagttggagaagaaagatagaccagcctgcaaggttaaataataatatctaacaatggtgtgaaacatgttttaagaaagaaaaatatctagcaaagattttgatctatgttggtcctaatatactaacaatctattattagtatattatcattaatagctatcattaagtaccacattaagtttttgttataagtaccatttttatccccattttacaggttaggaaactgaggatgagaggttacgtagcaatatgtagtagagacaggattcacacccaagtctatctgagcaagatctaaattcttgccattatactataggtattttttttctaaattttgagtcatgacatgtccatagccattggcagttaatatttttatgctaatgcagacaatatatattactgtttattttcattgagttttgaattcatttggaatattggcctttagttgtttctataagaattatttttctttttatatagggttgtgatacacagatgatttatgacatgttgctaagattgaaatccgttctctatttgcctggtgactttgtctgcaaaaaggtgagtgcatgctatttttcaaatgcacaactaataaatgcatttgaggatttcggacataagtcaagaacattgtttaaacaaaatttgttcagggtgaattccatagtatagaaataattatgatatatagctctgtacagcaataacgtgctctcagagttcacaaaggaacaagacaatatggatttcattacttatattataggatagaagtgtgggtagtctgaaaaactgctctgtttaaatgttaattatcaatcgtcacagcttattaatttcaaatatttaaagtggaggaaaaagttacagaagcgataggtggttcagccttttttatgtcttcggcaaaatatcagttaccttcattttgctctcccaagtagtgaataatcaatgccacattttaaaaaactgtactgtgctttttatgattacaaaataatgcatgttcattattttaaaatagaaaacacataaaaacataaggacataaataccaccatccaataataaccactcttcatatattttggcctatctttttatactgactgatggatagataaagcttgtgctataaaagtggcatcatactgtacatatgttctgaaacatgttttgtcatgtaacaatatatcatatgaacactatgtattaagtaatctacaatatgattttttaaagctgcatgatgtttcagtctatggatgtatcaggatcaattttcaaatgtttgctattataaataaaaagaacatcccctcagataaatatttttgcatatttctgatcactaacttaagggagaggaaaggaatgatgaccctgggatttatatcatgacagactcaaccaaagataaactcaataatcaaaatttaaaaagaaaaatgagtagttcaaaaaatgcaagatgatccaacaccttggtgagttcacaagcgaacaaagatgagaggcacttttatcatttcaaaataatgtgttaaatgctatggtcaaagcaagcacacgctgttgtaagacacaaaggaggggcacctgtccttcctggttacggtaagatttcctagagaagatgatgtctgagctaagtcttgaaaaatgaattggagtacaccaagtaaaagaggaaataggtgttctgggtagaggaaagaatgtgagctaaggcaaaaaggaaggaactgtgtctatagagggagtgcagagaactataataaggtaaatgttagaacaattttagaatgatttattccacaaaactcagtaaatatttctcaatatgatgagccagaaacagtggagggcactgagcaaaaaaaagatggttcttgtcctttaggggcctacctttctagtgctgtggtattcaattcacagtgcacatcagaatcacctgaatgaagacgtctgggctccacccctcagtgattgatttggtctagatggaggccatataccagtattatttaaaactcctatatcattctaaaatgcagccaaaactgagaaccactggcttcatgcgagagacaagctataaacaagtgaaattaagtcaatacataattccaaaatgtgctaagttgtataaagggaaaatagaagttgccagaagagtatgtagtggcaaagacacttaatttagatccagggttgggagatggggaggttattaggttgtcaggagtgacctttgaaaaatctaaagataaatagttctttagtttaaaaaaaaaatgtggacaggatggcattttttatgaagacttggagccatgagctgagaggcaagatggagcttggcatatccaaggaacggaagcaagtgagtgatggagactgtggtgaacgacaaagtcaaatggagtatgaggtacttcaaggcatcaggtggagatgccaagtacacagtgaaaatcagtctaatgagagaggatggaactggggtttactgggaactgtaatataaaggaagcagacttcaagaaaagctcaaggaaaggtcagagaagagggccttgcctctaactttgaagagctctagtgtttgaagagatcaatgaagaaaagtcagagagagcaactgagaatgagctttcagagatgaagggggaaaatggaagagagattatgataaaatgggaagcaagaatatacaatcccacacaaattagtccaagttaaaagaaggcagattggtgatatgaaatcaattttattgaaatgggaaatacaagccatagtgcagtccaagaaccccttgggggcagtggtgtactgaaatgacatgactttaatgcaccacaacatgtcctttcatttggggccagtagcaacagagattgaaaactgtgataactcacataaactctagcacctgtgcccctaagcagtgcaaatttgtttaacaaagtatgaaatgcagagtagatgcagccttttcatttctaatttcttcttcacatcacattcatcactcaataacaaaaacatcagtggagacaaataaggcaggaaaaggaattaagtaggtgggagagtgcagggaccagccccacagggtcggtgggcttctccctgtgtgcggcgatgagagagtgtagaaataaagacacaagactaggagatagaagaaaagacagctgggcccgggggaccactaccaccaatgcgcggagaccggtagtggccccgaatgtctggctgtgctgttatttattggatacaaagcaaaaggggcagggtaaagagtgtgagtcatctccaatgataggtaaggtcacgtgggtcacatgtccactggacaggggtcccttccctgcctagctgccgaggcagagagggagaggagacagagagaaagacagcttatgctattatttctgcatatcagagacttttaatactgtcactaatttactactgctatttagaaggcagagctaggtgtacaggatggaacatgaaggcagactaggagcctgaccactgaagcacagcatcacagggagacggttaggcctccggataactgcgggtgagcctgactgatgtcaggtcctccacaagaggtggaggagcagagtcttctctaaactcccccagggaaaaggagactccctttcccagtctgctaagtagcgggtgttgttccttgacactttttgctactgctagaccacggtccacctggcaacgggcgtcttcccagacgctggcgtcaccgttagaccaaggagcccttctggtggccctgtctgggcataacagaaggctcgcactcttgtcttctggtcacttctcactgtgtcccctcagctcctatgtctgcatggcctggttttccctaggttatgattatagagcgaggattattataatattggaataaagagtaattgctacaaactcatgactaatgatattcatatataatcatatctaagatctatatctggtataactattcttattttatattttattatactggaacagcttgtgtcctcggtctcttgcctcggcacctgggtggcttgccgcccacaggagagtagaaacaaggagacgctagaatgacaagtcacatttctttaagagtggatttacatgatagtagatattgacagagaagaaaggctgttacttgacaggacttgagacagctgaagtcagctttgttttgcttatcgttttcacaaaatattgaaggcaaggggaaggaaaaaaatacgttcaatttgaggttatctatataatttaagagatgacagcatttggggccaagtttgctgacctacttaatccccaggatggttcagaaattgactgagtggtagcttgggctggttgaaagagtgggagttttcttcagatgctctatggcagggcagaaatcacctagagctcttgttaaagcaccaatttctgggacctcattcccaaaaattctgattcatatttctgcagtaagaactctcagtaaactgagaatttgcacctctaaacaagctcctagtgatgctgatgctgctgacccaggaaccacactttgagtagcactgctcttttctgttggggtgcccttgagtgtcataaagccctcatgagccttagaaatagcttcctacacagaaaccctgaaattttgaagggcgctatctccaggggttacctcactctacatgaagctcttgttttttcatactttctccaaattagtccacacgctaacaaccagagcttggttcaatcttattttgcacatgctgtcagcccttattctctgaggaatgtctacttaatttgaatgctaattaaacttgcagaaaaggcttaaattagcctagaaatatgcaagaaatagtggaagttttggttcgttgattatgccagatctccttggaaaattattgaaatgatcattaaaaaataattaaaagagctgaactgtatttaagtacccactatgtacttctacctccagtcagttgtaataactgcctttgaaaaatcattccagttccttgagaattacttcacgcaaagaataaggaatatgaccctgtcctcatcattacttcctaaagtatctcttggaaaactaattttcagatatcttgccttattttttaattcattcatggctatttcattggtttttaagagatcagttctgatattggagtcaccgttagatgtggtctgtcttcatgtattatatagagtcagatgacataggtgctgctagttctggcgctgtcacctgcgagccttataagtttgctcaagacacttaattttttaaacctcgactgccaattgttaaataagagtaatgatacgtttcctacttgacttcactcggatttttgcaagaattagatgaattaatatctatgagatgctttacagctataaagtagcatgttctgctagaacaaatataggaattaaaataaggagctatgtaaatgtcagataatgtaatgattttttaaagtaatatgcaaagacatgatattgttattagcattaatagtatgtaaataaatataagatccatctatattggaatttctacttttatctgtttttgagtataaatatatgcttaatattttgcacaggccaggtgcagtggctcacgactgtaattccaacactttgggaggccaaggtggcaggatcacataagtccaggagttcaagacaagcctggacaacatggcaaaaccctgtctctacaataaatacaaaaattagccaggcatggtggcttatgcctgtggtcccagctactcaggaggctgaggtgggaggatcacttgaacccaggaagcagaggttgcagtgagctgagatcatgcccactgcactctagcctggggaacagagcaagaccctgtctcaaaaaaaaaaaaaaaaaaaaccaaccccaaaattttaatttaaaaatgtattttacacaatgcaaaacttaaacgtatttcttgcattgctcagttaggagatgtgggttctaggcttccttcgcttctaattaccgagtcatataactttagctaattggctaagccaatctgtgcctttgttttaatttttgtaaaaaggaaataatagtacttactctaccttccttataagagtaatggggagataaaataagaatttcagcttcctggatgttaactaaaaggtggagtctgataactttaaacacaacccagcaattataaagcaacaatagttgatgttcaggaaaataaacctaggtgtaaggaaagactttagaatctcccagagaatagttaagttatattttcctcattcataaatgagtgtttcctatatgtcaagcctgcgttcagcactgcaacaaagtagacattctctcagccatctcagagagtaaactacaatcaatatttttttcttccaaagaatgatgtaggctaaatatttttaaaaataaaaaataaatcttttaatctcgagttgattttagtgtattctaattctttcaaagtatggttaatgagaatatttgattaactcaaataacccagtcccctcctaagccaagtaagtgaatttattgtattaatgctatttttttttatagctcaaggtgatcaaggcactgctcattcagacatgtaggtactactagccaaatagtttgcctagtgttatgcaatctggcctatttagagtttaacagcctttcttgacctaagtgccatttaggtctcttgtaagacatctattctttttggaagttagagaagatgtgttccaagggcctcataaccacccactagtttggtgatttacttgtaagaactcatataattcaacataaagttatatttatggcttaagatttattatagcaaaggataaaatgcaagaatagcaagaaaaagatatacatgggcaaacacgagagaaatcagacacaggcttactaggtcctatttctatgagggtcacatggatgcatttttctctccagtggaccacagaaacatgagcaaaatatctccaccggtggaagctcatattagtcttgggtccaatgttcttaaatggcgcatatagctgcatgaccagacgtgattcagactttcaaactatgtacaaggtacacatcataaatctttgtgattatattaaatagtgttgacagcctgatacatcctgctatactggctcaggaatatagaataacaccattaaccagtggctatgtgaacattccaggagtttaattcttagggcttgaacaaagatcattgccctggtcccaagagtccccaaagataggcaagaactgagtaaaacaacctgctgcattaatactttatctcagtatggaatactaataataactcaaagatctcctatgccccaattccccaaatcagacctcaatgccatgggtagatgaatagaattgacctttgaaaggctacagtctatgctctttggctagaccaagcaacttcttccaagcatagtggtggtcatcaaagccaggttcgaccatgcttaaaatcaattacttcctctacccagggtccttcctaaagcaatgtgctaactgaaatatcttcatgtatccaagggaggcaaacagtactcacgtgttgagaagtatcatcttcctaatcattttctttcacatgatatgttcaacccatgtctgtaaatactttaggtcttaagataattaattttacactaatgttctttgcttccttcatttatatttactcctctaaaagaatttatatttcttaatttacagcataattatcaagaataaagtaactaccatttcctctttatatttaaaatgtagggagaaattggcaaggaaatgtatatcatcaagcatggagaagtccaagttcttggaggccctgatggtactaaagttctggttactctgaaagctgggtcggtgtttggagaaatcaggtatctgaaagatacttcataaatattgaagtccatcatttgtcataaaagaaaagtcttaggtagtaaaataagttcccgctcagatttatcaaaggtttgattgtgctgagagcattcgtaaaataaggattttcatatttttattcatcccttcaccaaagcgacctaaggaaaagaactgggtcattcagctctttagtccaggacctagagcagtgcctggcgtaaagcaggttcccagtatatgttgaatggatgtgcaaatgaattagtaaatgagagaagaggtttggagggttcattgttaccagattgttggaaaacttgaaagccttgctaacaagggggtcttgcgtaggctagtgatgtgatcatagctgtgggaccaaatttcctgagtttaaactccagtttcaccactactggcttttttcctctgttacttgtccccactgttcctcagtttcctcaccttaataattaggataataatagaacatatcttaaagtgttggtaaatgagttaattcactaaaagcacttagaacactgcctggcatctattaacaactcaataaatatcaattatttttaccattgcttcttattggccaggaaaagtttatcctagaacaagaaactccccaagaggaaaaatatagacagcaaatttaagcattttgtgagctaaacacttctatatgcattatcacatttattcattattcaaccaaaaaatatttatggagtgcctggtacgtgctagattgtcaggtattgctcttaactctaggaataaactatataaaaatattagacaagatatggcccctaacagagtttatagtccagtcagggaaaactgataataaatagttaattagctagacaagatgaattcacactgtaataactactatgaaggaaaaagtggttagaaagtaacaggacacaacttagatgcagtggtcaggaatgacctctctagggagataatatttgacctgagatttgaaagagaaaaggatcagccattcagaattgggtgaagagcctgattaccaaagggctagaggtaaagcaagtttgtctggtcaaggggtagaaaggtcaatatggctggagtacagtgaataagaacactggggagatgaagccaaataggtgagcaagacccagataacatggtcttttacgccatgataggaatttatgtctttttctaaatatgaatgaatgccagtagagggttttaggcaaaagaatgacacactctgaattattattttaaaagacgacttcaacagctatgtggaaaagatacagtagaggagcaagaatgaatagagtccagttagaagtcaactgtggtggctcaagtgaaagatgatggtgtctggaactgagatactggctcatatgatgaatagaagagtaccctgtcaggcagttattaatatattcatttcataactgagaaaattgctatcccaagatgccaagtactatatctttcccaggacaccattgctaatgaattatagggacaacattcaaacctgggtctccacggatcggggtccagtgatctttataccacgtcacagaagaaatttccagtctctaatttcatagctgctaagaagttatctttgtgttctggaaatatggataattttagatgacttcatattagcattgttagggtttctttggaatgttgaaacatgttatttctctgttgttaatgtggcttctctttttaatttttttctccttgtttaacgactgattatttgttaaggtgatcctctgaggatcttgctcttgggcagtggtggaaacacttctcagaacatacgagacctgagttctttgcctgttttctatcatttccttcctgggagtccttgcaaaagtgatttaatattttgtgacttaataatcactgtaatcttcaaggtcataaaacatgcaacagtttaatctgaaacactgcagaaattaattagctgacctttcccaagggttgagtactccctgaagaataagctttataaatacaagtatgttaattgctgatattatcatcacaggaggaaataccctaagaattgaatccaggtgtttctgagttgcaactgaaagtaatcctagattcctgacagcagcttctcaaataaatctcctattacccatttggtttctaaggccaaattgaaaccagtagaacagacaaactttaaacttgctcagtagtttggttgattcaagtaaaagggagctttttgccttgattctctttttggctgtggttatggggaaacaggatgcatctgcctctttccagatacccacaggcttcacaggcccacagctgtcatatgccgctgaagctctagtcatttattccagagctggaggtatgcctgccaaacatccagatactggaaagatctagtaatagtgtttactactcaaaaatgctgtgacctttgttaaaatgagctaaatccagcactatcatgtagcctttaaaagagttctttttcctcaggaaaaaaaaaaataaagaaaaacattaagggctttcaaggacattatatattaatccaaaagagcaaaaccctgactaaaatatagattaatagcctgtcattgagaaaacccagaccacatttccaattatcatctgaagagtgcagataccccatttctaaaagagagacccagggtctgctgagagatggccttgtggtggttccaggtccatcattttccttacacgtacatttagtcccaagtcttattcactgaatgtatttaaccacttcctgtctgcattctgtttctgttaaaatgtcatttttcttaaaacacatctgagtttttattcttgtgttgccattatgatttcaataggattttctattggtttcatctctcttcggaatatcctcccctggaaatttttcattcctccttcaaatgccacctttttgaagccatctttaacccctaaaacaactagttactctttattctatgcttccatagcatttcattcatgcatttattgcagtaattactactgatttataattaatttgttcagacaggtctctccaacagactgagctactaaaatgtaagaactagaggctgggcgtggtggctcacgcctgtaatcccaacacgttgggaggctgaggcgggtagatcacaaggcctggagatcaagaccgtcccagctaacactgtgaaaccccatctctactaaaaaaaaaaaaaaaaaaaaaaaaaaaaaaaaaaattagccgagcgtggtggtgggcacctgtagtcccagctactcgggaggctgaggcaggagaatagcatgaacccaggaggcagagcttgcagtgagccgagatcgcgccactgcgctccagcctgggtgacagggcgagactctgtcacaaaaaaaaaaaaagaaaaaaaaaaggaactagaatttatccatcttcatatcaccagcagctacgtaaacactatatactaagtggtgatttttacttgtatcatgcctccattcaaaaataatttgcaacagctcttcagcaatttttaattaattaagtacttaattgtgatttgatagaaacaaaagaaaattatatttgggtccccttatggcatagtgtgaaagtgactcaaagaaggccatgtattccttctttgccaggcacagtgccagtcatgagggtacaaaggagaacaagaaacaatcactgtcctccagggccttagaagagacttcaataccaggtgattaaatgtatgaattgtgtcccaggaagagagtgtgtacaggatgctttggggacaaagttttcacaaggaccagtgcatcctttggatctggcaattactagaggttatttgggaaccaaaagctgaacgtttatcgggcaaaatccacccccgatatttcatgtaggttcttttctattttccctaagtgtcggctggtctgagaaataaaggaacagagtacaagagagagaaattttaaagctgggtgtccaggggagacatcacatgtcaccaggttccgtgatgtcccacaagccacaaaaccagcaagtttttattagtcattttcaaaaggggagggagtgtatgaacagggtgtgggtcacagagatcacatgcttcacaaggtaatagaatatcacaagccaaatggaggcagggcaagatcacaggaccacaggactggggtgaaattaaaattgctaatgaagtttcaggcacgcatggtcattgataacatcttatcaggagacagggtttgagagcagacaaccggtctgaccaaaatttattaggtgggaattttctcgtcctaataagcctgggagtgctataggagactggggcttatttcaaccctacagctgcgaccgtaaaagacagccgcccccaaggtggccattttaaaggcctaccctcagggacacattctctttctcagggatgttccttgctgagaaaaagaactcatcaatatttctcccatttgcttttgaaagaagagaaatatggctctgttccacccggcccactggcagtcagagtttaaggttatctctcttgttccctgaacattgctgttatcctgttcttttttcaaggtgtccagatttcatattgttcaaacacacatgctctacaacaatttgtgcagttaacgcaatcatcccagggtcccgaggcaacatacatcctcctcagtttacgaagatgatgagattaagagattaaagtaaagacaagcataggaaatcacaagggtattgattggggaagtgataagtgtccatgaaatcttcacaatttattttcagagactgcagtagagacaggcataagaaattataaaagtattaatttggggaactaataaatgtccatgaaatcttcacaatccacgttcttctgccatggcttcagccggtccctccgtttggcgtccctgacttcctgcaacaaaccttcactggtcctcaaatgatgtgtgcacacaggtcagtcctataaacccctactgaggggtatgtaaaggataattgacgtgatgcctgtagtgggttgaatggtgtctcccacaaagataagtccacatcctaatcctaggaacttgtgtatgtgacctaacttgaaaaaaagggtcagggtctttgcagatgtaattaagttaaggatctcaagatgagatcatcctgaattatcttgaagggccccaagtccaatgacaaagagggttctttttcctaaggacactttttataagtgtctttataaaagacataagaggagaagaccatgtgaagactgagggtagaaactgaagtattgcagccatagccaagaaatgcctggcagcactagaagctggaagaggcaagaaaagatttttcactggagtctttagaggaaacacagccctgctgatattttgattttggacttctggcctccagaactgtgagataataaatttttgtggttgtaggtcagttgttttgtgataatttgttatagcagccctaggaaactaatacaataccaaattatttaaattgttcactttcaaaattttactggggataaacaaaacatgcttgacactctacttcaccctacatggacactccgccttcaacacctgtcaatcctaccaccaaagaaagtctcaaatcatttgtatcttatgttctccactgccactacttcagttcatccatctctcactggacaactgcagtggcttacttcaagtcactcaaatccaataaccatatcctccacaatcagtctccactctgcagccagagggatcttttggaaacacagatctgatcatatcactgccctcccacttaaaaccatttaatgttttcatgccatttttagggataagaacaaagtgattttccttacctatgagatcctgtagagtctagcccctgcctacctctctacttcaggttgcacctgactcgccttgctctctttattttattttattttaattttattttattttattttattttatttatttgagatgaagtctcactctgtcgcccaggctggagttcagtggcaccatctcggctgactgcaacctccacttcccatgttcaagtgattctccaacctcagtctcccaagtaactgggattacaggtttcgccatcgtgcgcagctaatttttgtatttttgtagagacggggtttcaccatgttggccaggctagtcttgaactcctgacctcaggtgatccacctgcctcggcctcccagagtgctggattacaggtacaagccactgcgcctaaccatccttgctctctttaatccagacacccattgtcttcccattccttgaatgcaccacactctatccagtcacagggagttttttgcacattctattacctccgcctggatgctttccccacccttttaccaagatctcagcttctttcaggccttcctggattccccactatagggacctccgaggtctccctgctgtacactttcatccaatgatgttcctttcttttggagcacttatctttgtaactatacatgcattagtgcatttatttcttcaatgtttttcttccttcctaaattgcaagcaccagaactaccacctatggctgtgccaaatgttctctgcaccagaatgtccaaagaggaaccgggagggcaggaacccagttctcactccacttctgagccatgagccctggctgttgtgctccctctcatgcacagttacctttcactctgtgaaaggaggcattcttctagccaagcacaggactgcacatgcttagaaaagccacattgttttttattatactttacgttctggggtacatgtgcacaacatgcaggtttgttacataggtatacatgtgccatgttggtttgctgcacccatcaactcatttacattaggtatttctcctaatgctatccctcccccagacccccacccccgacaggccccagtgtatgatgttcccctccctgtctccatgtgttctcgttgttcaactcccacttatgagtgagaacatgtggtgtttggttttctttccttgtgatagtttgctgagaatgatggtttccagcttcatccatgtctctgcaaaggacatgaactcatccttttttatggctgcatagtattccatggtgcatatgtgccacattttctttttccagtctattattgatggacatttggtttgattccaagtctttgctattgtgaacagagcagcgataaatatacgtgtgcatgaaaagccccatttttatagtttgcatgaagacactttacacaggcaccaaggggtcctgctagacaccatgtgtggtttgttctatactctatccccagcccttagggcagtggctggtccacataagtgcctaataaatagttattgaataaataagtgaatgtaattatctttctatctttgtgaatgtacaaatgcacattcatttttgtcgtgaatatgcatattcagccttgtgccctttttgtcagttttcattataagaataacactgctatatttatctttgtaaaattactttgttttattttatttatttgaggtttaattcccaaaaatcggaataagtaggccaaaaggtagaagcatttctataactcttgtaatatatgggcagattattttccagaaaaaaattgaaccaatttgcattacaaatcacaatgtatagctatttttcttcagtattactgatattactttattatccccattgccattgcattttaataggttattttaatttgcagttctctaaatagtgcctggaaataatagttcctccataaatatttgctaaatgaattgatttcctatgggcccatttattttcataaacgtgatcatttaccttctgcatttctttcattgttcaccatccttttttcatcacagataacaagttattgagtagaattcaggcattgatatattcttgtatgttttagatatctggttgccattcaaaacatttaaatgctgtcttttcccctattacattagtcaaatcacctatttgagaatttctttctgatatttactttatatcaatgtgaaatggcgaaatattttgacaaatcatcttaaaactccttttaacctttaaatcattattgtctatttcttctgaatactcagtttttaaaattggaataccagaggagacttctaggtctttggactattttaattccatattcttactcttcatcagaataactcagttattccttttttcccctttcctaaaaagtagaaatagtagatacaataggagattaaaagtatgagcagagataagacttgattaatactgaaagagaaaacttcattttcatttttttcatatctcaaacctgtaagcactacctgtgttaagagtacatatttacattttcactacatccttttgaatatagtctctttgattgtatagcacctttttgcttagcatgaaaagtatacctcatctaagtcccacaatatcccactgaacaaatatacaatcagtgtcattgcttaaatattcattcaaatatcctcaggattcctcctaaagtaactttatccagtgctaaatcaaggctttttgccaccatttggaagagcagagaggaagtaaagattctgagagtcataccttgacatgtcttatcacaccagcctgtttgggttcctcccttatttttcctaatatccaggggcaaatctgtatcattaaaacaacagcagtaacttcattggcatcactagagttatggttaaagaaaagacctcttgacttgaagtcaggtattgtcttagattttaatttcagagatgaaattcttaaatatttgttcttgaacaattcacttaactgattctggacctcagttccttgtctgtaagtataggttaagaacctacctcaccagctgggtgcggtggctcacgcctgtaatcccagcactttgggaggctcaggtggcgggatcatgaggtcaagaaaccgagaccatcctggccaacatggtgaaaccctgtctctacttaaaaatatatgtatatatatacaaaaattagctgggcgtggtggcacgtgccggtaatcccagctactcgggaggctgaggcaggagaatcgcttaaaccagggagtcggaggttgcagtgagccgagattgtgccaccgcactccagcctggtgacagagcgagactccttctcaaaacaaacaaacaaacaaacaaacaaacaaacaaacaaaaaagctgtctaaagccaggggcaagcgggaggctgggcctgcagacatccctcagcaggtgtcccagtcagggacacactcgctgccctgcgctttgcatccctctcagggtgaaggtgacagtggacccagacccttccctggtctaccgacctgaagtggaccaagaggctgccaaagacaaggctggcttccagagctacgtgtcgggtcccctcctggaccacgtctttaccaccgacaagctcatgaacatgcaccacacagtggatttcgtcaggagcaagcacgcctggtttggggacttttcctacaagaaaatgaaggtcatggaggccgtggacctgctgcatgggctggtggacgaatcagactcaggtgtagacttctcccactccttccaagccttccagatggcggagggcatccgaaagctcacccaggcaaggactggttccagcttgttgggcttctatgacctagggaaggtcttggccctgttgggggagccccagtgggtgatcgttggagacacattccccgttggatgctgtccccagacctccgtggttttgtaactccacttttcaggacaatcccgacctccaggatcctggatacagcacaaaactgggcatgtattagcttactgtgggcttggcagggtcctcatgtcctagggccataaggagtacttgtaccaggtgatgatgttcaacaagttctcgctcccactggaggcttcctacaggatccgattccactccttctgcccctggcacacaggcggtgactaccagcagtggtgcagcaagcaggacctggctatgctgcccggggtccaggagttcaatttgaccaacttccctgacctgccagatgtggacaagctgcggccctactaccaggggctcattgataagtactgccctggcatcctgagctggtgacgcttcttccacccccaccactgctggacgacaggcctggccctcagcgtgcctagtgaggtctggctgtgggcagacagacaccattagggtccacctcagtggggaaccccactcgccccttatagccaccacctctcatggccatttgtacctagtggcaataaagacctcgaaggagagagaaaacaaaacaaaacaaaacacctagctcaccaaagtgatatggtcattacataggaaaataaagggatttacttttaaaaaaaactttaaaactataaactttgtacaaatatttcacatagttacctggttttcactccaaagaaacatttacttaggctagtgtattagtataggcttctttgatacagtattttccagccaaagtaccatagttaagtattcttctgggaaactcgaaggaagataaataaacagagcatggaataaagagtccacattatcctttttctcctctttccttccttagaagttatacccagattcttcatcgctcattcacttctctaaggccaattcagttctgaaatcaagacctgctaaggggaaaagggactaagcattttatatctgtaatatctaaactctctaattttgttaaaaatctgtatgtgcagacattcctcaaaatgttttacagaaaaaaaatctaggctaacatgtgtttgccattcagtacttttatgaatatcaaagtatctgcaaagatcaaaaatcccaggcagaggtggccttagaacatcctctgatatttgcctagccataaaagttttgctagaatttatttttagtcaagttttaaagttgcaaggaataaagtgtttcctaataatgttgacaaagatgaaaggatatctcagaaaaagtctacacaggttatctaacctcatgtttccgaaataaaacccagttagaaatttccttaatgagaacaaatatttggagttttaatcccttactcagcattgaatatgatgttctttccattgatagcatgtagagttatatatatatatggaaataattctacatgagaaaatgtatttagaccagaaccttctttattttaggaaatattttcatttcttacaattattaaagcattaatcattctaaattgcatctgcttaagaaggctgcctgattggtttgcatccatgtgccacaacttatgagctatgtatctccaggcaagttactcaactgagacttcatttcttcatcagtcaaaatggagaaacactaatacatgaccacctcacaagattgaaaattattatgtgtattaaaacataaaaaagaacttgggaaaatatctcgctcatagtaagcactcaataatattatctattggggaggagccaagatggccgaataggaacagttccagtctacagctcccagcctgagcgacgcagaagacgggtgatttctgcatttccatctgaggtaccgggttcatctcactagggagtgccagacagtgggcacaggtcagtgggtgcgcgcaccgtgcgtgagccaaagcagggcgaggcattgcctcactcgggaagcgcaaggggttagggagttccctttcctaatcaaagaaaggggtgacggacggcacctggaaaatcgggtcactcccacccgaatactgcgcttttccgacgggcttaaaaaacagcacaccacgagattatatcctgcacctggctcagagggtcctacgcccacggagtctcgctgattgctagcacagcagtctgagatcaaactgcaaggtggcagcgaggctgggggaggggcgcccgccattgcccaggcttgcttaggtaaacaaagcagcccagaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatttgagaacaggcagactgcctcctcaagtgggtccctcacccctgacccctgagcagcctaactgggaggcaccctccagcaggggcacactgacacctcacacggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagtgcctctcctcctccaaaggaatgcagctcatcaccagcaatggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagaaaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaaggaaagtttagagaaaaaagaataaaaagaaacaagcaaagccttgaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacattcagattcaggaaatacagagaacaccacaaagatactcctcgagaagagcaactccaagacacataattgtcagattcaccaaaggtgaaatgaaggagaaaatgttaagggcagccagagagaaaggtcgggttaccctcaaagggaagcccatcagactaacagcggatctctcagcagaaaccctacaagccagaagagagtgggggccaatattcaacattcttaaagaaaagaattttcaaccaagaatttcatatccagccaaactaagcttcacaagtgaaggagaaataaaatactttacagacaagcaaatgctgagagattttgtcaccaccaggcctgccctaaaagagctcctgaaggaagcgctaaacatggaaaggaagaactggtaccagccgctgcaaaatcatgccataatgtaaagaccatcgagactaggaagaaactgcatcaactaatgagcaaaataaccagctaacatcataatgacaggatcaaattcacacataacactattaactttaaatgtaaatggactaaatcctccaattaaaagacacagactggcaaattggataaagagtcaagacccatcagtgtgctgtattcaggaaacccatctcacatgcagagacacacataggctcaaaataaagggatggaggaagatctaccaagcaaatggaaaacaaaaaaaggcaggggttgcaatcctagtctctgataaaacagacttgaaaccaaaaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacagggatacccaggaattgaactcagctctgcaccaagcagacccaatagacatctacagaactctccaccccaaatcaacagaatatacatttttttcagcaccacaccacacctattccaaaattgaccacatacttggaagtaaagctctcctcagcaaatgtaaaagaacagacattataacaaactatctctcagaccacagttcaatgaaactagaactcaggactaagaatctcactcaaaaccgctcaactacatggaaactgaacaacctgctcctgaatgactactgggtacataacgaaatgaaggcagaaataaagatgttctttgaaaccaacgagaacaaagacgcaacataccagaatctctgggactcattcaaagcagtgtgtagagggaaatttatagcactaaatgcccgcaagagaaagcaggaaagatccaaaattgacaccctaacatcacaattaaaagaactagagaagcaagagcaaacacattcaaaagctagcagaaggcgagaaataactaaaatcagagcagaactgaaggaaatagagacacaaaaaacccttcaaaaaattaatgaatccaggatctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattccttgacacacacactctcccaagactaaaccaggaagaagttgaatctctgaatagaccaataacaggatctgaaattgtggcaatattcaatagcttaacaaccaaaaagagtccaggaccagatggattcacagccgaattctaccagaggtacaaggaggaactggtaccattccttctgaaactattccaatcaatagaaaaagagggaatcctctctaactcattttatgaggccagcatcattctgataccaaagccgggcagagacacaaacaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccgcatgattatctcaatagatgcagaaaaggcctttgacaaaattcaacaaccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcagtatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgcaatccccatcaagctaccaatgcgtttcatcacagaattggaaaatactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacatgagaaaaacaagcaatggggaaaggattccctatttaataaatggtgctgggaaaactggctagccatatgtagaaagctgaaactggatcccttccttacaccttatataaaaatcaattcaatatggattaaagacttaaacgttagacctaaaaccatcaaaaccctagaagaaaacctaggcattaccattcaggacataggcatgggcaaggacttcaggtctaaaacaccaaaagcaatggcaacaaaagacaaaattgacaaatgggatctaattaaactaaagagcttctgcacggcaaaagaaactaccatcagagtcaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcagaaaacaacaggtgctggagaggatgtggagaaataggaacacttttacactgttggtgggactgtaaactagttcaaccattgtggaagtcagtgtggcaattcctcagggatctagaactagaaataccatttgacccagccatccccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgaattcatgtcctttgtagggacatggatgaaattggaaataatcattctcagtaaactatcgcaagaacaaaaaaccaaacaccgcatattctcactcataggtgggaattgaacaatgagatcacatggacacaggaaggggaacatcacactctggggactgttgtgtggtggggggaggggggagggatagcattgggagatatacgtaatgctagatgtcgagttagtgggtgcagcacaccagcatggcacatgtatacatatgtaactaacctgcacaatgtgcacatgtactctaaaacttaaagtataattaaaaaaaaatttaaaaaaaaatattatctattaatgttactattacaatattcttagtagtaataatatttgctaattggctatctgcatacacacttaccccatgcctagattacaaacagcttgagggcaggtgttaatcatctttatagccccagaagttggcagagtatctagcccattgtagagtatgctatttctatgtactcctaatttatctttttccttttcttttccatttatacagtgaattctttatcttcccttgcatgattgaccttcaaagcacaatcatctgtacaatcttggatgcatccaaaaaagtacttatcaaagcctctctgagaaagacaaatgtttaaaacagattatttgtttctctgaatattctaaatgtataccattgatcatgtctgagcaacaaagagagagctgggtatctgaaatgcattgtactgacctatctccttccatccataaacttactcttactgaactttacttgaaagtgattcatagcctttactgggggctctattacaaatgctcctagcaagcttattgttgtgtctatcgcaagaatatgaagttttctaccactttgcagaatggcccctttactaagcccttcaggagatatttctgcctgtctttaagccaactctggatccatttttatggtacagaaggcttacacctaaatttgaagccccactgtgccaaagtgttcatttttttatgaattccattttatgtccccattcttgtttttgttttgctcctacattcaatttatgctcttttgtattctacttttccttgtgagttctttctggatacagtagctctactaaaaagagctgtgcaggttgtacactgcacaactccagagggctccaatcacattacagtttgtatgcaatgtgtaatctacatgtggcagccctggacaaagcttggaatggatgactgaccagggactatcttaatattctagctctgtctgaaaaaatatataaatatatatatatatacatacacacaaatgtatatgtatataaatgtctgttgcatatgctatttatgtatgtatgtgaaaatgtatgtgtgtatgtgtgtgtatacttgttcctcacatttactgagttttgcatatacaagttatcttacacagtccctgaatacaccatttctccataacattctcacacctgcttttgttcattcacccaactttggcacactagtactcaactttggcacactagtactatttcttcttaaagataatcagatacctatagtaggtactaaatatggccttgtttcctacaggagacattagtaatctgttcagaaacacagtagatggtaggattatctggttccaaagtatgtattcttttcacaaaaccataccatgctttaataattctcctttttacccacttcactgtactgaatacatggtaggcacttaataaatacttacatgattagagtggaaatcaaaaaagtctttatgttattgtctaaggtcatagcaaatagaggtggctctaggattagaaccatttctttgtttcctggtccattgctctgctcactctatttttacctagggaaacaatagcaacctcaactctttgtactccagcatgggctctttcagaaactctatgtggggctgggaatatttaggctatttaatgagtgaaactttccatgggtggaatgctggagaagcattttgtggacaagatgaaaaaaaaaaaagatgctattttaaacattgctgaaagagtttgggcaaaatccatctggcagacagactatttcttccatttaaaaactcatcaagcactccaaacgtgtaacctgtaggcaagtttaattaaaacttgagaaatctcaaaataacctgacatttaaatatgttatttccgttctattctcatagtctaacatacatatacagatattctcaggttcaaattaacctccccaatcccatccagccttgcataactacaggattaccctgtgtccatgacaacaggaatgtgaatgaaacagactcatccaatcattgtccttcaaatattaacgtcaatttcatagaaagggaagaaggtagatagaagaaagctgagtagatgaatgagtgaagatatggttgtgacaacagaggacagacagaatgatacgtagatacatagatagatggggtaaaatttatttcccttgtattctctgacaaaggtggagcttgtcttaagagtaccttaggaaaagactaaagttagtggttttccacaaaggaaaaaatttgaaatgtgaaatcattgagaacatatttaaagattccaaatatatactttctgccttagaggaggaattccttttttttttttttttttttttttgagacaaggtctcactctgtcacccagtctggagtgtattggtgtgaccatggctcttgctgcagcctcaacctcccagggtcaagtgatccttctacctcagcctcccaagtagctgggactacaggtgtgtgccacgatgcccagctaacttttgtattttttgtagagatgggattttgccatgttgcccagtctggtctcgaactcctgggctccagcaatctgcctgcctcaacctcccaaagtgctgagattacatgcgtgagtcaccttgccaggtctaagtcaattcttaagtggcctggagagtcctggaccctgtcattaatgctaggtgcaggtaagtggccaagtttgaagccatgagtggccttacaccagtttcctcccacttttttccttccttctctggctttgggcattttatatgattccattttctttttctcccttagcataataattatacttattttttaaagtttaatggttactctaaagttttcaatatgcattttgaactaatctgaacctaccatcatataacactatgccacttcacatgtggtgccttacaacagaatgtttccaattcttccctttcagcccttatgacattgctgtctttcatttcacttatccataggttataattaccaaacacattaccactttattaaacagttgtcttttataacaattaagaatgcgaaaaaattgtcgagcatggtggctcatgcctgtaatcccagcactttgggaggccaaggtgggcagatcacctgaggtcaagagttcgagaccagcctgtccaacatggtgaaacccctctctactaaaaatacaaaaattagccaggcatggtggtggacacctgtaatcccagctacaggaagcagaggttgcagtaagccaagattgtaccattgcactccagcctgggtgacaacagcaaaactctgtctcaaaaaaaaaacaaaaaggaatgacaaaatattttactttcatttatgcctttttaaatgtccttcctttctttgtgtagacctgagtttctgatctatatcattttccttctccctgaagaactctaaatgttttttgcagggcaaggccactggcaattgattccctctgtttttgtttttctgacaatgactttgtttcttctttacttttgaagggtcatttccctaaatatagaattctagttggtagttttttcttgcaacactttaaatactgtactccactgtctttcttgtgtggcttctaatttaaaaatctgctacaactcttatccttgtttctctctatcttaggtacttcccccctctggattctttcaaggttttgtctttggttttctgcagttggaatatgatatgcccagaagttgggggtttttcatttgttttgtttcttttggcatttatcttgcttaatgttctcctatcttcctggatctatggttttgtatctgacattaattttgaaaagttctaggccatttttttttttttttgagatagggtctccctctgttgcccaggctggagtgcagtggtgcaatcttggctcaccgcaacctccaccctctgagctcaagcgattctccctcctcagcctcacaagtagctggtaccacagggcatgccactatgcccggctaaatttttatatttttagtggagatggggtttgaccatgttgcccaggctggtcttgaactctgagctcaagtgatccacccatctcagcctcccaaagtgctgggattacatattaatcatagttttaaaatatttcctgtctaataactccaatatctgtgtcatatttcagtctatttctgctgcttatttctttggactgttttttcttcccttttagaattccttataatttttttgttttttgtggttcaaagctaaaaattatgtaacaaataatatggactgaggtaaacaggcctctagtgtgacattttatactaatttggctaggactcgggctgtgtttaacatttggtatagctgttggtgccagaggcttcaaattccttctagttccctgtctttgtctccactgttgactgggcttacagaggcttctcagagagggtttgcatcttgctgctgtttcagctgtaattcgttagtattatataggagacttggtgggggggtaaggtatggagaaggggaaacaatttataattctgtgataaagtttcagttttttgtatttcccaatgctgtgacattcacaggagtttcttagctttccatctcccttagataagacaggaagtcttaaaggggctgcattgggaaaaatgttcttccctcaggtagcacaaagctctggtaaagtatttttctctaaatagtaggcctgcggtatggagaacaaatatgctctgggtatatttcacaatgattaatcttcccctatgcctgccagagccgagaggggatcttccttggctcttcaccctaagaacctgatgaggttcctggtggtaaatcccacaaaagtgtgagtgactttataaccatggcccccaagagtttctcactctcatgctagtccacattcagcctccaacaatttattaaaatgagcatttaagcattcttaccagttatgactccaggggcttctgctgcagtaagcagatatggctgtagttttatggattcacctctctctccagatttgggggcggtagtttgccctgtgacttcagttctctgaaggatctaagaaaagtcgttaatttttcaattgtgcagctttttcttgttgtaaggacaggagtaatgatttccaggctcttaacctgtcagagctaaaaccctatataagttttttaacaattaacagccaactggaatgctcccttttctgcaacaacagaagttgttcatactgtataacataaatcttcaggcacagggcccatgcagcttcttatatctcattgcttccaaaggtcagagtgttttctctgtcttctccacctgtagaaactgcttttgttaatgtgatccttctttctcagtttctaacagattaactccaaggggttcaatctgttgtgttatcctctcaatgcagatcctatggtgtcttttttaaacatttgaaatgtggtttttcttgttctgtttttacaaaccaatccttccttctcagatcaccggtaacgacagactttttattcatttatcttattcctttctgtgtttattcccccactcttttttgcttatttctcaaatgcaaaatgctcttttatatccctccaagacataaagcccacaattccctggcattccaggtggggagatgtatgtgaatgactatattatagagcagcttatgacactgaggaacaagttgattttggagtatagtaggagatgagattggattcacctgaggtgaccagggcatcatgaagtgctggctttcacatttgatgttgagagttgtatcagccagagcccaggtgggaaacagacacactcaagtgaggcaattgagtaaactttaataaagagattactgacagaagtgaggaaaagtctaagagtacccaactgacatggtttggctttgtgtccccacccaaatcttttctcaaattgtaatccccatgttttgagggaaggacctgatgggaggtgactggatcatgagggcagttccccccgccacccccctccgtgctattctcgtgataatgagtgagttcccaggagagctgatggttttaaagtgtggcacttccttgctctctgtctttcctgctgccatataagatgtgccttgcttcccaattgccttccaccatgaccgtatgtttcctgagccctcgccagtgatgcagaattgagttaattaagcatcctttgtttagaaattacccagtctcaggtagtatctttatagcaaggtgaaaatggactactacaccaacaaaaggtggcaatgcatctcaaatttagcaacagcaaaggaactgttactacagtgaggcctgaatgggaaaagaagagggtatgtttaccagaactcatcaagagtgatgggaattgcacttctagaagacatccatgtgtcaggagctgtagattttggtagagaactgcagccactgctaacctaaggcttggcaggaaaataacaggggagataaatgctctgatcccactctcttcctgctttctgatttcctattagtcttttccaatggctgagcccaagtgaagtcagagggcaagcctacagaggtcagcttcctgggaaacaaaggagcatggggagaggtgaaaagtggatctgaaggagcaaatgagggatacccagtccaaaaggattctgcatttctggaatctgggatgaaggatctgacaggatactgacagccacaagtccttgatttgtgggacttagaggtgagagttagagaaaaaatatattgaaaactgagccatttctattcccacatcttgacactctctgcacaatcacctggaccctcacctctagggaatgatttctgaagcagtataaatacttataatagttgctatttttttaaagagatttcagtggaggaaaactgaaactggtggcaaagactcatttttctctcttacagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccaggtacaacctttaaaacaccattagagatggatggagttggttttactttgtaaactctgagatagggagaaccgtattatgattgtgataaacttgatcacagtgagatatgcttaatgaacaactattaatgtaggtacccattgaaactacacaggttaggataaattgcagtttttttagtagattttgccagaactctcacagagttacctaaaacagcttttctctcttacccacagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcaggtaataaggtggagtgaatggacggctgtcatggagaaggccccagactaagtatatacacacaaacgcccactctaattccatttcagacactgggatgatttggactaatctaatactaatacttcctgctttatatatagcacattattatttaaactgctgaattcccacatatcatcacatttaaccctcacaggatgtttatagatggctttaatatgcatgtatttataaacagagtataccctcattattcatagattatttgcagattctatattggtgaatctacttactataatttattagtaacttaaaatcaatactcatggtgcttttgtggtcatttgtggacaacagcacgtgcagggtggcaaaaaatttaagttgcttgatgcatacattttcagctgagtttgaaaaaagaggcactctcctttcttgtttcagctctgatactataaacgaatgacccttggccgggtgcggtggctcacacctgtaatcccagcactttgggagaccaaggcgggcggatcacgagggcaggagatcgagaccattctgactaacacggtgaaaccctgtctctactgaaaacacaaaaaattagccgggcatggtggcacacacctgtagtcccagctacttgggaggctgaggcaagagaattgcttgaatccgggaggcaaaggttgtagtgagccgagatcacaacactgcactccagcctgggcgacagagcaatactctgtctcaaaaaacaaacaaacaaacaaaaacaacaacaaaaaagagtgacacttttagtgccatgctttccacatttttgtgctttttgcatgtgtgtgattttgctgcttaaaatagcccccaagcatagtcctgaaatactgtctagtgctcctaagtgccaaaatgctgtgatgtgccttccagagaaaatatgtgtgttaggtaaacttcattcaggcattacagtgctgtttgcatgagttcaatataatgaatcaataatacctcaaattaatcaattgatcaaattaaatagtgtatctctaaacaaaaacacacatgaaacaaagttatacattgaccaattgacaaaaatattatggcttgaaccataatatctcataggaacctaatgctgtatttcctccaagaacaatggttcagtacttgctaacttgctgtttgtggaaaatttatagaacaaaactacatgaataaaaatcaactgtatatatacagacatacatatggatatataaataaataacccattttatcaacattttcacaaatattcaattactatagatcacaaatgtttaaagcccaaaataactttgtaaatttcatccaagcttttcatgttatagatgaagaaactgaaaaccagatcaagggatttggataagatcataattagttacagagcagaaagctattactcaggtgttcagacttacaggcctacactaagctgcctttcaattcctaaaaatgtaaagaaactcaaatgttattgtttctctctctctctctctttttttttggtttcatatttctttgattctcataattagcctatgagggcagatattgagaaacagacagagcagggattcaggttttctgaacctagtcattatgttatctctaaaactgtagaaatgggtagctgtggacctttcagaaaataagtaaagcacatattataaagtcagtcacatacaaaagatgaaaacttgcattttccttttccacacatacaacactgtggtgaaagttagggatccagtataaaccaaatgcttcatttgcatcagcatagaaataataatttgcataaaaaatgtatgggagtaaagaaatatataagtaaatgtgttaagaatctcaactttatctgtgcacattcatatgtcaggcaagcctttctcaaattgatcccaagcattaccagtaaagagcatagtgtaccttttgctatgaaatttctatagctagtgctaaacacgataggtacaaacatgacaggtcaagcacctgtgggacaaatggaaaagatcatactaggaaagggataagtttctccctgaggttctcccacaagcttaggcaagaggaaaaccctactttttacagtatttttatatagtattggttaatatgtttttattaaaaataaatatttaaaattttatctctacagaataagtaaatatttaaaaagcaaaaacagagtcctgagcactgagtctaataattcagagagtataaggaccaataggaagagaattccttggcagagacaaaaaaatgcaattcagactaacatcatgagtcaaaggcaacaagtccattctctagcacaccagaaacttcgtcaaatgatagtcagaagcaaagcagacatgattcctggattcacttaattcagacagtctgtcttggtggtgatcttagccattgcatgctaatcaaaatctaatccaatgtttttaattacgatttcaacaccagttctttgtaattgctccttccagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataaatgtttgattatctttagatgtgatatagctagttcccaaagtgattgtacctaggattgtaacttaaattaacgaggggaaacgacatgctgggacccttgagaaacgaaaggcaaatccctagcttagtttctaggacttatctgagagtgtgatttcatgcagtggtaataagaagattattaaaagccatccctattctccgttttcattaactttatgcaattgctatatcttctaattgtatgtagtaagtttccttttcctttggttctttcctgatgatgtctcttccttccagttttattagcttgctcttggctgtgatgtgattcactaaccttttctcttaatttttattgtgtttaatttcttctttggcactctaaagcctggctaattgttctaggtttatgaatttcacctcttacatgtaaagggtataagattttaatgtaataggtcaaaaatcagattattttcattcaaatgaggatgatgagtcactgtaatatcaaaaaatccccagcagctgggactgaagggaagcagagatcatgaagctttctgaatgagaagtctgatttttggaacagtcccctgaagaccaatgttggtcggcagaattagcaaactggcaaaatcacattgcaggaacatattggaaaaattgtaccctttactaaagaaataaacttcaatattttctcttctaaccaacttaaaagacaccaatctacctaactcatctggctcaagggacttggactggaggatacaggctaaagtgacacttatcagaatcttcctcaagcacttgctggaaaagatatcagattggaacttcttgtttaaaattaagctttagtaaaacaaagtgatgaggttaggaaggcagactctacacatgtcagattgacatatccccacaatttccggaacctacatgtatagctgtttacaaaatctccaagttaattaagggcactttaggaagttgtcctcatgaattagctagcattagcataattaccgacgttgcatgctgtgaggaggctacaaaggccaggctggtgtcggaagtaataatacatatagaattccattctaataaatgccattagtgtataacatcaagttctgtgtaatgaggctatttccaagtctccaaagatggtcactgtaacagcactttgctgagagggttttaacaaatcatattagccaaaaagcctacaacatagatgcatttagcaaaccatgtacaaatcaatcactataataaactgcatcatttgatagagtcaccgtttttgcatgtagtgttagagtatcacaaaatataacaagttttactaaaggatggttggttttttcaggatttaagggaatatggacaaattgttaaatagtatttatttgataaatgggagtttgtatgcagaaagagtgaattgcgtataaaaagggtgatttaaaaacccagaaacaaaaggtagaatagggctgaagcatctgataataggaaaagaaaaggacaaaagtcctcaacttgtgagcaatatgctttccctttacaccctgtaatttattcaaatgatattaaaatacaagaccattgcaatttatgcttttcgactggcagttattttcccccccaagctatcctgtttcagataatatcaatttatttccaatccatcagactaaaatctaagaaaattcaagaactcttttattgttgatttggtgccaccaaattctttttctttttaaatctttctaattatcctttctttttcaatcccattgctaacacccagaacatattttctgttcaatgcaaataaacattcactttttacctatagtctgctctcgtcactggtctgccctcttagtccctttgctattggaaaataaaatctttctaaaaccctacttttgaccatgttacttccctgctcagtggctgtattagagttttccagagggagaaaaaaaaaataggggatatatatctatctcaggccattggattcagactggaacttagac

SEQ ID NO: 12817 - DNA, 9128 bp, Human
agaccatgctgtaggtctctttctagcgatctaggagttaatgccacagtgtgttcaaagccctttgatgcgatcagataatcagtaatgtatggaatatttgtgttcataacttgtgagaacggctgcatggcaggacaagaccccagcacaacagtatggaaaatccaccctaagcagacatgtcatgactgatgttgaacaatggactcaccagccaggcacggtggctcatgcctgtaatcccagcactttgggaggcagaagcaggcagatcacgaggtcaggagatcaaaaccatcctggttaacatggtgcaaccccgtctctactgaaaatcaaaaaaaaaaaaaaaaaaaaaattggccgggcatggtggcgggtgcctgtagtcctagctactcgggaggctgaggcaggagaatggcgtgaacccaggaggcagagctttcagtgagccgagatcgtgccactgcactccagcctgggcgacagagcaagacttccgtctcgaaaacaaaacaacaacaaaaaaaacaatggattcaccatccgatgggctccctcactgccaggtcactcttcatggaagtatttgtattccagtcctttctgtggaaagaacttaacattctccttttcataacactgtatcttcagaaacaagagagtcgaagtctcctaattttcaggactgtctatgttgaacatcaaaatatattctttagagcagatctttaataatcatatgacaagagaaaaactttcataatcttatgacatgagggaaggaatattaaagccgttctgtgggttattatctctaacgttcccaatagaataggctttgccagctgggtgcggtggctcatgcctgtaatcccagcactttgcgaggccaaggcgggcaaatcacgaggtcaggagtctgagaccagcctgaccaacatggtgaaaccccgtctctactaaaaatacaaaaattagccgggcatggtggtgggcgcctgtaatcccagctactcaggaggctgaggcaggagaatcgcttgaacccgggaggcggagattacaatgagctgagatcacgccaccaactccagcttgggcgacagagcaagactctgtctaaaaaaaaaaaaaaaaaaaaaaaaaaaaaaaaaaaaaaaaaaataggctttgcccattatactctctcatattcattgacctgaatcctcaaatgaggtgtgtccattagtcaactccaatctcttgtcatatataagatggtagagatgagaagaaggtagctcctttacagcccactatttccactaactactacctgtgtttcaagatacagcctttcatccttctccagtgttgagagtgttgaacctcagagtttctcctctcattttctctaaatgagatacaatgccagccatcccaagctcttggcctgagttgatcatcttgaagtctaggactccaagaagcatgaaagagcttctttagtgaagctatgtcctcagtactgccaaaattcagacaatctccatggcctgacaatttaccttctatttgggtaatttattgtcccttacgcaaactctccaactgtcattgcacagacatatgatctgtatttagctctcactttaggtgtttccattgattctattctcactaatgtgcttcaggtatatccctgtctagaagtcagattggggttaaagagtctgtccgtgattgactaacagtcttaaatacttgatttgttgttgttgttgtcctgtttgtttaagaactttacttctttatccaatgaacggagtatcttgtgtcctggaccctttgcaagaacccttcccctagcaacagatgcgtcatctcaaaatatttttctgattggccaaagagtaattgatttgcattttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagaggatcaaaactgagttgtgtattgatgaatagcaaggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaagttattagccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattctctctcatctccagagcaacattggtgctgttgtaaagatgtactgtagaaaagtattcttcacccagcatgacccccacagaaggtgtcaggtagacttgaaataagcaaagtaataacccagctcccatacccatagtggcaattgtagatttctattgccccaaaagagccatacatagggatacttacctagaaagacagaggctcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcaggcggatcacgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgagcccgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaatctcccactcatcgatacactccacagaggcagcatactctccaagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagtgtttccttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcatccctactcgccatcattctttcattcctcttggcccaatctctctccaccacttcctgcctacatgtatgtaggttattcatttccctctcttgattccccccacccaactctctttctccatttcttgcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggcctaaccttgccattaacaagccccaaattctcatgccagaggtctgagaactttatgggtttgatcctatcttgttgtgctcaagtcttgtctctgtcatccatggtctcctacgaagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcacgtctgtcatgtgtcccccagtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctcctatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatttccccccagagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgagttaggtgtggtcagaggaagacatatatggagatatctgagggaggaaaacagggtggggaaaggaaatgtaatgcatttaagagacaaggtaggaacagatgtggctcttgatttctctttgctagaatgaatcagacattggtatcatctggtatcccaaagcttcagggtctgtcatccctttctatagacgggcaccttgatcacggctccagtcttagaaatcatctccagtacctaaaaccattgtttcacattagaatactgagtctagggatctagaaaatacattagaatatggagtctagggatctagaaaatactgagtctagggatctagaaaaataagcctcaagatttgggcacatcctagcttgtatttcctggggcaggtcatcagttcagaagcatttccagatcctggctcctttcaggttagggtcaattcattgcatgaaatgggaatctcttagaggccaatgcctgcttttgcttctttagtctcaaatgtagtatgagaaactctaaaaaaaggtaaagcatggttgcttattatgttcagttggagagtaggaactaactgtatacagttagttcatgttggaaaggttagatgaacattgaaagaattttgcaaagtcaaaggattaagagagaagaggaaggaatctgaagcaaggagctcaaaacggatcttaaattccttggtaactatgtgtgtcttgctataggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccggttcatttgggcttggtctcattttgtgcatctgcaggcaaccctcttgttgtggtctagtcctcatcaggaaaacctaaagtggggttggtttgttgggagatctctactgagcaatgatataactctgtcttcagtagagtgaatctgaaaccccaaggtatggatctcagaatgcatgggatggaggggagcagatggggttagagtggggagaaggaagacagaagaatccataaacattgcaggatttacatatcaacatcgttcattccagatttaatgagcaaagagattggacactgaagactggccttacccattctgttagacatagtctcagatgcctattttattaccgagagagtagtctgactgattcttgaaaccaccttatatttgaagatgtgtctttgagtggaaaagctgagtgaaatttggggttggggagaaagatatgacattaagatgagaggaaggaatatttgaaacacaatgaactgttgctcatttgtctataaaactatgacttgatatttatctctaaaatagtttctagaacctgccataaaccactaagataaactattcatgatagtgtggtagactgcaaataaatgctgttgaaatgagttaggcttgggtttcatcttggctgtatcatttactagctatgttttcactggtatcttacttaacttagcctcacattactcatgaaaatactggtgttaatttttactacattgaattaatatcagaattaaaaggaaaacgcaagcaaagtaattagatacatgcttagtgataataaaatattgcaaaaaattatacattctgttgtttttctcaaaatttctatagactgatgataaaaatctaagagaagctaaacaaaacaaggataaaccaaagcatcatgacattctaagccttactaataaataagaagtttctcggctgggcacggtggctcacgcctgtaatccagcactttgggaggccgaggtgggcggatcacaaggtcaggaaatcaagaccatcctggccaacatggtgaaaccccatctctactaaaaatacaaaaattagccaggcgtggtgataggcgcctgtaatcccagctactctggaggttgaggcaggagaatctcttgaatccgggaggcagaggttgcagtgagccgagatcgcaccactgcgctcctgcctggcaacagactgagactccgtctcaaaaaaaaaaaaaaaaaaaaagtttctctactgttggttcagagaatcaaagcagaatcttgagactactgatggtagaataggtatgaatgtctttcttacatgactacaaactttattataaaataaatagcttaacacagagaatacactaaaacttagacaagcatggattaagaaagcaaaaagtaaacccatatactaccatgtaagaaaaccatttttggccaggcgcggtggctcacgcctgtaatcccagcactttgggaggccgaggcgggcggatcacgaggtcaggagatcgagaccatcctggctaacatggtgaaaccccgtctctactaaaaaaaaaaaaaaaaaattagccgggtgtggtggcgggtgcctgtagtcccagctactcgagaagttgaggcaggaaaatggcgtgaacccaagaggcagagcttgcagtaagccgagatcgcaccactgcactccagcctgggcgacagagcgagactccatctcaaaaaaaagaaaaaaaaaaaaaaaaaaaaggaaaaccattttaatagacttttatttttagagctgttttaagctaacagaaaaattgcagaaattgtatacagagctccccc

SEQ ID NO: 12818 - DNA, 30678 bp, Human
  misc_feature (1)...(30678): n = A,T,C or G
cctcagcctggatgtctccccgttggcgaactcctatttatcctcaaagccccaacggcaatgccacctcctgccgcgggagccgtccccacgcctctcactctccccagcgccttcaaagctgtggacccacacgctcccatttcagcttcacctccagcctgaagagtttatttcaactcttcttccagagtgggaaacgggttttcctcaaaatcagggtagccactataatcggagactctagaatgttggccccctccccctcctgccatcctctgcagaagccgaggagcgttcgtggaatgaatgaatgaacgaatgatctagtggaacccctactttacagacggacgagtgtagtcccagagtctggactaaactagagggagcctggccagccccggggacagcggggacagagggaactcctgcaattcggagctgcggtattgcagccggttatacaacgtggggaggcagcctggctccccaaagacagcgcagcctcgttcccggagggcggcctgcctgggacctgccgggcactccgccaccctacggtgatgcagcaagagccgcgcggtccctttaagaaacccggctaggcgaggcccttctgtgatcccgcctcctcccttggcccgcgcagctccgacggagcaggccagtgagtgacgggcagatcgcccaatagcagcgtgcagaggcaggggcgtgccccggcgctgctacctgcgcgggcaagctcagcgcacttggcttaaggggcggcgcgctccctgcctgctgctgggcggagggaaggcggcaagagctgcggagcccctggaaggtgagaaggactcggagagggaagaaggcccgagactcgagaatgcggggttggggccgggagggatgcaagttccctgggaattagggggtccagcctctgacctccttccggtgaatgttgacgacggctgaattgatcactgattctcaaggggggcatcggacatctgggacccttaagagggcctttgccgatcacacacctgcagccccctgcccgttagaactcctgcactcccccttgccccgtcttacaaatggagaaactgagcccactcccccagatcctaagtcccgcttgatgtaaaggaaagaaccctggcgtaagggtctgggtctgaggtcccagttccggcctggtcacctttagcaacttcctgcccctctgtcagcgtcagattctccatctgtgtcagaggtggaccggcccaaggaaaatagatcaggaatcgctgactccaggagtctctatcccagccccttcgcctgactctttctctggctcccgcggtccctctgagcgattaatgctacataaggtgtgggcagagctggggtcgtgcctccagctgggcaactgcctgtctctctgggtgcctgggtttgctttcttgggcctcggtttccacttctgtagagtggggtgatagtccagcacttcccctgggcgtgtgaaatgtccagcactgccaatattcgttgctgttatcttcggagaacagtgaggggaaaggaatccttgcctgggctgggccaggcaggaggctgggggtcaggacctggaagaggcttccaggtgaggcttggggtggagcctggtgacgaaagcgttaagcccaaactcggtccctggaggattagaggatgatctttaagtccccagctgtcagccctgctcagagcgacagtcctggcagccaatcagatgcgaggacggctgcgggttgcgctcccattggtttactccacccctggggtagcggagcctctttatcgagtgactactgtttgcctcgctctaatcagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtaacgccccagtgtgagaccagggccgggtgggcaggcagcccccactgtcccccaccgtctcccacctattctcccccaggtccagctcctggtcgaattgctgtggcctctcttcctcttcttcatcctggtggctgttcgccactcccacccgcccctggagcaccatgaatgtgagcccccccagggaccaggcactttgtgtgtgtaggggaaggcagatggctcacccgtgcacaggaatcccccgtgcatgtcagggagccttcaccaggccgccaatacatggcatgggagtgagctctccatcgctggaggcatgcaagcggtgccgggcgacccgatgggggtggagtcaggcagagtccacagggcctcagcaccaggcgtctccccgcaggccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctgtgagccagaggcagtgggtgcggccggcctgcaaactcggggctgcagtgccggccggaaccccgcctcctgccctctctctgtccccagggtctcccggctgctagccgatgcccgcactgtgctgggaggggccagtgcccacaggacgctggctggcctagggaagctgatcgccacgctgagggctgcacgcagcacgggtgaggaggccggggggcctctggcagggctgagctctgagcctcaacttgccgggccgtgaaatgggcacagggtgggggtgggtgcctcagaccaacgtccccccagccccatgctcccgtgcgctcctcccccagcccagcctcaaccaaccaagcagtctccactggaaccacccatgctggatgtcgcggagctgctgacgtcactgctgcgcacggtagggtgtcggggcgggaccgcgctgacttcctgggacactgcactggggatgtcctggcactgccccaccccgggccaaggacctcccgttccaggcatccaggctgtccctggtctctgcggtgatgctgcttgtccgtctgggcccccagacagagtgtgtctgacccagtgaggaagactcgtctgtgagatctccaatgagtccctttgcctctcagagcctcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggaggtacgaggccccactcatcctcaacccccatggaggcaacgttggcaggcagcctgcgccgggagggtctggggcagcccgggcacttcccttgggtgggttttcaggaggattagacagcgagagggagaggctgcccctggcccagtgccctgccctggttagggcttggaggtgggatcattgccagctccgtctggtaacctctctctagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagtgagtgactgacctcggtttcccctcttgggaagtggaactctgggcaggggggcagggcctcatggcacccccatcccaggccccgcctgctcggagctgattggagccctggacagccacccgctgtcccgcctgctctggagacgcctgaagcctctgatcctcgggaagctactctttgcaccagatacaccttttacccggaagctcatggcccaggtgggggcagcctggatgctggggtgggagggtggtggccagagcccatccagtaccctcagtccaggtgggccagggccaggccggagggtcacggaaactatttgaagaagtaggagttagccgatggagggggatcagcttgtgcggaggatcagaggcacacgcaggagcaaggcagagggggcagggggtgggcaggggtcctcagaggaggagagggtcatcagtggagggggtgctgtccacaggtgaaccggaccttcgaggagctcaccctgctgagggatgtccgggaggtgtgggagatgctgggaccccggatcttcaccttcatgaacgacagttccaatgtggccatgctgcaggtgtgcgggggtgctggggaggtgggatgtggctccccggtgaggagggtagacaggcccggtggatgggaaggtgggctccgtgcagacccccacttttttttttttttttttgagatggagtctcgctctgtcgcccaagctggaatgcagtggcgtgatctcgactcactgcaacctccacctcccgggttcaagcgattctcctgtctcaccctctgagtagctgggactacaggcgcccaccaccacgcccggatgattttttttttttatttttagtagagacggggtttaaccatgttagccaggatggtctcgatctcctgacctcgtgatccacccgcctcggcctcccaaagtgctgggattacaggcgtgaactaccacgtcctgctttttttttttttttttttttttttaagagatggagtctcactctgttgcccaggctggactgcagtggcgagatcttggctcactgcaacctccgcctcctggattcaagcaattctcctgcttcagcctcacaagtaactgggattacaggcatgcgccaccactcccggctactttttgtatttttagtagagatgggctttcaccatgttggccaggctggtctcgaactcctgacctcaggtgatccacccgcctcgcctcccaaagtgctgggattacaggcatgagccactgtgcccgacccagactctcactttcacctgcgccccccagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggaggtgagggcctgtccacctgcggggtctgtttcagtggggagggcaggtcccatcctagtgttcccaccctggtgttcccagggggaggcgggcccggccctagtaagagcctgggatttgtagagatctcaggagggagccggccgtgggcctacgaggggaaaacatggcccagccccgaggtccagggggaggagcggagtggtctaggaggcaggcggaccccagcgcctaggactcacccccgcatcccacagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggtcaggcgagggagggggcggggggatgagggactgggcggggccaagagcgtggtgggtggggccaggcagcattcagcctattggagaccatgatagacaggatctgggctgtatcaacagtggtatggtagccagagcccggggctccttagaccaataggggcccgtgatgggcggggcctaggtgcatgaggggcgtggccatgggcctgagataagatgagagcaggtataggttgagggcaatggtgggcggagccaggtgtattattaggtccctggaataagggtggagctaaaattgcaccgggtgctgagcgcagtagatcttgcctgttatctcagaactttgggaggccaaagtgggagaatctcttgaggacaggtattcgagactagcctgggcaacatagtgagaccgcctcccccccgcccccctcccccaccaacctcacgaaaatatctttaaaaattagccaggtgaggccgggcacagtggctcacgcctgtaatcccagcactttgggaggctgaggcgggcggatcacgaggtcaggagatcaagaccatcctgactaactcggtgaaaccctgcctctactaaaaaaaaaaagtacaaaaaattagccgggcgtggtagcacgcgcctgtaggcccagctacccaggaggctgaggcaggagaatcgcttgaacccaggaggcggaggttgcagtgagccgagatggcgccactgcactccagcctgggcgatagagcgagactccgtctcaaacaaatgaataaatgaataaaattagccaggcgacttgggaggccgagctggggggatcgtttgatcccgggaggtcaaggctgcagtgagctatgattgcagctcttcactccagcctgggcgacagagcaagaccctgtctaagaaaaaggttattcagggtggggccccgggagtttctagcccttccctacaaccggccaccatgcccctctcgcaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgtgagctctggcacccctccccgctcttccccgcggcgggaaggtcccgggtgtgggggtgggcccaggctctgttgggaaccttcctgcggtccaggctgcgaactttgcacctttacaccactccacgtgacctgctgcagcgggaggagcaggggactctgagggtctggtggggggggggactctgagggtctgggggcccccggcgcagggacagcctgggctgcactgatgcctgagagccaaaggctggctggatcaggttccaaggaacagggaggcaaatcttcccgccttgagatcccgggacacgaaccagtcgtgccagatggtgggcggagggggggtctgcggagggtctccagcctccaccccagccgtccccaccccaggttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaaggtgggcgcgcctcggcctgcccggctgcagaatgggtgcgctggagggtgacagacaggggcggccccacgtgggtgcgcgcccccaggccaatccaggagctgcaccctaagctcccgttgcctctcacagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcggtgagagccgggtcgggcgtggatgggggacgccccccgcttcggccgctcactgaccgcccgcttttccgcagagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggtgggccgtagggggcggggctccgggccgggtcgcacctgctttgcgggaggctgagctaggggtgtggcctccaggccgtttgggggtggggggtggcttattcccttggagagaaggcggggcttcttggcacacgcatgcaggtggctgcattggaggggcggggcctgaggcaggtgggcggggtttctgggccgcctcatacctggacgccctgattccaggtgtatggccagaagctggcacagtcgccgggcgctgtggctcacgcttgtaatcccagcactttgggaggccaaggcaggagaatcgcttgagcccaggagtttgagaccaggctgggcaatatagtgagacctcatcaatacaaaaagttagctgggcgtggtggcacgctgggcgtggtggcacgctcctgtagtcccagctactcgggaggatggggtgggaggatcactcgagcccaggaggttgaggctgctgtgagccgtgatcccaccagcctgggcaacagagtgagacctccatctctttaaaaaaaaaaaaaaaaaaaaagctggctgggtgcggtggctcacgcctgtaatcccagcactttgggaggccgaggcgggcgggtcatctgaggtcgggatttcgagaccagcctgaccaacatggagaaaccccgtctctactaaaaatacaaaattagctgggtgtggtggcgggtgcctgtttcctagctacttggaaggcagaggcaggagaaatgcttgaatcccggaggcggaggttgcggtgagtcgagatcgcgccactgcactccagcctgggcaacaagagtgaaactcagtctcaaaaaaaaaaaaacaaaaaaaaaaaaaacaaggccgggcacggtggctcacgcctgctttcccagcactttgggaggccgaggtgggcagatcacgaggtcaggagatggagaccatcctggctaacacggtgaaaccccgtctctcccaaaaatacaaaaaattagccaggcatggtggcgggcgcctgtagtcccagctactcaggaggctgaggcaggagaatgacgtgaactggggaggcggagcttgcagcgagtcaaaatcgtgccactgcactccagcctgggcaacagagcaagactccgtctcaaaaaaaaaaaaaaacaaaaccccaaaaaaagcctggtacactcctggggggtgggctaagcaataacccgcgcccctccccgcaggccagtacgggatccctgaaccatggaattttccttttcggaggagctactggtgcggacctcggccccccaagagtccagccccttgccccaccccgctggacccaaagggtgaggccctacgaggcttaatagctggttgtccacatatgcccagttcccccccaaaacgagattccacagatgccaatgacaatgacctggacaccccaaccctcacacctgccctgaagacactgcggtccccaagctcccgcagcttttataggccccggcccagcaggtcccggattccacagcccagctctgagggacttgcaggccccaggacccccatgacctccatggctgagtccaccccatctctgcagtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtgagcccccccaccactccctcgcctgtgagttcccccaccactccctccctgtgagtcccccaacactccctccctgtgagccgcccaaaccactccctccccgtgagccccccaccacttcctccctgtgagctccctgtgaggcccccgaccagtccctccctgtgagcagtaatggcgccactgcactccagcttgggcaacggagtaagaccctgtctcaaaataaatagggcgggagtggtggctcacgcctgtaatcccagcacttgggcaagccgaggtgggaggattgcctgaggtcagagtttgagacacagcctggccaatatggcaaaaccatctctactaaaaatacaaaaattagccgggtgtgatggtggcgtgcacctgtaatcccagctactcaggaggctgaggcaggagaactgcttgaaccctggaggcggaggttgcagtgagccgagactgtgccgttgcactccagcctgggcaacagagtgagactctgtcacaaaaaaataaaaataaacaaataaataaaaataaggctatcacagggttttggatgtagcatttaataggtgctctgtggccaggcgtggtggctcaggcctgcaatcccagcactttggggggccgaggcgggtggatcacgaggtcaggagattgagatcatcctggctaacatggtgaaacagtgaaaccccgtctctactaaaaatgcaaaaaaattagccggacatggtggcgggcgcctgtagtcccagctactcgggaggctgaggcaggagaatggcgtgaacccgggaggtggagcttgcagtgagccgagatcgtgccgctgcactccagcctgggcaacagagtgaaactccgtctcaaaaataataataataataataataataataataataaataattaaaaattttttaaaaacagaaattaaaaatagaagctctgtaactgccagtgcactctgtgaagggggctactctgagacccctctatccacaggtccatcttgagtggcctcttcccacccagtggtggctctgccttcatcctgggccacgacgtccgctccagcatggccgccatccggccccacctgggcgtctgtcctcagtacaacgtgctgtttgacatgtgcgtctcggcaggcccagagtgcagcggtgggaagggactggacgccctctgggactctgcctgccatgtgggtcactctgctctgtgcactggccgcaggctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgagcccatccccaagggaggtcacctcacagggaggggcctggggattcatcctgaaggcagggggaagccgggtactgaggtccacgtgggtaggcaaccttgcccaaggctgggtgtgacacactgaggtcccttccccatctctaccaggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtaagagctggggattctgctcgaggggccagaaaaggcttctgacaaggaagtgctggggatggggttttgaggaatgagtaggagtttgctacatgtggaccccacttgttgctatggcatttaggggctactgctcaaataccgagacagtaagagttggggatagacagaggttcccctggattctgcctgaagggccagaaaaggtttccaacaaggaggttctggggatgaggttttgagggatgaataggagtttgcttcatggggcagacaactcctggcagaggccccagctcgggcaaagacgcggcggcctgatggtagttgtgggttggtcccccgtgcctaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggtggggaccggccttctcctgacccctgacccccgggactctgttcagccctgaaggccaagccacttggtgcctctctgcccgcaggctgacactgacatggagggcagtgtggacaccaggcaggaaaagaagaatggcagccagggcagcagagtcggtgagggccggggtgggagacccaaggcgggtgggcagtggggtggctgtgccttaacttgaggaggaggagggggagggggaagaggaggaggagggggaggaagcggcagaggaggttgaggcggaggaggagggggaggaggagggggaggagtaagaggtggaaggggaggcgaaggggaggagtaggagggagaggaggagggggagggagaggaggagggggaggagaaggggggaggaggaggggaagggagaggaggagggggagaagaaggggaggagtaggaggggagcagaaggggaggaataggagggggaggaggagggggagggagaggaggagggggagggagaggaggagggggaggagtaggaggtgagcagaaggggaggagtaggagggggaggaggagggggagggagaggaggagggggagggagaggaggagggggaggtagaggaggaggaggagggaggagtaggaggggagcagaaggggaggagtaggagggggaggaggagagggagagagaggagggggaggagaaggggaggagtaggagggagaggaggaggagggggagggagaggaaggggaggagtaggagggagaggaggagaaagaggagggggaggagaaggaggaggggaggagaaggaggagggggagaagaaggggaagaataaggggggaggagtaagggggagggggaggagaagggggagaagtaggagggagaggagggggaggagaagggggaggagtaggagggagaggaggaggagggagaggagggggaggagaaggagaggaggaggagagcacttgagaacctgagatgatgcccccatccctgggctgagccggaaccatgagactaacttgaacactgaccccacctttaacccaaccagggctgagcccagagacaaacctacccctgacctccaacactaggtccagcactgccctcaagatctctttttgtttgtttctgagtcttgctctgtcgcccaggctgtagtgcagtggtgtgatctcagctcactgcaacctctgcctcctgggttcaagcatttctcctccctcagcctctcgagtaactgggattacaggtgggttccaccatgcctggctaatttttgcatttttggtagaaatggggtttcaccatgttggtcaggctggtctcaaactcctgacctcaggtgatctgcctgcttcaaccctcaaagtgctgggattacaggcgtgagccactgcgcccggccgcacctggcctacgttcttaaccctgatctctgtctgccgggacagtcccctcacaggtcaccaatgcctcttccccagggagactggggtggggcgtgagccggggctccctgaagcacccctttgtccacacaggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggaggtgtgaggcctgggtggtggtgaggtggggccaggaggagggcttcctggaggaggtggtgttttgaaggatgaatagcgtgtttatgagcagcaaggacattcagggaggaggcatggcacatgaggagctctggtggctcagatgtcccttgggaaggcctgggggacccatggtgtaggaggggtggggggctcacaagcccccagttctccctgtcggtgtccagtctctgagcccctgcttgtctccccagatcttcctgaaggtggtggaggagtgtgctgcggacacagatatggagggtgcggccacagctccctgacccctgaccccagtccagagtgggaccagaggccaggtccccatccctggcttagtgtggcccaaggcatagcctttaccctatacctgattcctgatcccccaatccgtgaccctcaactttgaccctgacccctgatggccctgcagatggcagctgcgggcagcacctatgcacaggcattgctggcctagacgtaaccctacggctcaagatgccgccacaggagacagcgctggagaacggggaaccaggtaagtccttcccagtggccctggggtcctcccagccacccccccacagcagcgtgagcactgaccctctcatccctcacagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccaggtgaggagggctagcaccagggagtcgcatgggagtccctgagttccctaccctggccgtccactcagtggcctaatccaaacccttacccccgtgtgtattcccaacccaaagcacatttattgagggcactggggagccatgggtggttgtagagcaggagcagggacaggtgcaagcaagcctggagggtggatggaagcagcagctgatgggctggtcccccagatcgtgctgcctgccctctttgtgggcctggccctcgtgttcagcctcatcgtgcctcctttcgggcactacccggctctgcggctcagtcccaccatgtacggtgctcaggtgtccttcttcaggtgggtgcagaaggaaggggctggtggcaggaagactagggacctgggggtacagccctgaccctacatctcccctcacacacagtgaggacgccccaggggaccctggacgtgcccggctgctcgaggcgctgctgcaggaggcaggactggaggagcccccagtgcagcatagctcccacaggtgaggcgtcttgttggcctggacctttcccctctctggcctcagttttcccatctggtccctggccagggagcctcagggggcacctggagcatcccctgtgcccacctgggagctgggagcctctgtggctccaggaacccccagaagctgggtgcccacagaccttcaccttgaccctgcagcgcccttgagtgtgcacagcccattgtctgcaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccaggggtgagccatgccctgggactcagtttccctggctatagcatgggtccttgggttgctggggctggtgtggtcctggaggaggaagtggaggggttggatgcccagcttggggctacgggctgggagtctcgcgtaccttcctttcctctttttttttttttttttttttgagatggagtctccctctgttgcccaggctggagtgcagaggtgtgatctcagctcattgcaacctccacctcccagtttcaagcgattctcctccctcagcctcccgagtagctgggattacaggcacgcaccaccactcccgactaatttttgtatttttagtagagatggggtttcaccgtgttgccaggctggtctcgaactcctgacctcaggtgatccacccgccttggcctcccaaagtgttgggattacaggcaggagccaccgcgcccggctttctttcctgtttttgtccacccttgactctgtgctcccctctcaccatctctctctctgtcccacatccctgtctgcctgtgtctctgtccatctctcccacagcctgaagactaagaagtgggtgaatgaggtcaggtgaggaggggtctagcttggggtcccctgccccagttccactcccatgccctctgcctgccccctgggagctctcccggcccccccggccctcagctccccttccctgcctgcatggccccacagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaaggtgggaactgggggggcaggtgggcgtcctgtcacagcaaggtccaaccccattgctctgaccctatgaccttgacccccacccagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgaggctgcactgtgagtccctccaccctgcatgtcctaccctgcacgtcctaccctgcctccatttctctgtcgtttggggtggtgggagctggatttgaaccctgacacactcttgctttataaatgggggatagaaactgttcctctgctccctaagccagggaaatgggacctcctcagactcagcgggccccagcctcccccacacatcctcatcccaccaacctttatcctgcctgagacctgtacaacctctgctgccaaatcccaggcaccctcatccctaaattgcccctgccatctctgccactgctgactgccccatagacctttgtcccatcaatggcgtgttcagctctgctctgagcaacccatgcaccctcaccctacaacagctctcatgtcttcacctccaggatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatggtgcgggggctgcttggacgggtgggggcccagccactgcttgccactgccctgtctggccccttgtaggcaggggcttgtccaagatggcctgggtaaagtcttgaggattgtgggagactttgtgccttcctactcaaaaagcaaggaggtcagggtgggaacagggctgagggtggcagtgcccacctctttaggctgataaaggtaactgccatctccaatgcagtgtaactacttggtgccagcatgcatcgtggtgctcatctttctggccttccagcagagggcatatgtggcccctgccaacctgcctgctctcctgctgttgctactactgtatgggtgaggcccccagtccctcagggcctattcttactgaccccttactgccttccacattaatgctgctgagatagaactctgcagtgactcccaaggagaggatatggaggtctgaggtgatgccgtgtgtgatccaattcagtggtgtgccaaggtggccttaaaagctcatcttatcctgactcatattagtagagttctaaggcagcccatgcctgtaattccagtactttgggaggccgaggcaggaggactgcttgtggccaggagtttgagaccagcctgggaaacatagagagacccacctctaaaaaagaaagaaagagagagaaagagaaagagagaaagaaaaaaaaaaaaacagaaatgtgctttgggtgaaaatgtcaaggtctaaggcagagaagatgggaatggagatttttattcctctcagggcttctcagtctgagtggttactccagtgactcctattgtcccttcagctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcaggtggggcaccacgaggctggggcttgggctgggttgggtcgttggactcagcccctgaccaacatccgtctcccacccttgagcagaagctgcaggaggtgagccggatcttgaaacaggtcttccttatcttcccccacttctgcttgggccgggggctcattgacatggtgcggaaccaggccatggctgatgcctttgagcgcttgggtgagaacttcctgtcaggtggggccatggctacagatagctagcacccttggagacctagagttaattatacagagtggagaaaaacagccccccagggagacagccagggttcttaggtggccctaaggttgggccaagttggaggtacaagaaagcagccataaaaagctaattcttagattacatcacaagaggcctcttctgttttctatgccaattagactccagctgagtggcctatccaatttgtgttcctttcccttaagaatccagagtgacatggatggagaaagggccagaaaccaagactctcatggacccagtccctcctttctatatccacaggagacaggcagttccagtcacccctgcgctgggaggtggtcggcaagaacctcttggccatggtgatacaggggcccctcttccttctcttcacactactgctgcagcaccgaagccaactcctgccacagttagtgaggtctatggagagggtggcaggggccaaggacctactttaagcccacagatattctgtccccaggcccagggtgaggtctctgccactcctgggagaggaggacgaggatgtagcccgtgaacgggagcgggtggtccaaggagccacccagggggatgtgttggtgctgaggaacttgaccaaggtaggtgtggtcaggtcgactgctgggtggggggtgctcccactggcccactcacctttctgaaagacctgcactctcccaggtataccgtgggcagaggatgccagctgttgaccgcttgtgcctggggattccccctggtgaggtgagtccaggggtggaggccaggtgcagggacagtgagtggctgccctactgcatgccctgcccatcatcctttactgaacacctactgtgtatccaccaccttttattgggcacctactgtatgccaatatttgtgctcctatttttattttattatattattatttatttatttatttatttatttatttatttgagatggagtctcactctgtctcccaggctggagtgcagtggtgggatctcagctcactgcaagctccacctcccgggttcatgccattctcctgcctcagcctcccgagtagctgggactgcaggcgcccaccaccacgcccggctaatttttttgtatttttagcagagacggggtttcaccgtgttagccaggatggtctccatctcctgacctcgtgatccacccgcctcagcctcccagagtgctgggattacaagcgtgagccaccacacctgccctattttatctttttttagagacggagtctcactctgtcgcccaggctggagtgcagtggtgagatctcggctcactacaagctccacctcccgggttcacaccattttcctgcctcagcctcccaggtagctgggactgcaggcgcctgccatcacgcctggctaatttttgtatttttagtagagacagggcttcaccatattagccaggatggtctcgatctcctgacctcatgatccacccgcctcagcctcccaaagtgctgggattacaggcgtgagccactgcgtctggcctgtgcatttatcttgagccaacaaaacctcattaagcacctactgcatgcttacctctgttaaacacacactgtgctcactaaagaggtgtactgaatacttttgtgtccatcaacgtttatcaaataccaatagaatttattggacccctattgtatacacatctacatcaagcacttgctcacagccagcatttatcaggcacctgctttgtaccagttcacattcaagcacctactatatacaaatgtatttgctgtgtgccacttattggccacctactagggctggtacacatctgcaaacaagtgctgtttgttagcacacattgcagtatatatatatatttttttttctttttttttcttttgagatggagtctcactgtcacccagcttggtgtgcaatggtgtaatcttggctcacggtaacctccgcctcccaggttcaagcgattctccagcctcagcctcccgagtagctgggaccacaggcacatgccgccatgcccagctgattttgtatttttagtagagacggggtttcaccatgttggccaggctggtcttgcactcctgacctcaaatgatccacccaccttggcctccgaaagttctgggatcacatgtgtgagccaccatgcccggcctttgtttttttctttttttttttttttgagacaaagtctcgctctgccacccaggctggagtgcagtgtcacgatctcggctcactgcaacctctgcctcccaggttcaggcgattctcctgcctcagcctcctgagtagctgggattacaggcgcccgccaccacaaccggctaatttttgtatttttagtagagatggggtttcacaatgttggtcaggctgatcttgaactcttgacctcaggtgatctgcccacctcggcttcccaaagtgctggggttacaggtgtgagccactgggcctggcccacagtatatctttactaagcacctactgtgtgctggccaacctctctaccttgggctgactgtgcacctagcctaagtacacacagtgtgccaggaaacatatggagagctcatgccctgatatttgttgagcactgctgcacacgacctttatagggtacccactgtgtgccaaaagccattccctgctaagtgacagctttatgcctcgctacataccccaatatctgcctagctcccccggggccccacccacggccttccatgtggacactcagaaatcagaggtgctgaggccaggcgtggtggctcacagctgtaaccccagcactttgggaggccaaggcaggaggatcacttgaggtcaggagttcgagaccagcctggccaacatgccaaaaccccgtctctactaaaaatacaaaaattagccgggcttggtggcacacgcctgtagtcccagctactccggagcctgagacaggagaattgcttgaacccaggaggtggaggttgcagtgggccaagatcgtgccattgcgccggggtgacacagcaaggctccgtctcaaaaaaaaaaaaaaaaaaaaaagaggctgggtgccgtggctcacgcctgtaatcccagcactttaggagttcaaggcaggcggatcacaaggtcaagagatcgagaccatcctggccaacacggtgaaaccccatctctactaaaaaaaaatacaaaaattagctgggcatggtggcaggcgtctgtagccccagctacttgggaggctaaggcaggagaattgcttgaacccgggaggcagaggttgcagtgagccaagatcgcaccactgcagtccagcctgggaaacaagagcaaaacttggtctcaaaaaaaaaaaaaaaagaaatcagagatgccggaaccagggcctggggcctcactgagcaccatctgtgggcatccctgtagtgttttgggctgctgggtgtgaatggagcagggaagacgtccacgtttcgcatggtgacgggggacacattggccagcaggggcgaggctgtgctggcaggccacaggtgaggggtgccaggtagggtcagggtggggcagggttggccctgacgtccttgtgcttccccacccctccacctccagtgaatggactgggctcactgccccacacctgcatggtctctgagacccctgcacctctacctcccacacgcggaccaggccctgagacacccctgtcccttatcagcgtggccctggatgggtgggccctgagacccctgtgttagccaccagtatggtcagggactagccagctctctgagcccccggcgcccccatccccagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccaggtgagcccactttgtccccaccgctctcacctcccagggcccacccgacccaggccgtgcctctaaagcctggcccaatcccgcactctctcgccttggctccatccctgtccctgcccccagaccgtgcttccttcccctatacctctgtcccccatcctggtccaatagggatgtggctagcccgcctctttgccccgcaacaccaagttccaccattctcattggtccacccacccttccttccgctgcacgttgcccctctctccttgactctgccttctgtggccctgcccacttgctcctcttctgcctaccccctagggcttcgcgcctttctcgctggggtcacggtcacattctcactctggccgttcccagtttgcagccgtttcactgcctcttccatctgcttgggggtcttgtctttgccctggcccgccccaccctcacactgtcccaccccatgccctttctggccctgcctcatacccatgttggctccacccacaccatggccctgctccatacccatcccagctccacccataccaaggccccaccccatactcatgctggctccacccacaccatggccccgccccatactcatgctggctccacccacaccatggccccgccccatactcatgctggctccacccacaccatggccccgccccatactcatgctggctccacccacaccatggccccaccccatactcatgctgtctccacccacaccatggccctgccccatactcatgctggctctacccacaccatggccccgccgcatactcatgctggctccaccagtgtggccccgccccatactcatgctggctccacccacaccatggccccgccccatactcatgctggctccaccagtgtggccccgccccatactcatgctgtctccacccacaccatggccccgccccatactcatgctggctccacccacactatggccctgccccacacccatcccagctccacccacaccatggccccgccccatactcatgctggctccacccacaccatggccccgccccatactcatgctgcccccaccacactatgtcccattctcacatttgccctgccccatgcccattgtgcccctgctccacactcaatgctggccccgccacactgtggccctgccccatactcatcaatatgagtccccatgcctactctggccccaccccacagaccgctggctcgggcctggcgcgtctgggactctcatggtacgcagaccggcctgcaggcacctacagcggagggaacaaacgcaagctggcgacggccctggcgctggttggggacccagccgtggtgtttctggtgcgtgggagcggtgcctgggtggggtggggcctgcgacggaggcggggccttgcttatgggatcttccgtgctccccaggacgagccgaccacaggcatggaccccagcgcgcggcgcttcctttggaacagccttttggccgtggtgcgggagggccgttcagtgatgctcacctcccataggtggccgggctctgatgccctgggctgtggttaaggtgatccaggcctggagagagagccccaaagcacaaggccacaggggatggggggtcctggccctagtggggcgagggcgccaggccccggggtgtaaggacacacagaggtgggacgcggcgccgggatcagaacggtctggggaagagtggggagatgtccacaccagaagggtggcccaggccgggggaagcaggcagtgtggcgccaggcacaggtggccccggcctcacggagctcgtggtgccgggtcccgacagcatggaggagtgtgaagcgctctgctcgcgcctggccatcatggtgaatgggcggttccgctgcctgggcagcccgcaacatctcaagggcaggtgagccggcgcggcctccaggcaggtgtggggtgagggtgggcacgtaggtaggctcaggggagaggccagacgtagagccgggtgaggaaagtttggctccaactggagagatggccaaggctttagattgtcctgcaggggtgactgagggggcgagacaggctggggtgtgctgggggcgcaggaccaggaggcgtgagccgggggctctgggtggatttagaagacacaatcaggtgtgcgttggagtaggtgcagcctggagaggtgagggtggattgatgggtggagttaggggagggcctggttagtgggcggggccataggaaagtggggcgggggtatttattgtgtgggcgggggtagagtgcaagggcgaaagaggagtgtccgaaaaaggagtcaagtggggtgatagcttcgagagcaacctgggcaacctagggagaccccatctctataaaaaatttaaaaattagctggacatggtggtgtgtgcctgtggtctcagctacgcgggcggggggtggcgggggactgagacgggaggaccacttgatcgctagggtagtacaagtatggggcggggccagagagtattaggggctggagggtgagctgaggtgggacctgggaaaggcccgatccggtagccctggccccactcactgcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtgatcacggcgccggggtcgggctgggggaggcaggctgggggccaggcccgtgggctgaccgtccctcttgtcccctctgggctgcccaccgctaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaccgtgtgcatgtgtgtccttgagccaggctgcacacatgtccacacagctgcctgcacatgcgtctggatatggctggccccttgcaagctgagtgtgcacatacgggccaagtggcgattcataggacacaggtgtgagcgtgcctacagctgaccggatcccagctgtaaatgcctctgtggccagcccaggagttggggatgtgagtgcgggcctcataagggcctggtcacaccgtccctgtccccacgtccctgcgtgcctatgtggggctggcgcctaagggcggtacctgtaagtgcctggccataaagtggggatgaggtcaggactcaggaatgtcctgggaagcttacaggagcccggtgtcccggagcacaggccagggccgggccagaagcccatccgacatccagctgaccctcaccctctgaccccagccctcagcgccatgagtcgggggcaaagagttctcaagggtctgctgggctgggtttgcacttggacctgggcctggagagccagacttggagcaaggggctgtggccttcatgtcctgtgccccagagatctgcccctcccacccgaggtaggtgggaatggggtttgggaaaggaaagaggttggggttttgggattgggggtggggttctggaaggggacagcagggagacttggggaggggggagagagttcacactgcggggtgggggttgggggaaggtaggaggctgggatctgtatgcctgcagatgccccagctcttggccaatgccgcctcaggctgttatcagcaacgggtgcctgcgtcctgctgcccagcacgtccggtggtccagagtcactggaatgcagcttgggaggcggggctggggaccttagctaagggcaggtctggggcaacatgatatggcccacagggctgctgagaggtaaccaggtgtcctcagcatattctgccgatggtggggtccacaccacactttggggacccctgtgcaggcagcccaggaccaggtggacgtggggacccagacggacgtggggacccagacggacagggcccggtaacctggattgttctgacttcctggacgtctttgcccccagggtttcggttctgggcctcagtttccccacctgtcctcgacctgacccacttcacggggctgcagggcgggtgatgggggggaccctactctgcccggccctgctggggcccggccacaccctagggtctgcaggagaggcggtggagcgggcttgccttcagggaaaagggggctgcaggggcgcagcttcggcctgtgcgtgtgtctggggtctgagggcgaggctccaggggcttggtggcgtctgagcgcgtgtggaggtccgggtctctgcgtgtcatcgtgcacgtgtctgtgcacgcccactcgcgtccgggagtgagagtcagcgccctgcagtcggccgccccgtgcccgccagcgtcaggcaggggctcccggtcccaccccgcgagcggcgcggctccgagctcccgaaggcggaagcggggggcgcggcccggggctgggggcggggcctgcgacctcaccttcgcgcccactccgcagagccgcaggctgaggccgggaagggtcgggggcgaggccgcgtcgccgcctccccgaagccttttcctgttggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggtgagtggagcccgggtgagacccggagctgacgccgggccgcagggggacagggacccgccctgtgctcggggct

SEQ ID NO: 12819 - DNA, 9801 bp, Human
gagagaggttgagttgggtagttgttggtatttttgtttttgtttctttgcttattcagttgaggtttattgtaaaacttgacaccagaaaaaggaagaagtggcgtttttgtgctgtgagcgtgtgacgtgtgtcctttccagagaaaggacagtcatggtgcttttttatcctctctgcccaaagaaggaaagctcttaacagccagcaggaggctttgtagggaccagcgttatcaacgccagtcgcgctgaccaatgatgagttaaagcagttaggtcgtttctaagagcaaatcaaaagctaaggttctgtgattctgaaaatgagacacggacagagactggagacccagagagaaagtgaaggactaaaagacagtcatagggtgggagtttgctctcctctgttttgttctgggtttttttgtttgtttgtgcgctctgtctgaccgcttttcttttttttctttttctttcttttttttttttttttttttttgagatggagtcttgctctgccgcccaggctggagtgcggtggcacaatctcggctcactgcaagctccgcctcccacgttcaagggattctcctgcctcagcctcccgagcagctgggattacaggcatgcaccaccacactcagctaatttttgtatttttagtagagatggggtttcaccatattgaccaggctggtcttgaactcctggcgtcaagtgacttgcccgcctcggcctcccaaagtgttgggattacaggcgtgagccaccgcgcctggccctgactgcttttctccttggtttgtttctcaatcccccttcctctgagccgaattccctttttgttctcattttctctctctgtcccctctctctctccttctttctctccttccattcctcctagatgaagcaaaaactcagataaaccagcacagaggccaggtatggtggctcacacctgtaatcccggcactttgggaagccaaggcaggcaggttgcttgaggccaggagttcaagaccagcctggcccacatggtgaaaccccgtctctactaaaaatacaaaaattagccggacatggtggcacgtgcctgtaatcccaggtactcaagaggtggaggttgcagtgagcggagatcacagccctgcactccagcctgggtgacagagcgagactccatctcaaaacgaaaaacaaaaaacagcacaaagttcccttgtcctgtgactcattctctctctctctttctaccatttctccttccctgtgtcttttttttttctctctgtgggttttatttaagcaatagaagttcttagcaaagaaaaactttatggaattagattgatccacttcatatgtacatatatgaactcagttcagaaactctcttctacccctgcctgatcacctatttggaagtctgttccttcaactcttcttctctttctgggactctttctagcttgggcttcctgcccctcccgtccactctcctgctttcacagcctctccttccccctgcccctcccctgcactgcatggggatgggccccaggtgtccaaggtctccccaccctcctttgtcactggagtcaggattagaacccagctccctagtcaccttgagtcatcagtcctggggctgctgacgggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgaggacaggccaaacagtgacagccacgtagaggatctggcagacaaagagacaaggtgagaaggaggtaggcgactgccaatgagggagtgacacacaggggagcaggtagagagaggacaagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcagggtactgctcacctcggtctcccctattttttgatccctcttcccttctgtccctctctgaatctctgtctctccatttccctcctatgtgtaagcatctttctccctgggtgtctttgatgtttcatggtctttttctatcactgggtctctctctctttctctctctttctcgtctctctttctcctctctctctcctgcctgtttctctctctcactctgtgtgtctctccatctctgtatcttttcttcctctctctgacccatgcccctgtctgtctccagggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcaggtaagtcccttcctggggtgggcgaagggaggactatgggaaggcaagcgctgggggtaggatcacaagggagggtggtgcccactgggaagaagctgatcctgcaacaagagagtctgaggttagaccaggagtggaacttccttagcagtgggcctggggtggtgctgggcagggtgaggtatgttgggtggagggccggggagggtcctggaacctgccctcctgcctctcccattcctgcatgtaccctttctttcctatatgacatctgccactcaccccagccattccttgacccagtctgggcccggggcccaggtctcacccaagctctttttctttttcttttttttatttttttgagacagggtctcgctctgtcgcccaggctgctgtgcaatggcgtgatcacagctcactgctgtctctgcctcccaggttcaagtgattctcctgccccagcctcctgagtagctgggattacaggcacccgccaccatgcccagctaatttttgtattttttgtagagacagggttttgccatgttggccaggctggtctcgaactcctggcctcaaatgacctgcccgtcttggcctcccaaagtgctgggattacaggtgtgagccactgcacccggccaacatgacccaaactctttgtgcaacttcagaatctatgcctggcacctctctgggcctcagtagactgatgttctggaatttttttctttttctttctttttttttttttttggagacagagtcttgctctttctgtcatccaagctggagtgcagtgatgctatcttggctcactacagcctcaaccacctgggctcaagtgatcctcacacctcagcctcccaaggagctaagactacaggcctgcgccaccacacctggctaatttttaaattttttttgtagagacagggttttgctatgttacccaggctggtctcaaactcctcagctcaagcaatcttcctgccttgacctcccaaagtgctgggattacaggcatgagccactgtgcctggcctggaactttttttgtgaaaggggagatcagatgcaaagaaacagagactcagggagagagagggccagcagcaggatgcagagaggccattcatcaacccactcgttcaatcatgaacccactcgtccacgcatgagcatggagggcacatgctccgtgccaggcggtgggaataaggcagtgaacaaggtccactgatgtccctgccttcatgggcttcaccagccgagagaatcagaaagagaggcctggcgcggtggctcacacctgtaatcccagcactttgggaggccgaggcgggcggatcacttgaggtcaggagtttgagaccagcctgacacacatggtgaaaccttatctctactaaaaatacaaaaattagctgggcatggtggcatgcttctgtaatcccagctacttgggaggctgaggcaggtgaattgcttgaacctgggaggtggaggttgtagtgagccaagatggtgccactgcactccagcctgggcgacagagcgagactcggtcttgaaaaaaaaaaaaaaaaaaaaaaggagagagagagacacagatgcagggacatggtaggagaaacagggaacacccaagatggaaagagggtgatggaggttgggaataagagcctgtaagagagactcggagaatgagagttgcgggtgagaggacagacagtgaggggcagaacagtggggagcggcaggagcgcctgagtgtccgtggaggggtgcaaggtgggggactgcgtgcctgccacccgctcagccgtcgccaccggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggagtaaggggcccagggccaggggtcaggggtcaggatgggtacaagtctgggatgcagggcgagaggtcgaatcatgacacctcagaggaaggatgggtaaagggtcagggtgtgggatgggacatcaggatcatggtttggggtcagagattatggtggattggggtcttgggagccaaaggggttaaaggactgggtatgaagtcagggatcagaggtcagaggtcagagtgtgtcagaggtcatcacactggagcaaaaggcatatatatatatatatgtatgtataggatatgggcattgtgggtcatgggtctggggttagaggtcaccgtagaattaaggtcatgggatccagaggttgtacaatctggtcaaaatctgaggatggaaattgggattctatccaaaatcacatatctgagattggaggtcatagcgtttggggtgtggggcccgaagtttggggtcatggaggctggggcccaataaactaggatcaggggacactggcgttggaagcagtgaggtttggaagatgcagagctgaggttggaggttaaggtaaagacagggacatggggtcaggagacagaagatatgagatcaagctgggatcataaggtaataagacagaaggtcaaagatcacagtagctggcattgaagagggtcaggtctggattcgttgtctctgacgctggagagacaagaaagttcttgagttatgccactcaaagtcaaatgtcaaagatcaaagagaccgtcaatcatctggggtcatgattcatatgaaattaagtcataaatatgtaacttggaggtttcgggattgtagtacaggtcggtgaggggcaggggtattgacatggatgggccacatccagggaagagggacgtggcctcaaagtggggagatttaggggaccctgcagcacgcatgttctctctccagacccattcccggatctgctccagtgcctcaacctctccatcgtctcccatgccacctgccatggtgtgtatcccgggagaatcacgagcaacatggtgtgtgcaggcggcgtcccggggcaggatgcctgccaggtgagccagtgcaggcagcgtgcgtggtcaccaggacaggaagtgaaggggaggggctggaagcaggaggggaactgatggaggatgaatcagggaaaggggatgctgcagagagacggggtcaaaaaggaagggagaggctggttacggaggctcacacctgtaatcccagcactttgggaggccgaggcgggcggatcacttgaggtcaggagttcaagacaagcctggccaacacggtgagactctgaatctactaaaaataccagaattagccgggggtggtggtgcaagcctgtggccccagctacttggaaggctgaggcaggagaatcgcttgatcccgggaggcggaggttgcagtgagctgagatcacgccactgcactccagcctgggcgacagagccagactctgtctcaaaacaaaataattaataataataataataataataataataataatggaggagaggcccaggataagggagggagagagacagggagtaaaagggaggaccggggaatggaggagggggaggggcagggagagagagggaggaagggaacagagaaggaaagatggggcaggggttacagagagagacagcaaaacagacggagaggactgggagcccagacagggaaccagctgtttctggggctctaagtctttcccataccatcctccagttggtgctgtcccagactgagagagatttgaggatggcggtctctcccctcattggtcagggccccagccattgtccttgagagaactctgtgcttttgatggagtcctgcccaccttccctgggattggtcatttttgatggcactctctcccctcattggtcagaaccccaggcattgtccttgagagaacctctatcctttatggagtcccaccctcctcccctgggattggtcattgataatagtgttctctctcctcattggtcagggccccagccattgtccttgagagaatgctcgactctttatgttgtcttgacagcctcccctgagattggtcattaatgactgtgctctctctcctcattggtcagggccccagccattgtccttgagagaacctctgtcctttatggagttccacccttcttccctgggattggcccctagagacagtggttcttctcttttggttagccattgccattgtcctccgggaaagtgattatactcttttgtctaatgaccagacttggagccctccccaaggcccaggactgggttgaagggttggggaggaaaacagaaataagatgtctcccttgttcagacagtacttctcttcccttccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggccatgtctgtccatttgaagtcctcatgctggttgagactggaagaaggactcagcagtttccctatctcataggagtagaaacagagctcaaataaggccaggcacagtggctcacacctgtaatcccatcactttgggaagctgaggcaggtggatcacctgaggtcaggaactcgggaccagcctggtcaacatagtgaaaccccaactctactaaaaatgcaaaaattagccaggcatggtggcgcatgcctgtaatcccagctactcaggaggctgagacaggagaatagcatgaacccgtgaggcagaggctgcagcgagccgagattgaaccattacactccagcctgggcgacagagcgagactccatctcaaaaacaagcaaacaaaaaacccagtgctcaaataggatgagggtcttccctgagtagttactcagaaatggagtagaaaaagttacttttaataatataggctgggtgcagtggcccacgcctgtaatcccagcactttgggaggccgaggtgggaggatggcttgagctcagatttcgagatcagcctggcaacatggtgaaatcttgtcactacaaaaacacaaaaaattagctgggtgtggtggtgcgtgcctgtagtcccagctacttgggaagctgaggtgggaggatcacccgagccggggaggtggaggctgcaaagagccgagatcatgccactgcactccagcctgggcaataaagtgagaccttgtctcaaaaacaaaaacccagcaatataaataagacacatgtttcttcatctggcataatagaaatagtgcccagagcttataagcttttcaagagtccacaaaagacccgaaaaagaaaaagaaaattgttagctccaaaataccagatgaaagctgcaaagtcaacatttatgaccatttaatccaatgtccataaaacgtagcattctttccactagccaactgcagtttactttcttgtaatgaagcatacattgtatctttaatgtgggacgtggctttgttctaataagacgaagggtggagtgcaggcttggaaagcaggagagctcagcctacgtctttaatcctcctgcccaccccttggattctgtctccactgggactcaagaggtgaggagagaccatctccccaaatgcactgaagggaaactggaggagggagggagtgaggggtgatcataccagcggaggcacatttgctgagcccccctgcagtctgctctttccaagtggaccctcctggaagcctgatcccaacctcccctgcaagcaggtctgtcacccccatctctcagatgaagaaactgagccttgcaggggtggagtcccttgtccccacgtcataagggtagtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccagtaagtgaacagctggacttgggctgcctgggcggcagggagaagcgggcaggggaagggtcagcagaggagcgaggccccagaggagccctggggtggagcacagccaagggctctgttccctttcctggactcggcttccacaggccctgacctgcctcccccaccctccggtcctgcccctgtgcctggcagcagccccacctgtgtgacatcccagcacaccccccctctccttgcaaaggagaagggagcggcctaggggaggccaggggcccacctgggctggggctgtggagagggagtggctgggacgggaggaaaaagagagacggagattagatggaagaagagggatttcaaga

SEQ ID NO: 12820 - DNA, 16373 bp, Human
gttcattttagttcacacggctgagaaatcatgcttggtatggatgttgtggggctttctttactcttacttggtggaaaaaaatgttcctgcttttcacaaaaggagtcaagggaggcatcagcaacacccttcagtctaaggggaggtgactggtaagtttcaggtggcaaggtgctcatggtctgcactgtcttctaacacccaaccccattttcacataaatatcatactgcccttttcgatctaggtattgtgaatgggctcatataagtttccttaaagatatcttatatgaaagtacatattttttataaagcaaatgggcaatatttgtgtaacaacaatctcctgactcatttgattgttaaatctccatttcagaatgttgatttttacccctgtcccataaaatcttactagcagtagtttcttggaaagggggaaactgtaattgacttgacattgctcctgagctggtttctctactttgtgtgaagcaagttttctttcaataaaatacttgacacatcacatataataagtcttagacttctttcactctgaagtttgtatttttcaatggtaaaactagccttctatccttgtcctggtaagttttaaagtttttagctgtgtgaagtatttttgttcagctgggacagtggggttgctgggtttgccagtttctgccagttgggctttttgtttttttaattcattcgtgtttttaagtctattctaaaaggccacttacagatattttcccgactatctttctactactctttctttcactttccacggcatctctgtgtcccgggttctctgagcgctagcactgaatgttggctttctggctgcagtgtggagacgcagagccttcctgccctttcctccatgtgtagaaaacagtggtaaagaaaggctttgcaggaggagttgggaggaggacaggaaaaaatatttgaatcttgctctataagttttgcaagctcacaacagatgaacctaaggagttttgtttgctttggtttggtttggggtttttttaatattattgttcctttacctcaagtgttttttcatttcagtcacaagacttccttacacctaaaaaattgcttaaaatattgtctcatgaaattagggttgttgaggcaggaataatttcataaagttctattggaaggcaaatgtcaggactgatgtaggaagacacaccaacgaagttgagggtggtccaaagtctgttacaagttggaaggcttttgtaaggaagttcaggcagaaagaaaggggctcttcatattggagttgtcttttttcactggagggtacaatacagaggttacaatcattggacacagatgacaatatatagactaaaatatttcatgcacaaaacaatcagtaaaactttatgattcagaaacaaatccatatccttttcgatgtcaggaggttacatattaatcactacatcaaattagctcagaagctacattgaagccgaactacatcaatgtatgggtgtatgagcagatcgggttataggttacagaggtattcttcaatcagacgttatcttatgtgtaggaaaaggcaaggactattattccttatcttttaaggagtagagtgactcaggcaagagagatgggaggccgtgtgctcaatcttgttttgtctttgaagcatctttctggagaactgcaggtcatcacagcaggggctttgtgaaagtatgctagcaagccgaaatgagcaagcaaggcttcttacatttgctacattgtctcacagtataacacgttaggtaaagggttggatgtgatcagtaattgcagagaaatggagccaagcccatttcactgactgtgcaggggttgatgtggattctctgctaagactgcataaccaatggaagccatggagtgtgccgggtgtgtcacagcctcacttaggcacagcgtttccttgtctttgttccagggaggatggtggattttccaggctacaatctgtctggtgcagtcgcctccttcctattcatcctgctgacaatgaagcagtcaggtaggattcccttctccctttactgtatagtctaatgtcccagtgagctagtctgggtccaaaggtcgagaacaacatctaagagtgtaagtctggggccaagccacctgtatccaaaaaggaactcctcacttttgaggagctcctccactcccaggagctcctccactcctagctgagtcacctttggaaagttacttgagcacctcataccttagttctttcatctttttaatgagaataacagcagtaactacatctcagaggccagcacaggctttaggattaaatgagacattaaaagcacttgaatcagtggttgcaccacgttaaattattaattcactctagtactttggggtcaagaaatgcagctgcttcttatcataaattaagctgcaattaaaaaaaatacttggaaataagaaattagaagaaagggactttggaaatctcactagctgaattttgacgtcaaaatgttgcaccttgaaaaataattatttaaaaattcagtgtcaaaaaaaaaaaatcagtgtcagaaggagatgtcagagccctaaggaaaatgcagcatggcgaagtgggaaaaaacacgacacagagcatcagagggcgcaggctctgcctcggcaccgcagagctggtgtgtctgcctcggtgccgcagagctggtgtgtctgccttggcgctgcagagctggtgtgatgtgatgaagctgctggcttctctgtgcttgtgctgcagctccctaccctgtaacagtcaatctgatggaatgtcttcagttctagcttcatatttagacttcatcaatgaagaatacaagcagatctccacttaggctctttagccaccttttgagcagcatctatttgatacccagcagcagctaagtagggtgaggttcttcctagcaggattggatctgcacagagaaagagcaaatggccccggagcatttagaatgagaaagaacatatcatacatgacataaaatgatcaaacataataacatacataactgttaaacatctcttcaatttgcagataacaaggaagagatcagacatgtcttagaatttgtttggaagacccaaaaatctctagacaaaccagtgtccttaatccagcacaaaatgtccttgtgaaaactgcattgtacatagtcccagtaattggcctcctgccaactccagacgggaaaaaaacaaacaaaaaaaaaacaaaaaaaaaacagtttttatatctaagagaagaggaatcctgaaaggctaaaaaaagctaataaatggatttattatctaaacttcaggaaaataaaatgttaataacaagaataaggtttccaatttaaaaagtcaatttacatgagaataaatgactcaaggaataaataatttacttgagaataaaaacaacccaggtatgctggtattaatatcttgaagatgaagaaattaggacttcaaatctcaaaatcttaccaagagtaatagatttgccaccgaatcacatagctggtaggtgacagacagcaacctcacccacatttttgaactgcatttgttttcagtacacaaaattgactctgtaacaaacagatgtgcaaatcatcatgctggatttctctaaaacattaaacatatatctctccctcttctagttgcctccattttgacaggctggacaccccaaagcatgcatatgattttctgattggcatttcctcgttcctctttttcacttattttatagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtgaatatctggggaaagacacagggtctcaagaggcagagatatattaatttgtggtaagctttgtgacagttgaggaaatccttttgaatcatcaaggtaattcctaatgcttagtcctctaccctgattgatttaaaaataagtggttctggagtcttcaagcttagtgttaaaatattttcccaaatttaatttgcacagttttgactgttcttgaggattatttggaatccatgacatgcagtctttagcaattttgctgagacacacatttgtgctacctaaggctggtgcgcaagagcaaaccaattgctgcatgaatgagcccagctgacgtccggcatctgtatctcagggcattggtttttctctacccaatcccatctatgcagaaactgagacgtgaaaatgttctttccttgtgaaatgccctcagttagaaagctatcaacaagactgaaaaggctaagaatgtcgtgctttggagattgttatatactagtgttcaatgaattggggactcacagatgcttttggacacaccctctgtgaatgggaaggttcttcatattgctgttgtattagctaagcaggaaggagtagggaagaaggggacaactgaagaatggatctgtcttatgaaaagtaaactatcatatgattccctgacagggctaacttctccatgctctaaagagaaaatcaagtaaatccaattactaaggcaaatggggaaaatagttctctggagatgttaacgtctccagctgatactgcttccttctttacttccctggaaggctgtttcctaatacctttttttttcttaacatccattactgttactgtgttcaaggtgattcaaaatggatggaggaatacatatatttctgacatggggggacagggaacgtactgatgtatttcaatatcaggaacatttacaaataagtcacacattttctaagggtccaagggaagggagtggatctctcttttaccagcaagtgattaagacagaattcccatttatggaaaatatagtccccttagtttgggtgtgggagtttcacgttaaatagagaaaaaaaatccatgatttcataaactgttgtaaactaggatttctcaaaaccatcttacccattgaatagaatatttagctacaaataacgcctcgtggagattcgcatttcacatgctcccgtttatccacttgcttccgaagatcacagccaccagcaaaagatgcaggaagaacaggcccctggggagtgatttctgactttgtgttaaatcttcaatcaaattggagttcaagacatcatctaaaataccagacaatgtgcccaatacagataattttaagatgaaaaaggcagagttcatggcacagaggaattaatgaataaattacagctcatctctgtttgcagtgctagaggcgttgcaaaatgtcatgatgtcccccttctccgattcccctttctggatctggagaaaagtactggtcagatgctaaaatgtaaagacccagactggggaacaaataaagtgtatctgaactcacatttgaatggggagactgaggtcgactttctgctcctcagactcctgaactccggccacctccctgtgagcaacgtcactgggatctcagcctctgtgatttctgcctctgtgggctctgggtgtcagagctgtggcttccctctgcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccaggtcagtgctctgcctctaggacccacatgctcagatcagcaggagaggtcccagggactgcaccatagcacctcgtatttttatcaagagacattatctatcatatagcaatatgtattgaaagccataaaacatttatgactggaaatatacgcactacattttacttgaatagctgttatggcgcctgcgttatttttgagttctacctttccttcttctgcattgattgtttttactcacaagtattcattgcattgtaaagaaaataaagctatatttcttcaactgaaatgttttcctatgctgtcttgtgctgattacttctagaaatctatcatatgaagataatcagagatgtagacaactatttgcataatagaatattaattatggccttatttataaatagcagcaaaaacaaccaaccccccaatacaacagtacagtgtggaatcttgtcttactatacattatagcattaataaaaagatatttttaaataattttaatggttgaaaaaaatcctcatgatgcactattcaatgataaacatgacatctacctataaattgacatttccaatcacataaaagttactggccttaaataacttataactgcactaaaactttcaggataccctccacatttggatataagtatacagttattcatataaatggatagattaaaaaaactttaaagttaatgttacattttaattttaaatgaagctgattgtatattacatataattcgtctctctactttgtaatttaggtgatactgtttatgtccatataattttgtactttctgtgtatctataaaaggaacatatgttattttcatgctgatagctaagtatttatgctgtaaatatcagaagaaaccaacagaatcatggggagatagaagtgacagcatttttgttgtgcagagaaaaggaaaaaaagctgtatcattgggtaatctgtgggaaagaatcagtatttttctgcatttcatttttttaatgaattgagcttccctatataatgtataaattgctttcttttttaaaaaatagtttctctcctttcccttacaccaaattccttaatatgttattcttgttctttttccagagaaactccagactgagctgggtaagtacgaggtgctggcacacacctgtggagggagcctctgccctccccagcagagggaggggagctaccacgagaccatgtgacccagaggaaaaactgaggcacgattttaccaggtcctatgttcattaaataccagaggagaccagcaaagtaatggcctcattcaaggaggttgcagctgtgttacctgacactttgggggctcatggagattccagtgagcatcagatggacacctataggaagcatggcatcatctctgttctatgtgttgaggggaaagggagctgcctcagaatgtgtgggggatgacagcagacagctggccggggcctggaggccctttgaaaacatttcaagtgtgaacaagggcagcatcattatgacaacctgggttgcacccagcacctccctgctcaactctgctatggggtcctgcacctgctcctcaccccagtacacccctaagctaatcactattgggagggagctgttactttctgagtgcaacctgggatactgtgagtgtagcaattttttttttttttttttttgagacggagtcttgctctgtcgcccaggctggagtgcagtggcgcgatcttggctcactgcaagctccgcctcccaggttcaggccattctcctgcctcagcctcccaagtagctgggactacaggcaaccgccaccacgcccggctaattttttgtatttttagtagagacgagatttcaccgtgttagccaggatggtctcgatctcctgatctcgtgatccccccacctcagcctcccaaagtgctgggattacaggcgtgagccaccacgccgggcattttttttttttttttgagacggagtctcgctctgttgcccaagctggagtgcaatggcgccatcttggctcactgcaacctccatctcctggattcaagctattctcctgcctcagcctcctgagtaactgggactacaggcatgcgccaccacacccagctaattttttttttttttttttagtagagacggggtttcaccatgttggccaggatggtctcgatctcctgacctcatgatccgccggccttggcctcccaaaggtgctgggattacaggcatgagccactgcacccagcctaatttttgttttttaaatctcggagttggactgagggtattattttgctgcacctgagataagtggtttaaaacataaccagccgatggctgagcccctttgagtttcccctttacctccttactagctccctcctttttatggcctcttctcccagcccaaggcaaccagcctgcctccctgcctaggtgcatagaacgtggatcccttatgtgctctttccatcaattccttgctctccatcaagtcacctgctccaggaatgtgtatccatgtgtgtgctttaggtgagcttaagcacacctttcagcccacaaaagagtttttgaggaaaatcagggtaacaaacacaacccaatctctaccagagtctactatggcaccttcaaccccattaggccataaacataaagggaagggtccctggaaggcgcaaagtaactccacaatctgaggagagacacacacctgtgtatcttacccttctgagatcaggaagtaaagccagtgtttggggcaggttgacacaagtctgtctctcaagaaggttttaggagaagagtcactcctctgagttctctgagacccactggagacccagcacacacaatacgaccccatgtcctgttgttcctaagtcatggtaacctccggggccacaattaaccaacacggaaagatggagcttccctttgcttcctgtcaggtgggagaggagggctctgggcacggaagctttgcaggtgagctctaatgatgggacacccagctctctatggaagtcctaagactgaaatcactgcttgtagtcttacaaataatgtttttcatttataaaaataatagtttttaaaaatattaattgtatgccaggcacgatgctgaatatgttatgggaattatttcattttttcttacaataattataaagtttaattgctttatcctcatattacagctaagaaacaatcttagagacatacatggtttgccaaaaatcaggaagaaatggtgatgtttaccttctaatctacatctatctaacttaacagtgcaagtccttaattacttatgtgtgactttgtcagctcattcatctctatttttctcatctttaaagtgaacaggttgaatttaatctctaatgtagtgtccagttctaagagattagatataacttagcatatttgagaaatgagatagtgcattaattgaatatgctgattgaaagaggattatgtggtatgatgatgagattatcaggtttcaaggaatcagtgtataattcagtgtacttcacgctccagaagggaattaatttttcagtggatattcagaaggcattcagaacatacaaacaataaccaaaacaaaacaaagcaatatatttcagcacaaaattgtctggaaggctgtgtacaaaaccgtatagaaaaaggaggttaactactgcatgttcacacttataagggggagctgattggtgagaacacatggatgcatggcagggaacaacacacactggacacctgttgggggatgggggagggagagcatcaggaagaacagctaatggatgctgggcttaacacctgggtgatgggatgacctgtgcagtaagccaccatggcacatgtttacctatgtaacaaacctgcacatcctgcacatgtaccccggaacttaaaattgaaagaaaaaaaaagtgggttaggcatagtggctcccaaggagcttgtattctagtagaacatcaattattaacaaacagggctgcatgatttttttagcactttaaactttagttttacttggattctggacaaaaggagttttgtctgtatctgtaatgcatcaaattaattgaatctccatacttacattttgcttccttcagtctccattgaagtcaattttagctcttaattacctatgtcaggcagggcaagccagtttaagatctaatatgtgcacaggtcacacacggacagggaataaaatcctcatatggataaaggagatgaggaaacagtctgttttattaagtaatttaccgtaagccatgtggatgcagaaacagccccaaactaatccctagtccattttttctgattcttgtcttcagactttaatagatacataggagaggaaaataatattgttttaggtaaaattacaggacaaagcaaacaaaatgctggaaataactgggagtcaactgttacctggaatggaaggtaataatctgaaaattcaaattgtgttgacagggactttcctctctacaaaggtagctggcagttttcggccaatgacataatgggatgttaacgcctttggccagtgactctatgcagagaaccaacaattttatgcttgtgtttctattataaatgatcacaccttatgcaaaaccattcttatcatttaacagaaaaggacgacacttaatttagaatagagaaaaaatggcacgggcagggcctgatgagaatggaaaatgtaatatagcttgggcccaggaaagccctcagagaacatctttccccactttgcacagtgggagaattagaccccttttttacattcatcattgtttcacaatttgtactttgccgacttccccaattattgatcttaaaatgttaattttaattttcaaaattatttgaggacattcaactggtgtgtgtctataactccacctatgtggagcattggggaaataaaatatagcggctggaccagacttacaaggtactataaagtccacctagaggaaagcttcttcaaatatcattaccaaaagtccacatgagacacgtttttaaacccctccctattaccacgtcagagggtggggatggctccaacgccttcaagtctcacaggtctgtgcacctctgctcacgctgcagggtcttccaggcacttaatgcaaactattttgttcaactctgaaacattatgattttggtagttgtatagcaaatttacagtttaagaaactgaggcattaagaagtagtttaagacagattaagaagtagtttaaaatcatacagaattgaagtgttagaagaaaaactttagacagactaaatttagcagagtctaactgagaaaaggatgactcataaacaagccatccctcagaatcagaacggtttcagagaattcaaagcagcaatttggtcagacagcatttatggacagaaaatggaaatgaggtacagaaaacagaagtgaggtacagagacagctctattggttgcagcctggcgtttgccgatttgaacagggtttcaacagttggctgcctgcaactaacagaagtgcagcagctgctactcagctatttattacaaaagtgtactcctaagttagccttagctcctaagttaggcttattcataaaataattttgcaattaaaactctcagaataaaatgagcaatttataaatttggccccaggatgcctctgtacctgagtgcttatgtaacaaactgcaacctaagttaggctttcagtagttgacgtactaagttaaattgcagtttgttacataaggagtcaggtacagaggcatctggggccaaatttataaactgttcactttattctgggtgttttttgtttgtttgtttttaaagtctcgctttgtcacccagcctggagtgcagtggcatgatctcagctcactgcaacctctgcctcccgggttcgagcaattcttccacctcagcctcctgagtagctgggattacaggcacccaccatcatgcccgactaatttttgtatttctgtagagacggggtttcaccatgttggccaggctggtcttgaactcctgacctctggtgatccacccgcttcggcctcccaaagtgctgggattatagacttgagccaccacacccagcctatctgggagttttaattgcaaaattattttattattggtctgtaaactgaaaaaaatacaggtagaagcaggtagggattcaattactgttttactcagactgacacacatcatggaatgattcctccttaaagaagagcaacctctattctgagtccatgaaacccccacctcacctaaggatgaccctgagcctcacagcaaccctgggatgctcatggtttctaaactccaatggagctgttcttagagatgacattattggttccattttgattctttcattgtgttttgtccactctatttaacagcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaggtaagaattctagatagatattttgtattcaatacctgctcctgccactttaatatgctagttcctggacaatttctctgacatttgaaattttcttaatgcttattcatcatcaaatttatatcaaatcctccagtgtgtgaaactgtcatagttacttaaaatccacaaactcaaatggatgaaatttaattatttgggcatataacttgtatcttttccagtatcttcaaaaattgaccatatctttaaggaaatctgagtatcttactacatattttacaaaaggctcattgtttcacagtgtgttattagaattctgagaaatgcaataaaattctagaaactgtaatcatctgaagactaaactggatccactgtgtaaaccaaaattataaatattgacagttttggcagggacaggggagaaaagatgaaatcactccctgcagcatcatttcccactgtccgtgtgtgtgagaattgaaacgtccaaggttagcagatgccattgagtacatataggcccaagtcttggatatgctacgtgtttctcccacggattttgattctaaattaataaacacgtttagccatgggagcgcatgttgagaagtttcatgagcctcgtattttctgccattggacgtagatatttataaggtttcgatttttgagaatatcctcctactccgtatgttaatcctgtccatgtgacccatgccctggccgaagttattttgttctcagggacagaataaatgttggatttgaacatttaccttacctcttaatcatcccagaatgatttaggaatacaaagaataaaaataagcaaacaaacaaaataagaaaatgctccagccagcctcatccctaagtggagtgcaatcccccttaagcttttctcccttccccaagccctccacatccccttctttcctcccagtgaaattgctgcccactcatccacttgaaaggaccccaggctttggttgctttctctgccccaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtgattccttatgttccttcaggtttggaaaataaatatgaagaccaactcagacttactcattgtattgctcttcttcctttgtgatttttatttgctgctctctgacgaggtctcctgctatcctctgcaaagctggttttcaggacacccagggattctactcctctgagtttctctctgacaccctcaactagcgccctgcaattatttttatcattggatacacactaaattctcgtaattgaccctgttttcactctctctctttaaattctcttcttctgatgtgaaaacaattaaattacagaactttgtgttttccccctcatggaggattttcttctggattagaaactgatttttattaataccatcttcatggttgcggcttgagtaattttatcctttcctcctcaagtcattccagtgattgtgtgatatagttggaagagagaagggaaaacttgtctgtgcatgtgtacatttctgagacgagcaaacatgaaatacttgcattctctcctctgcatctccagagcagggaggagcaggccaactgcttcctgggaggccaaattctctcccttctctccagcctagaagctgctcagatgaaaagtacaatcttaatattgtcccagtttcacagtttcaagggattcttgggtttccattttagagtccaggatgacgtttttgtggaaaacactgcttgtttggggattgcttcttgctgtggctgtaggcctgcccaggaagaggagctgaaaagaggtaagtcagggaaacagaaacagcggagcacactgcagtgggaaccgtactgcgtacttccccgagcctcccttttcacaagtcacctatgggaggcagtcagtgaatatccagtaactaaggaaacatgagaaacaggaaagcccagggcttatcatgcaatccaggctcagtgatgcatgaggtcagtgtttccacttgtaatagaagcaaaatgattaaaagataatgatttgatttcctgctgcccattccccagtgatctggttagggaagaagaagaaaaaagtgagtagtacagccatccttgttttcaaggctgagagctgaggttcactgagatttgttggcgtgaacaatttcctatgatctttaaaaatgtggtgacctacttgttggtgatttctgtgttgctggtgacttctcatgtgttagggaggctgttttgtgtgctctagaaagtgcttccactttaaatttcttatgtccgtgaaacacttgtcttcctgtttggctgttaatagaatgaaattatattgattaattatcagaatggattctctttctttacagtgaatgtgacattggcttcaaacacagctcacctgagactgatttcttctgaacagaacaagcgtgtgatccatggacattcaggcagccagatatcccacagagatctgactatctgctctatgggccagagggaactcctgtcagggagctggtactgagaggtggagactgggaacagggcgcgatgggtcccggaggttgccaagcacatgttgcaaagaaagagtcatctctgtgtcacctgacagtgagttttaggcaatggattgcaaaagaaatgagttctgggccatcccctctcttccaagccccatccccttgaaggtggcccctgaacaagtcagaatccccctgaccgtgcctctgaatacctctcctcttataacatgattggcaagtgccctatctacaccttccccaaaacttccttctctgggactctgcaccccgcttcattctttggttccctaatgtaggttctctggacattttttctgtacccacaagaacatctccaacgtatcaggaaaataacaatctgggattctggaaaccagaatgatattctgagtcctgatcatttctcatttctctaactgcttgaagggggctgccatgatcattgaagtactaactcaaggtgttttaatt

SEQ ID NO: 12821 - DNA, 87774 bp, Human
  misc_feature (1)...(87774): n = A,T,C or G
ttttcctattttttttttttccttgggacagagtctcactctgtagcccagtgcagtggcatgatcttggctcactgcaacctctgcctcccaggttcaagtgattctcctgcctcagcttcctgagaagctgggattaccggcacctgccaccatgcccggctacttttgtatttttagtaaagatggcatgttggccaggctggtcttgaactcataacctcaagtgatctgccttcctcagcctcccaaagtgctgggattacaggcatgagccaccattcctggcctgggtttgcatttcataatcactttgcattagctttgtgagtttgagtaagttatttaacctttctgtgccttagcttcctcatctttacaatgaatgtcaacaatatctgcctcacgttgttgatagaggtagagatgctgtaggtgatgtgcccaggtatactcggcagtgacagggaccaataacatagtaacttctgtcttaactattattagcacagaggaagccatttataaagttaataattttttggttcctaatgaattattattgctaaaatttgctttaccctcccccctcaacctcctttttttttcttgcagggtgaactgccccatgatcaagatgtggtagagtatatcatgaatcagccaaatgttgttccacgaatcaattctaggattttgacagctgaacgagactacctggatttaacagcgagtagtaaggagcatttcaggaacaaccttatgctttttttgacttgtgcttcagaatctttacatttttcagattttaatattctgattatcttctgcagtgttcagaagatagcccaagattgtgacaaaattttatgtgtaaactctttgcacctttagttcataatatgagattctaaattcacaagagtttcctcctaaagaagaaaacatcttctgggcaaaaccctgtgaactttgaaaaatatttagtgccatttaaatgccaactaaacagacaatagatgatgagaatggacctggattgttcgcttctctagtcataaagcagttctctttcttcatcctcattctagagtcagtcagccataatgtcaacaaatatctcagtgaattttactctgagaacttaggaaggcctttagcagcttcatcaagatatgatgtatatgccataaaactcaaccttttaaagtatacaattcaatggtttttttaatgaaaaaaaccccacaaagtttgtgcagtcatcaccactgtctaatgatacatcattatcatcaccccccaaaaattccccagaattccatgtacctattagtggtcactctctgttcctcccttcccctatcctctggcaacaactaatctactttctgtgtctatggatttgcctattctagacatttcatataattggaagccttttgtgcctggcttgtttaatttagcatattgttaaggcttatgcatgttgttgtgtatgtcagcatttcattcctttttatagtccactttatggatagtccacatatatctgttcctcagttggtggacagttggcagttttctgctagaataccttataagagccaaatatgttaagcccaggtgcaatttgttccttgtgccttcctcgagattctgaggcctcttcagcaaacacctggaaataagatggaactgtcatcactagcccatgaaatctcactggggaaggaaagatgtgtgtaatgaagtcataaccagctatttattgttatagttgagtataatgaacatatcaatctatttatggttgttaacgtaatgcactatctctaatagacttgaaactgaaagtttgttttaggtagaggaaaaatacatgtatatatacacacacacacacacacacacactcctatacataagcacacacacactgaggaaaaagtgtaaatataggcttatatttgagaaagaaactacccagaaagtgagctttttcttcacagccgggttttcctttcttccctgaagtttcagtagagcaaggtgagcgtgttgtggctcttcatcctaagtgtttattgttttcatcatttttatttaaatttgaagggttgtctctggaatacacatgaataaggaacataatagcggttttgtttttgaatttccttttccattgagtgttgcagcaatgagctatgaaacagtgctagtccacagtggcaaagtgccacctgtcagctgaacatagtgcagacatcaattaggaggctctggcatcctcttgacctggtggtggtggcattgtcactcaggtttctttggctttggctgtcctggaacctttttagtaggatactaatttttaccagcatggtaaaatttttaattttatactaatttttatcggcatggtgtgctctcccttcccccacgtgatatcatggaccgtgtgtgacttattttctacggttttcctggatagtattctatggatagtaggtgttcagtgtgcattgtcaagtgacagtgtagatggatgagcatgtgcacagatgaataaatgagtgggtaggcaggcaagctgtgtctgacagactgtgatgagaagactgacatttgtatagggtgcaataatgtttaagattggggagattgttagagacagagagtttacagtactaggctgtaagaaattactgggtagtttagagcaagagaatgacttgatgaaactggaattctaggaataataatttgagggaaaatgagtaatgaggattgccctttgacactaattggagaagggacatatgcaaaaagagtgaaaatgaccttttatttctgttaagggtttaaaaggtgatattttgttagacctgaaaaataaaaatcagttttcttacgtattttctcttttacccctgcttcctctgtaggaacaggaagagcttactccactggttggactagggaagggagaaatgagttaaggggatctctttgagattgtcctccagttgacaagtgacaggaatgggaataggatgaattcagccattaaactgacacatacttatatgatagctgtgtgagatatgtatgtttccatcaaccttgtgtctttgatgtgtgacttcagtagggataggggccatgttgtgaagttgttcagtaaacatggaacttaatatacttcactcacgcatttctataaatcttatattatgatcaagtcaggttatcagttgaatattaagaatagattgaactggaactaatatatacgtatttcattttttctcccagataacttctttgtggatgattatgctagatttactatcttggattcccaaggcaagactgctgctgtagccaatagtatgaactatctgacaaagaaaggtaatccatttgaggcttattatcttgcattcaacatttttttgaaagtatttgcatattcatcttaatgtgcaaattaagagagaaaagggaaagagacttcataatttttcttatttcttataaagctttgagtctagaacatatctatttaaagtttaattctttgtatatttgttgaaagtatatatttgtttaaaaattcagatgtcttcataaattttgtattacctgttttaccttttgactaaagtcaaaaggaaaaatatttcatagttcaaatggaaaaacatttgtgatgtaaaaatgggttaatgaattaaaaatgactgtacagggttaatattattttggggtttataagataaagttggttttagaaagccttgtataatctttgaagctgattttatgcagaggtatttatttaggctaagattgtgtaaaatgacgccctgtagtggcggacagattctgtcgccctcgggtcagtgcttcagaaaagcactggctgttattttaagtcagctatttttaccgcctttttaaatccccgctgtggtctctccccaagagaagttctggtttctcagctgtatgtaaagtacaagcaattactccatttggttctttaaagaaactgtttcttagggtactgggacagcgccatgacaccgacaggactaagcagcaggaagaaccatagaccgtgttagccattgtttagactttcaatttttacagtaggcattcattccagaaatgatactttttttctactcttttctctttacctttgttcaggaatgtcctccaaggaaatctatggtaacttaaaacttcagaatgttctatttcttaattttcttctttggtttcagtgaccattgtaatttagaatttatcaacacttaattgtactgtttccggaatctgtgggtaacaggaagctatatcaatgtagataattttttttttttttttttttgagacagagtctcattctgtcacccaggctggagtgcagtaccatgatctcggctcactgcaagctccgccttctgggttcaagtgatttcaagtgattctcctgcctcagccttccaagtagctgggattacaggcacccgccaccacgtccagctaacttttttgtatttttagtagggatggggttttaccattttggccaggctggttttgaactcctgacctcaagtgatccaccctcctgaacctcccaaagtgctaggattacaggcgtgagccactgcacccggccaatgtagataaattttgtataaacatttgtaaagaattagtttcagaaaattacaaattagtatgattaaaaatgacaatatgttacccacatgttcaaaggctgtttttcattttacatgctaacagatgcccagaccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcaggcaagtatctatgacttcattttatatttttgtttgtggctgtagttgtcttcatgggcttcgctgtgcggctaggattgttcagtgggagttgggagtcctgctttcttaatgctcgagggaacggagaattgtatctctagagatctgccagctctcaagaaaagagatctaagactacagtatccaggctttgttgaacgggatagattcttatagagaaaaaaataaatagcgagatcctcatcatagacaagttttattgcatacctgttcatgttcttggagcagagttgctccaacaattgtgttgtgtactgtatcggggagatggggtccttaccacgacagaggtctggacatgggggcagtagcacacaggaatggtagtgtgtgtgtttagtagaagtagatccagatgcactgagggatacacacataggtgttctgaaaagatatgctgccattaatagttgggcttgagtgagtggcaatggcaggtggttgggaagcagctgattcttctggagagtgtcatcgttagaggatgagatgtcaaaattctttttcctgggctgtttcagtttgcatcttcatccatacctcacaaccctcctcatggtcccctttccaccctgtacctgggaaggtttactgaaataaagaaatatccaggtggtttcagttttactcatatgccgagttcctttattgttcaaggagtggaccaaatgctgtggtcaatttgaagttagaacagggcagttctagctaagggcgatagttatatgtgaaaggcactctaacacaaatgcgtaaatcttcaaatggtagtagggtaggagaatggggaaggagagttgcattttttaataactattttaattgaagtaaaatgtaggttcacaagaagtgctcaaatcataggacacacagtgtcacaaagagaacacactcttgtgaccaccactcaggtcaaaaaatagagaattctcaagttcctgaaagccctcccacacttgtgcccacccacacttgtgcccagacactacgcctcttccctcttctcatattagggaataggtttgcctatcttttagtttattaaaatggaatgttatgcaatttcatttgtgtttggtttctttacccaatcttttgtaagatttattcatgatgttacaagtaggggtatagagtcctttttcattctgtagtattatatcatatggctgtaccacaaagttttatttgtttaagctatttgaaggacagttgggtttttagcttggtgctattataagactgctgcaatgaatattctcgtatgtcttttggtacacccaaatataaatgtctgttgcttatgttattggtacaagcccttttttggctttgtgtgtcctgggtgtattcttccacttggattcttgtcttttcacccagggagagattgaattgtactaggaatgtgggaaggctgtatgaatgaagaagggtttgaggagagcactgaaaacacttctaaaacaagtgcgttagaagaatacaaaatgtgtggcataagaatataaactgtgttgggtaaagataggactctgagggtctgtaatttatgctatatttaccgggaaggtaagaaatgaagttggaaaggtgggctgggggccacttcatgtagggttttgaatgcttgatgatggcatttttaattttattttgaatgaggaggagaactatctgagactttttttttttttttttttttaatgagacggagtcttactctgtcatccaggctggagtgcagtggtgtgatcttggctcagtgcaacctccacctcccgagttcaagcgattctcctgccacagccttgcgagtagctggaattacaggcgcccaccaccatgcctggctaatcttttgtatttttagtagagacagagtttcactctgttggccaggctggtctcgaactcctgatctcgtggtccgcccgctttggctttccaaagtgctgggattacaggcatgagccactgcgcccggcctgagacttttaagagagatattatttgctacttattgaacatgactgatgttaatgctgctttttaagttcaaaaatatctacaatatgactcccgtttcccattttgtgaacagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttggggtaaggctctgagcctctcatgaggctgccccattttgtctgccacggaagctcacccactgcagcttacgtgtccggttcatgatcacgatttgtcattttagtcctgagtctcagggaatttttttttttaatttggaagtttccctttattacttttaaccttgcctagctttcatgtggtgcatgatttgagtttttgtgtgttttaagtatggagccatttgttatgcacagtttttaagagagacaatatggcttatttatagagcaaaaaacggagatttgaaccacttataggttcaaggcttatatgttcttgatgtgtttccagaataagcctgtgtttattcatttatattttatgttacttatttttttgacacagttttgtagtttttaaattttttacagaatgatgagtatatactatttgacgtttgagttaggaaaacaggctgtcactggaaattagcaggatttaaaaatgcagagtaaaggaatgatgaatagtctgctagtcgaacaaatcacaggaaaagataaggaaatagcagttactctaagtagtagggagatggcggggagactggagaattgacacatcttaatgttaattatgaaaattagttattactttccagggaaagaaatttttatggtttattcactgtgtttatttgtttatatggtttgcttagtaacgactatttttccttaataatgattactttcctagggaatggatttcagtctttttaaagaggtctttgagtcttccaaaatggatttcattttgtctcatgccgtgtactgcagggatgttctgaagctgaagaagggacagagggcagtgatcagcaatggaagggtgaggatttgtcaagcttgacttcacattagatccgtgaacagtctttgcagcattctcctctgaagctagtaaactcttcagacagagccactcttttttcaaaggtgattggggcttatgaagtgccattgatgtttctgcctcctatttccaaggagctgtgctttttgacatagacaaatatccccatatggagccttcctgctgtcggtgagagtgtggtggctctcagaaagtcagtcagtatggactttgacacataaagtagcctttgttgtttttattcaggtagaattaatgaaaactactttacgattttattttactttgtccttgaggaattgataagtaaataactacaagtatttgctttgggcttcactttgtattatttcactgattttatctaaacatgtacctgtctcaggtctttaagatgttctggcgtatgaggtagcctgaggacgccagagggttccttaccagcttgctgagtgcaggcagccttccagagctaagcgcctgctcttctctccttcacagatcattgggccactggaggatagtgagctctttaatcaagacgatttccacctcctcgaaaatatcatcttaaaaacctcaggacagaaaataaaatctcatattcaacagcttcgggtagaagaagatgtgtaagttttgccataggaggaattacaggggttatataattggactttcctcattgatcagttagaattatatgttgttactcatactacatatcccaaggagttttatttccagtttaaaatctaataatactcttcaattccagttttaatgtatgcttctgttgaaacaagataatttattttgtagggtactatttaaggaactgaactagttctctctttttatttttataatttttggttgtggaaaatttcaaatatatgcagaagtaaagaggctagtttatttattacctggaatacttatgtaaagtgatacttttcatcattatctatttggttacccttcagttttattttgttcaggaaaggaaaggcagtttaaatgtttcttttatttaccagtgcagaatactgagttgtttcccttgtatcttcaaaggtgatgatgaattggttgttgtcggtttttaattttaattttcagtgttattataagctgatgtgttttagtgtgttattttcttaatggaagaaaataaattgtttggatggaccctggagtccattgttacatatatgtagtttctgcattaaatatcaaatgactatgtagttggaggatctatttctatgtttaattgtttgaggaaccacaatacctttcccacagtggctgtaccattttacattcccactggcaatgctcaagggtgccggtttctccacatcctcacaacacttgtaattttctggggggttttttgtttgtttgtttgctttttataatagccatcctcgtgggtatgaagtgctgtctccttgtggtttgattcacatttccctaatgattggtgatgttgagcatcttgtcatgtgcagattggccatttatatatctttgggaaaatgtctattcaagtcttttgcccatttttaattgcgttttttttttttgtcgttgagatgtagcagttctttatacattttggatgtcactttcttactagatacatgatttgtaaacattttctcctattctgtggagatgtgttctttgatgcatagttggaggatataaaattttaaagttctgcttgcgaggttgcaatgagctgagattgcgccactgcactccagcttgggtgacaaagtgagactgtgtctccaaaaaaaaaaagttctgctgggtttttttcttacatcatcatgctgcagagttcaagagcatgttttagagaagtgttgacttggatagctgtcaaagtcagctgttgccatgtcttgtatgacctgggaagaaatcttttctcattttggccaatactggggctacaaataaggaggatccatccctcttacctcagtggctcctgagtgatgccccttgtcccgacctgtgaaatgcttccctgatgtaggtcaggaggtactcgtgactcgaagcagccatgtcacaggcataggcttggtgtggcatgctgttggaccactgcagggagctccttggggtcttcttgggctatataactgccagactgtgcctagaagacttgccttttgccaatgagagatggctctcgatctttcctgggtgaatttagggaaatcaggtagtcatggggccaaaagactaatgctaaaactcttaggcttcccaaaattaccttgtctgcatcaggttttcattagcgccagagctgctccaccttggagtggcccccttccccgtgacagccacagctatcattcatgacccagtctgcatccccaaggctgccctgaagcttggctgtgtatactttgatcattgttcttcatcagccttcagggagtttcttgttggcctgctcactccagtccacgtaaccaagtgccccttgacatgttttgtagccgtgttgacacatcacaggaagagaatggcctgtattatatatatttggcatttatattgagaagttgaaccaaaatagttaattttatatatttgctgggttcataggaaatgtatgtaggcttaattacagttcaaatacattcacagtgctcttttaaaattcttattcaggatttagtctttggttcagcaaattggagtgttttttttttttttttttcaggtttagttcaagatctttttcagttagaaatcaattttaggctgggcgtggtggctcacacctgtaatcccagcacttgggaaggccgaggcgggcggatcatgaggtcaggagatcgagaccatcttggctaacacggtgaaaccccgtctctactaaaaatacaaaaaattagccgggcatggtggcgggcgcctgtgatcccagctactcaggaggctgaggcaggagaatggcgtgaacccgggaggcagagcttgcagtgagcgagatcgcgccactgcactccagcctgggcgatagagtgagactccgtctcaaaaaaaaaaaaattaattttagaagaggcagggacaataaaattctttttaaagtggtttacttcagtgttaattgtaatagtgaaattagaaacaacacagatgttcagtagttggcttaatatttagattattttgtatccataaatgtaacattatgcagtcataaatatattgaaataggctgggcacggtggctcacacctgtaatcccagcactttgggaggttgagatgggcagattgtgtgagcccaggagttcaagaccagcctggcctgtactaaaaccctgtctgtactaaaaatacataaaaattagctgggcctggtgctgcatgcctgtagtcccagccagtcgggaggctgaggtgggagaatcacctgagcctggaaggtcgaggatgctgagatcaagccctgggcaactagagtgagaccctgactcaaacaaacaaacaaacaaacaaaaatattgaaatatcactgtatttattaaccaaggaaaggatttttataatatgtttttaagtgaaaaagcaggctgccagtataatttgtttatatgtatttaaaagtatagaattatgagccaaaatatcagaccttgttacttgatattatgtgtaatttcaatttttggcttttatgtttattttccagtgaattattactctaatagtcataaaaagtaatagttttaaaaggacaagggagaatgtaaataatactgacagcctgtaatgggccagggcctcagctaggtgcattgcagagttgtgcagttttactagagtcatgcagcgtgggtgctgtctccatttcacatgtgggaaagtgagtaacttctccaaggttataccactaatcactctttctcatgcctatcagtacggactttataccttgttcaaaccatcttgttagaattcagtatttgggctgatgatatgtttggcaataattggaaaactttcagttaaaaagatgttaagatttctctaaccccttctttcagggcaagcgacttggtaatgaaggtggatgctcttctgtcagcgcaaccaaaaggagatccaagaatcgagtaccagttttttgaagacagacacaggtatagaattaatgttgaatttgtgcatattcttgaatattaaactcttatgtttgctttacctcagctccttcatttttccatataagatttatatataagttcttacaggaattgaacatttgtttggtgtgcagttttcacatgtatatatttgtgttcatatataaaattcatatgcaaatctcagttgtatgaaaactgacatttatttctaaatgaatctgaaataactctgagtgcacccttgtagtagaaaatagactgcatttaattaaacagagaagttgtacttttcttaaattcgagaataaacacaggcaggtcaagatagctcatgcttgtaattccagcactttgggaggccagtgtgggaggatcgcttgagcccagaagctcgagaccagcaaacaaagggagaccctgtctctacaaaaaaattttaaaacattagctgggtgtggtggcatgtgcatgttgtcccagctactctggaggtagaggctgcagtgagccatgatctcatcactgcacttccagcctgagcaacagactgagaccctgtctcacaaaaaaattaaacagagattggctgggcgtggtggctcatgcctgtaatcccagcactttgcgaggctgaggccagcggatcacctgaggtcaggagtttgagaccagcctggccaacatggtgaaaccccatctctacaaaaatacaaaaattagccagtcatggtggcagatgcctgtaataccagctactcaggagcctgagacaggagaatcgcttgaacccaggaggtagaggttgcagtgagcagagatcgtgccattgcactccagccttggagacagagcaagactccatctcaaaatcataataatagtaagataaacagattattaaagtacttgtctcattcatcttttattgaaaactttttttaaaaaaaaaaaacagggtttcattctgtcatctgggctagaatgcagtagcgtgatctcagctcactgcaccttccgccttctgggctcaagtgatcttcctacctcaacctcctgtgtggaagagaccacaggcgcttgccaccatgcctggctagtttttgtattttttatagagatggggtctcactgtgttgcccaggctggtctcaaactcctaggctcaagttattcatctgcctcagcctcccaaggtgcttggccgaaaacttttgttttaaataagcttagcatagtgagggagtttgcctttttgttcttcacttttttgttttgaaaagtttaaaacctagaaatagttgaaagactaatataatgagcacccaaatatccttcacttagattcaccagttgttggtgtgtcacatttgctttatctctgtcatctgcacacgtgcatgttgtgtgcgtgtgtctgcatgtgtgtgtttgtgtagtacttctagtaactgctttagtagtttatttatatgtttgcatacacacggtcatattttttcctgcaccatttggaaatacgttgcagacatcctgatgtaacatgtctgacgttttccgcatgtgtatcctgagtgctaggacttctccgcagtactgttagctgacctcagaaatgtaaccttgatacagtaatattaaaacacaatttctgttcacatgactccagtatctttgtaatgaccttctacaactgttttttgtatttgttttggtccagattacatattacagagttgtgtctctttggtctcctttaatctggaagagttctttgccattttttttcctagtcttttgtcttttatgatgacattttttaagagtccaggacagttgtcttatggaatgtctcacagtctgagttgcttcctcatgattagatttaattgtttctaggaaagagccctgcgcagtaatgtatatagcctttgctgtagctggcaagtatatacatatacactgattgtgcctcggaatccccagggaggctttaaatatagatgcctgtgtcctattcctctgtgtttctgagctgatcagtctggcatggattggactttggtttagtgggcctgtgttttttatgacccatccttgtggggatcaggtgtgcgtggtgagatcatttgatgattgtaggctggaatggaggccctctctgtttgcactggttgtgtgtcctaattttttatgtcagcagtgggtgaagattcttatggctcctggataatccttgttgaatttggccattagcacccagattgcacccattttctcaacattttgtgaactttcaggaagtaactcattagtcaccagcgggaggaaacctttcctaatcaacctgccatcttgtttacccttcttgcccaaggtagcgagtcctgagcaaagacctcttcccttttcagaaatcttcttctccatgggtctccatgttttgtataattaaaataccttaattataaattctattatgagacaaattataattcctattagagaagttcctcttattgggagttgtgtcagttaaatgaatgtttattacatttaactcagaagtttctcatttatgctagaaatagaaagatctgaaccatcagttatgtatattcttgccctcaaagtgtggtccatggaccagcagcaagacattgtctgggagcctgttggaaatgcaggctttggacccaccccagtcctgaggaatcagcacctgcattttaacaagttgctcctgggggattcccgtgtgcattcatgctactaagcacagtattcgttgacatttactctacgaaccataggcaaatgtgtataatctccaaatcttgttcctgtctctgtcacttttagttttattctggtcttttctctgcacaatatagtgaatacatttaaacatgatgttgttcatattgttcccatttccacacaaatactcctctttccttgttttttttcgagtccctttttcttgttctagagatgtggggtaagtaaaggacctcacaaggtcaatttgtggtgtgcctgttgctgatcacctagaacactgctggctcagaatgtgaacatgttgtgtgaatctctaccccaaacctggtgtgggcaggcatgaccagatgttacactcttgtgtagagtcctttttgagactctctctctggttcccttgtgagcctttgtataatgctattttctaatgagtttttccttctagaattctagaatagcagagaggtgcaaattatattagggcagtggctctcaaaatttggcttttacttagagtttgttaaaatgcagattgctggacccgtccccagagtttctgattcagtaagtctgggttggatcctgacttgcttctcacaaatgcccaggggaagctgatgccactgctctggagtcacactttgagaacagttgtattagagtaacagaagttttgttgtgttagaagaataatgattggcagtggacttaatctgaaattgttaataatgccagagatcgaaagcacctacctcaacacagatacaaagctattctcatggttatttccaaagcagtgaagatgtgaagtaacctccatgagcatgtaaattgtttccagttttcttcgttatgctgttttgtggtattcttttgtattcatcccacttaggtaaatgttgtttggtaaaaaaaaagtaaaagtagtggttagtattgtaaccacattatagtattgttcagagcaaacaaagtataatggtttaaacagttaatggttttcaaaaattgggtataattttaaatcctttcaagttgagtccttttaaaagttcattagaggttcctgctccttttaagtcaccagtctgtgtgacttcacagggagtccatgcaacaggaagttaccattcagttaagaacagacaagggggctgggcatgatggctcatgcctgtaatcccagtgctttgggaggccaaggcaggcagatcacttgaggccaggagttcaagaccagcctggccaacatggcaaaacaccgtctctactaacaatacacaaattagctgggcatggtggcatgtgcctgtaatcccagctactttggtggctggggcgcgaggattgcttgagccggggaggtggaggttgcagtgaaccgagatcacgccactatactcccagcctgggtgaatgagcgagactctgtctttaaaaaaaaaaaaaaaaaaaaaaaaaaaaaaaaaaaaaaaaaaagacaaggaccaggtgtggtggcttatgccattgctttgagaagccaaggcaggaggatcacttgaggccaggagtttgagactagtctggtcaatatggtgagacccgtatctctacaaaaaaatataaattagcccggcatggtggcatgtgtctgtagtcctagctacttaggaggctaagttgagaggatcatttcaacccagaagttagaggcttcagtgaaccatgatcacgccactgcactccagcctgggccacagagtgagaccttgtctctaaaaaagtaaataaggaaaagaacaggcaaaatatctatctataacttaatgctgacgaaggatgtggtgaaatttattttttggccttgtaaatttgtttagttcttcaggaaatgtggttgacaatacttattagccgcaaagtatttgtatcctttgtctccataatctcatgtctagcacttccttgactctaaagaaatttccaaatgtggagaaagttggttgtacaaattgtttacaggttgaaagccatctctatgtccagcagtaaagaaaagctggagtaaactctgacagcttcatttggtgaatagcatattatttcttatagaggatgcttgttgtgtaacagcatgtggaaatctttatgctacagtagtgagagacggaaggaaattgttttgaaattgctaatctgtatctacaactaatgtttatacaggcatctagaaaggattacgtagagatgcagctaagtgggctgggatagtgaatattttgtgattatatttttcctttttctttgttttgcaggttttctggaatgttctttcattattttttaaaaattgatttattccttttctttttgtactcttcttgccaagaagtaaaaactggcataatgttatcagaagctaacttcagtagcttttctcagtttttggttaaatacagtttcaagctgcttttcctctctttacatggacctttcagtccatttcagatccattattaaggttttgcaatctttgggatagacagaatcatatagttggccactgtcatagtctagtctttctagatctaaagttctttgaaatgctaagaaggttgaaggttatattgtacaaaaaaaacttttgtttcctgtgtcctccaggttaatgttttatccttgtgatctttcagtgcaatcaaactgaggccgaaggaaggggagacatactttgatgttgtggctgtcgttgaccctgtcaccagagaagcacagagacttgctcctttgctcttggtaggaacgctgtgcaggaagtgtacatcacctttgtttgaagttgtcacatgctctgaaattcactgagagcttcgttttccttgagttgccttcaacaggcactggacaatgctatggggttctagggcagagcaatctttacaaagattgacagtggctgtgaaacagcctcacagccctagaaagttggtgcaagtgtggttggctgcctcatgtaatttaaaaaagtgattaacatcctcatttagagtaaaacatcctggaattaaggtatgctatattttaatttataatatcagagataaaataaatatgttttttcatttttccttttttataactaccatggattttttgtcttggcatgtcttttagacatgtacagtgtgttacaattttaggacatttaaaagacctttgacaaagacagtcgctccaacattcattgccgaataaatctctaaccttttttgtgagtattggtatctctgttttttcatcctttggcatgtgagcggtgactctgaggcctgtagtttttccatgatctgcctgctgcttccccacaggaactgccttcgtgtgaggagcagtgagctgcagcagcctacttcccattgcttttggccacgtcctatgtatgtgtgatgtagattgtgcagtagagttgtgatttccagaagtttcgccagtgcagactctgtggctgttatctttatatcttttcttgagatattaatagctcagtgtcaaataataaatttctgaagaaaaaaatcctaaatattttgtcatctggttttccttctaggttttggctcagctgataaacatgaatctgagagtatttatgaactgccaatccaaactttctgacatgcctttaaaaaggtaaaacatgctatgtaagaaaacagttgaagaaattgtactgaatccaagttctgatattgcatgttagaggatcagatggatttataggtggacatcatgtttgaaatggtcatttactaaatgttcagttttgccaaatttcattctaatcagaagttctaagaacatagtgtgtttgtagcatttaggtggcattaacccaggctgcttgcatttgtgccttttctttctttttttcgagatggagtctcgctctgtcgcccagattggagtgcagtggcatgatcttggctcactgcagcctctgcctcccgggttcaagggattctcctgcttcagcctccttagtagctgggattacaggtgcacactaccatgcccagctaatttttgtatttttagtagagacggggtttcaccatgttgaccagcctggtctcgaactcctgacctcaagtgatccgtctgcctcacttcccaaagtgctgggtttacaggtgtgagctaccacgcctggccccatttgtgcttttcatcttaaaagaagaatattcatttcaagttggaatatacatgttagaggaagcttgcttagctatatattgtcatgagctttggaatggtcatttatgaaaaaagtgatacagaaagcagttagcgttgtggctatgggaaatttctaacttgccagtgtgctgtgttttataggttagcttctaagtggattgaaacagcatttgaaagtaaccaaagggttcccagcttccaccattattctcgtataggggaaatgtttacattattagtgttttcaggactagcctgagagcccaatcagtatttaggaattggttttaaagagaaaaatgagtcctccttgaagggaggaaaatgcccaggacctaactgtgaccctgacagccatccatgtgaacgagtggcctccgttcaagtgattggattttggcttgcaggtggacagtatagtggctgctgagtatgagctagagtacctgttactagaaggtcattgctacgacatcaccacaggccaccactgagcactcctcctcagtgctgtccttgtttgccttttcttgcatctgcagcaaccacaaggaggcatcataaggtcaaagatggttttggaaacacttttcccaatctggaagggtactcctccaaatctaatttgttttaaccagttgttacctgtgtaagggctgtgcactcaagtcctgttgtcacatcgaaaattatctaacactttccttttcaatttcagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtaagaccatatctattgcttccaaatacctaatcatgtataatacagcagattgaatcatagtctaggtgggcctctgagacatcagtgttcaggtatgatatttttttaaacaacagctttattcacatggaactcatataccataaaattctccccattaacgtgtacagttgagaggttttagtatcttcacggagttgtgcagccatcaccactatgtaattgtaggatgttttcagcatccccagtgaaagccccatactcattagcagtcactcttcatttccccagcccctggcaactgctggtctactttgtatctctatggatttgcctattctgacattttgtctaaatagaatcaaatgtggtcttctgtaactggcttctttcacataacaaattgttttcaagatccatccatgctgtagtatgtatcgacgcttcactctttttaacttgccagataatattttatttatggacatatcacgtttcatttatcctttcacgaatggacatttgagttgttttcactttttggttgttatgaataatgctgctatgaatgttgtgtgcaagtttttctactgatacgtgagtacaggatgtctttgcatttaggtctttaatttttttcaacatttagtatcttatcctcgttcgtatttttagaataacgtccttattgtttttttctcctttctctttccaacctagtttttataattgtatacagtcattaaccaccactatagccacgatgcagaacatttccattaccccaaaaagttcttttatacccctttgcagacagtagcctcctctcgcctggtttcaggcaacaactgatctgctttctgtcattatacttttgtcttttcttgaatttcttaaaatatgatcatatattatgtaagtcctttttgtctgcttcctttactttgcataatgcatttcagatttattcatgttgtctctgagtgcattcaagtgattggattttggcttgcaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctggtaaataatctgttcatcagatagtgatattgtagttacgttaatttgggcactataatttatgatggagcaattagcattcttaaccatagagtgagattaaaattcattatgggctgaatttggtcaatatagaaatcattagttcagctaaatttgtaggttagaattacatgtcaaaagaaaaaacatgctggaatactcagctataactgaattggccccctgaaaatagattgctcatgagctgacagcctttttcttttctttggaagtgcaacacttattcatgcatcacacgttgattcttccctgaagcacagctaaagagcagatgatttattggtgtgactggcctttattgtactagtttttttttttttttttttgagactcctgcccaggctggagtgcagtggtgtgatctcagctcactgcaacctccgcctcccaggttcaagcaattctcctgccccagcctcctgagtagctgggattacgggcacccaccaccatgcccggctaatttttgtccttttttagtagagatggggtttcaccatgttagccaggctggtctcgaactcctcacctcagttgatccacctgccgtggtctcccgaagtgctgggattacaggcgtgagccaccgcacctggtctgtgctagagtttttaatgtgtagttttggttttttaagagttgcattgatttgtttactgtgttattcacattatagttgattgatatttcagaaatagaagtaactgttcctcagaaataacattttggtgttttgaagagagctaactggacttttcttcttgtcctagggctactttcagctgaaagccaacccaggagcttggatcctcagacttaggaagggacgctctgaagatatttatagaatttacaggtaggagtaagtgatgcagttacattatcccagaacttttagaaatgagcattagctctaattgaatactaccctggcagttagccaggcaacatgaatttaatttgcagttgtatgtgatgaaacagtggtttttccaggaaattaaatatggaagaattgttagaatagaattagataataagaggtatagatgctaatgagtatagtcaggctttattctttaattattcctttgtgctaacaatatcccagaatcaaatcattctatcagtgtgatgcggctcatagataggcagatgagaaacttgaagaaaggagaaaagaaagaaagaacagccacacttttctgcccagagagtgtatgtgttgaccctgagtgatttgcaaatgcacagtacatggaagctttggtcttgaagctgtgctgttagtgctggtattccttggtctgtggtggcatagtaagaacattccctctatagccagcttttaccttaaggtttactgcacatatttattagtttaaaaataattatgttgcctttaaaaaagtttgatataaattctgcttaacacaatttaaattagttttaaactgtgtgaagaggcttcccgtcaggttgtgtaggggatgatttccattagggcacatttgaagcactctgtagtatgtccttgccttaattagctccgtagcgacacacatgaaacagtggattagtgcctggttcttacccaggaaatagaagaattctgtattataataacaccattgtaaacagtagaagctttttttccacataacattttcctcagataaggttttacaaaatttgggatgcacttccgaactccttcccttttggatgccctggcccttgccagccctccccttcccaggagcatggtgccccctcttcctagctgttcagggccccacccccattagaatcttcctttgcctgagaaccctactctctgctagatgacagcaaatgcagtgaattcatgttgtaattatgactttctgcaccttgaaatttggtgactggaaattttaggcattgctgttgattagtagggaaacatacatttaatttttcttcctctgctcctgtctgcctgcaaatagaatttgttacagtttttctggtagcgtatagacaccaggttgagtacagggcctattgttgactgattgttgcctccggcagaaagagcgagcagatttcctttacaacactattccagttaaagagtagtggccgggagtgatgggtgatggctcacgcctgtaatcccaacactttgggaggccgaggagggtggatcacttaaggtcaggagtttgagaccagcctagccactatggtgaaaccctgtctctactaaaatacaaaaattagccaggcgtggtggtgggtgcctgtaaactcagctacctgaaggctgaagcaggagaatcacttgaaccccggaggtggaggttgcattgagccgagattgctctactgcactccagggcaacagagcaaaactctgtctcaaaaaaaaaaaaaaaaaaaaaaaagagcggaggcagtgtggttccaataatggttcagggggcctgttccctgcattcctttatcgaaggctctgtgcttggctcagagcttgtgaacacaggcggttgtttagtactcaccatgtggttaccacacatgggtgcctctcactacgtgatgggtaatttgcaagaggactcacaaaggaggtttgggcatgcaccttatataaagagaggtttcaacacgtgcttctgtgcagctcgaaggagcttaaggagcaagaagatagctggatctggaaaactcctttatgagaaggatgatggactcagatgctctgagagcatttgctgccttttgagaattgtgccttgtaatattgatctttcttttctcgcaaagccacgatggcactgattctccccctgatgctgatgaggtggttatcgtcctcaacaacttcaaaagcaaaattattaaagtgaaggtgagtttggtaaaagtagtggcattctgttattggacagctgtcatttaaaaatatgtatcttggaaccagcccaagagtctctttggaatttgctatggcaattatagggatactgctttaaggcaaaatgtctttgtaactgtgagtttgtggcttccctcaactgaaagattgtaccttttgggtaatctcggtgtgcagaacatgtcccatcttatataaaatattctcatagatgctatgttgtttatatagccacaattcatagtgttgttgatgattcttttctcaatattgggggaactggcaatggaaattttcaacaataataaaatgatagtcctatttaatttcttttgacttgtactttccgttctctgaatgttgaagctcttagtgccttaaattcaagtacagtatattcttgaagaaagaatcattacacacagtgaaacctaaaataggccatccattgttgagaagaaaaatggtcactgtactgccaagaagaaacccctgtttgtgctagtgaatcctgaaaactggtcataacatgaaatacctccctcccaacagctagagcccccagcagccacactcttccctggaactagctgttgactcattgaatcgtgcttctggtttcactgcacagttgagtttgcggctctttgcctatgttgcaagctgaaaatggggttcatctaattaaaagaggttgctgtctcctcacataaggttatgatgtgaatgtcctggcgaagatacttctattgaatccttctagactctgggtggggttgtgcctgtttgtgagagaattgattgataattccctattgatgacaggctcacagtgtatatccagtgagaggcagttttatgcctgtgagacatactgggagtaaggtttatcacatttgattgcaggttcagaagaaggcagatatggtgaacgaagacttgctgagtgatggaacgagtgagaatgaatctggattttgggattccttcaaatggtaagttgacattgtaagagttatgtttttaaggaaaaactgagatataagcaccatccatccctcctttttgcatcttgtgattctgtctgggcctttcacattctactttgtgcagctacatctcacacttatatttggcatagatgagtattttccactcgattgatccaaaagaggttcatgtctcctagtggggaagttacttctgctccatactttgtgactctcattgcctgtacctgctctttggaaatttgactgctccctgctcagtttacttcccgttgtgtaagttgcattctggtgcagcctgtgttcagtctcttcctaaaacaacactgtcggagagtgaacattctttttgtaggttggttttgtcagtcttgtggtctctccagggtgtgagggaagcttcataaccactcctgctgcagctcacccgctagggaaggatgggaagcgcagtctctttcctcttactttcaaaggccgtgtgtctgtatgagtgtttcaagtggtcttttttttacccttattgttataggggctttacaggacagaagactgaggaagtgaagcaagataaagatgacataattaatattttctccgttgcatctggtcatctctacgaaagatttcttcggtcagtcttgttgattatttcattatatatgatgaatgaattggtcagtgttcttatttagagaggaaaggttttgtgggattctgctcattatactcctgtgtctttgaagcactctgagcattgtgactggcttgccatttatcattggatttgttttgatcccgccgtctctgtgaagttgaactatgtagtgagtgcttctggatattacaaggctgcagccctttaacgtcactgtacacattcatagactgtactgtttactgcctgccaaacattgcttaacccagagattaggaggttgacatagagaatagaatcagaacagaaccatggaatacttcactgccttgtaaagattcacaggattttagagccaggagagagcttagttcttacatgtgaacacttctgttttataaacaggctgaggccccgagtgtgaagggacttgtctaaggtcacacagctacagccagaagaggccacgggctagggctgcctgatgtagtggtcaccagaggcactgtcaggaaggcctgagagtcacttttctcattgccagggctctgttcactcttaatttttcactacagatctagtatagaaaatcaaaatgtcatttgtctcatttttagccctcttatttccaagaaataatatcctacctaaaatagtgacaataataacaaccgaatttggttaaattcctccattcaaaaatgtggttttgttttctgagtaaggaggccggagctggtagccttcctctctaaagcagggcctctgtgtaggctgcaggaggcgctgtggttacacattcttcccttagcaccagatgctgatgtcatgtgacaggagttttggggagtgatgtcagttaccccgatttccagggttcatctggaccataactaatatatcagttcatgaagcagtttatttagaggtgtaacagaattaaaacatttgcctctgtcagttaagtgtagttttataggtgaggaatgccccttctctttagtgataacttcataagttggagtaagtacaatttttcattttccatcactgagcgtctccctcggcctaattgagccattagttagctctgccgtaaagagcatttaggtgtctcgtgattgactctacataatgttgaggttaaataacattggaaagctgttattaattacctgcttttgtttggcagcataatgatgctatccgtgctgaagaataccaagactcctgtgaaattctggttcttgaagaattacttgtcccccacatttaaggtttgtttcacagagaaagggaaaacattcttattaaggagatatttactgtatatttttcatgacttttgttttatctgtatactttagcaaattttccatttactaagataccctaatttggttgcatatttttattttgattattcttccagattggtctatttgaaggaaacagttaaattgtgtttaaaaacttggatgatatggtaggagagtcttttgttgttgttattattagcagtgtcttactgagataacgtttccttcctctgaagcctgcatgcttgctttaatttagaaagcacagcgatggtttacattgaagagaatgattggtgttagcatgaaccactcctagatgatgtatggaagtagtgcttcctctgtgcaaaacaaaacacgtacttggaatgttttctgcattacttatatcagtcagtatttgtcatctaagttgatttatttgcatcctttttttttcttgtagaatttactaagtgacttttaatatattcaataaccattctccttgataagcactttactgctggcgcctaaaggtgcttatacttagaatctgaaagacttattcaaaaaggacaacacatttgtccagagttctggctttgcagtgttattccctgggttagatctggcctcgaggaaggcttgtcatcaagctcagtaaatgccttactgaaatcaagtttagacaaatggacttaaagttcatgtgctgtaaaaacacacacagagggatatacatctaaaatccttctcttgaacattctgtcatttcatgtggtgaccagaagtcataaagaaatggggatttgacaaaggtttatatctgttcttctatgtagtcatgagtgggtcacggccggtctttgtaagaccactgttttggtaaatgtgttttatttgtcccgtatcatggtggttggcttacattatgaaagcagttttcttaatcagaagaaatgattatttgttgttcccatgtctaaaaataggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcaggtaggcccttaaaggccaagttttgacagtttgtattaaaagcaacaaattgcttctttttaaatgctattttttccacttatggaaaaggacatgcttattttacatttagaaaatatgaaaatatgtatcacatagatgtcatcactttttaaatttgcatttagcttatctcctttacatctttttctctgtctttttaacatcattgtgatgacataatgtgtgcagttttgtatctgacttaattcatttaacatgaaaactaaaaattagaaaattaacatttagcagtgcttgccatcatctctaattatctgcccaaaagataggagttattgtcatgggtaatagacgaagcttaagtggatacatggctttggcagtagggaacctccggatattcttccggccgtcagggtttgacttagtgaaagggaacatgtgattttagagcatacaaactcaaacagcataagtgtacgtctgcccacagccttccacttcagcccgagcgggcggaaacccaagtcagccacctgagtggaaggatgtaatgtgtgtgaaagtcactgggacagagacttcactcacctctttggaattctcttccactggcttagcctgaagtgtgccttcctgattgtaacatagccacatttaatccttgttgagtacttacgatgggcaaggcattattctacatctgtccatccatatgttaacttacataatcctcccagcaaccctgtgagataggtactgtcattatcattatctccattttacagatgaagaaactgaggcacagaaaggctaagcagttgaaatttgttttattcctactcccacacaccttgctaagaagtgtcttacatgttagtgagtcaaccaggtaataagtggagcaatcaaagtgcatctgcccctagtgcctgtgccactaaccacggagcagccttccatgctgccttaagcgagccactctgtatctgaaggaaaccgcattagagctgtctgcatggttgcttaacaaatgactttttatattctccagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcaggtactgaaaagaagcactcctaacactgttacggggttttccttaaaattgattttgtgtggttaaaattgtgaataggtaatacattggtatggttgaaaaataaaaatgataaaaaatacacagtggctgggtgcagtggctcatgccttaatcccagcactttgggatgccaaggcaggtggatcacctgaggtcaggatttcaagaccagcctggccaacatggcgaaaccccgtctctactaaaaatacaaaaattagctgggcatggtggtgggcgcctgtaatcccagctactcgggaggctaaggcaggagaattgcttgaacccaggaggcggaggttgcagtgagctgagatcacgccgctgcactccagcctggatgacagagtgagattccatctcaaaaaaaaaaaaaaaatacagtgtaaaaaaaacttcctaatcctgtctctctctttcctactcagttcctgttctcacagcagataacctcccaacttattgactgtctatccttccagattttcttaattcttacagaaacagctgtgaatgtgtattctttttttttttacacaaaatatgctacctatttatacattttgtaacttggcttttttttttttttttttacttaatgtcatatacatcttctcagtgaatagagagagacctgattccttttcatagctgcatattattccagtgtgtgagtgttatttatagttttccctgtgacctacaatgttgcaatgaataatctactaaataatttttcatatctcatatatttgtgagataaattcctagacgtagaccttttaggtcgaacagtgtgtgtgttgttacatttctaatgagcaccccattctcttctctgcgagaagtgtgatttgaagatgtgcagggaagaggaacgtgtaggaagcggcacatgcagagatcactgctggggtttagtgatggtggcttcattctttacattcctggtccaaaagaactgtaaggactgtaacactctggggttttcccccccctgtaacattgaagacatcatcaggatatcattgaataatggttgtttatcagttactatggcttttgttactgccgcatatgctagaaatctttggtctgagattatttctttcggatggcaaatacagaacagtaacaaaagcatagcacagtatagattttgcagtgactttcttagagatctttaaagtagcacactttaactccactgtagggctgtagcataccttttcaaagaaaagccagaatatttggctagtggcctgttccattattcattgggtttagttttcctgtcgtaatccatggttggttgtaacaagcgggtcttctttattcagtgcactatatgttgtggatctgaagaagtttaggaaaatagctgctggtgacagactcaggggacagtaccaaggtctgagtcaggaccctaacagcctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatggtgtgtgtgtgtgtgtgtgtgtgtgtgtgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttctatgtcagaaaccatgatgtgtttcaaggctagctaaattactgtttgttaatgttaagcatttttcagaggtgagattgtagtttaagggttttggatacatatttcacatattttaagcattttattttgcttaagtctacttaaatgtttttaaacctttattgtgatatgtagcatccataaagaaaagtatacaaaaaacatacatacatattcacatacatccaggaattattatgaagcaaatacccagataccacaacctagttcaagaactagaacattatcagcatcccagaagccatccttcctccctaacaaaagtgtctagcatcacgacttttatggtaatcatttttgtttctttatagatttactgtttaagcatgtatccataaacactagtttaatttgctcattttcttctcctctatctcaatggaataataaaaggtaaacttttttgtttgtttgtttgttttgagacagaatctcactctgtttcccaggctggagtgcagtggcatgctctgggttgcactcactgcaacctccacctcccgggttcaagtgatcctcctgcctcagcctcctgagtaactaggattacaggcacgcaccaccactcctggctaatttttgtattttcagtagagacagggtttcaccatgttggccaggctggtctcaaactcctgacctcaagtgatccacccgctttggcctcccaaagtgccgggattacaatcacgagccacagtgcccggctctacttactttaaaatttgtgtgatacctggtatcttctaatttatggagctactatggatctgattctgttgtattatttctgttattcttttgttcatactgtctatcacatatttgtttatcttctgtagtgtgtcaggcgttgtttttgcagaattattttggggaataatttgagttcaaaaatggtatcacccaacagtatttgtttctctcttttttttttttttttggagatggagctttgttcttgtagcccaggctggagtgcagtggcgtaatctcagctcactgcaacctcagcctcccgagcaggtgggattacagaggcgtgccaccacacccagctaatttttctgtatttttagttgagacagggtttcaccatgttggccaggctggtcttgaactcctgacctcaggtgatccacccaccttggcctcccaaagtgctgggattgcaggtgtgagccaccgtgcccggcctttttttttttttttttttttttagacaaggtctcactctgtcacccaggctggagtgcagtgatgcgatcatggctcactgcagcctcgaactcccaggctcaggcgatcctcccacctcagcctcctgagcagctgggacgacaggctcacaccaccaggcccagctaattttttgtattttttatagagatggggttttgccatgttgccctggccagtcttggaactcccgggctcaagcgatctacccacttcagcagctatttttaaattttagtctgttggcagggttttgtagagaagtatcatctatttatttttgtaccatcatggaacattctttacaagtatcgcagtcaatcatttctgtacatttccttgttccatgtaagtcttaggacaatggaacattttattgtggcaaagtcagaaggactccacaggaaaaaggtttaaagcatagggtagcattggctagaaaaaatgtcgtctatttgggagcaagtctcaatagacaaggtagattcagaacttccttgacagaagcctgcaaaatttacgaaccaccactctatttagttgactttcagaagtcagtaggagtatttttctcaggattgccctaatgaagggagggttaggtgcaggctgtttgtaagttttaagccaaagcttttcagttgcttattatgggcagatgttttatggatcctctaaaatttgtagttttgaataacttctctaaggcattggtaaggaccttttccattttaaacatttgtgattggcatgtgatctgtaacgagcagctgtacatcactgatgttctatacgtttgtctccacacgaactggctgggtgcagtggctcatgcctataatctcagcactttgtgaggctaaggtgggtggatcgcctaagctcagcagtttgagaccaacctggggcaacatggcaaaacgcatctctagtaaaaatacaaaaattggccaggcatggtggcgggcccctgtagtcccagctactcaggaggctgaggcaggagaatctcttgaacctgggaggtggaggctgcagtgagccgagatcgtactactgcactccaacctgggtgacagagtgggaccccatctctcaataaataaataaataaatatcgccagaactttagatacatgtattttatttttatttttttttaaccaaacaggatctgcccaataacatgattcatcaggtgccaattaaatccctccctcaagaatggctttggtgtgaaacgtggtgtgatgacgcctctaagaaaagggcaaaaaccattgatttggtaagccgtatgtggtgtgcttctgcatgttcatccactggatgtgtgagtgaatcacgattaatgatttttatttagattcttaaatttaagaatttcctagattcttatttagactttctctgtaattgtgtagtttgtcggggctattcttatcttacagaatattcttataaatattcttatcttatagaattagtatcgtttgttgtatagtaagcataagtatatagtttgttggggctattcttatagaatattcttataaatattcttatcttatagaatatttcactggttttatttccctgcttacattaggaaaccaaatcccttagcacttaatgggactgttttcacaacttacaatctgctgagtcactccttggcttccagtttatctctgtgccttgtaatttttccaaatggactttcacttttcctgccttccattagccactcacacattctttgtagatgtaaatacagctttacatagcccactaccatattgcttctggtagtatatcatttggttccttactattgttttcttgtccagttaggacttgtaacccaagaacctttgaattctctatcatgtggcctttcttcaactcagctgaagtgtgttcttttggtttcacagtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtaagcacaaaccgttggttttaggacagtacttctttccatttctgatttctgcttgttgtaaagacaatagaataatggataaaaggaagagaaaaatctcctattaatccttccattctaacatcaaccagtatatatttttcattttccttttatgttggtcttctaaacagtatttattagtgcaattgctatgtttttttttttttctcgtttttctggtgagggggagaaagggtattttaattgtgattatagttatttaggttcatgagttttgtgatacataaaccaaaccttttgcagagttcttcttagattccttgttttttttttcattaaatctgtcagtgtactagtgaatgaaaaaatttagatcaacacaaatatgtagttgaagaaactttttttttttttttttgagacagagtctcactctgttgcccaggctggagtgcagtggcatgatcttggctcactgcagcctccacctcccaggttcatgtgtttctcatgcctcagcctcccaagtagctggaattacaggcatgcaccaccacacccagctatttttaaattttatttattttttattttttgtagttttagtagagacagggtttcaccatgttgcccaggctggtctcaaactcctgacccaagtgatccgcccgcctcagcctcccaaagtgctaggattacagacgtgaggcactgcgcctggccgaaaaaagtattctttaaaacaagcatgttgggatggagatggaatgcttgtatttaatttagtgttaagtctttaatgtcttccctgttgtgtgtgtcttgaatgatagctacttgaaaaaatcattagaatacgaaattgactttttaaaatattaataagttgggctctagatttaagaaaaattttaaatgtatttatttttaaattgtcacgtaataattgtacatatttgtggagtccatagtgatgttttggtatgtacatgggctctggatttttaagatttattctgctttagactaattctaaaaaagtggctgggcacagtggctcatgcctataatcctagcctctcaggaggctgaagtcggaggattgcttgagcctggaggtcaaggttgcagtgagcgactgcactccagcctaggtaacagagagagaacctgtgaccaagcaagaccctgtctcaaaataaaaaaatccagaacatggatcttgggtgatttgcctatacatccctcagactgtactatgatattaaatatcacagctggaaggttatatagtaaccataaaagtaattaattccgattcatcagtaaaaccctgaggatttccatagataaatgggcaaagaatgtggacacactgttcaagtaagaggaaacacaaataataaatgaatttgaggaaacagtaatcaaattaaagcagtctatcactagtatctgctacatggaagaaaacagacatagtgataatgccatttgtttgggaggcggtgatgaaaccgttgtggatgtagcttgatgaagctttgtgtattggaatagcccttgttacaaagcagtacatctgccattagaagcccgtaaggcgtttatataccctcaagaattactctcttgagaatatatctgaaagaaataattcaacagaaaaaacaaagttgtatacatgaaaaaatttattttactattacttataagccagaagcatcaaaaacagtttaaacatccaagaatgagctacactgatacatagaaaatgtttagatgctattaaatgataaaagaaaaatcccgactaaaaaaatgcatgcaacgtttactgaaagtaaatattgtatttgtgaaaacaattcagttggagtggggtttacagatagtttccatttttaaaaaatctttaatttagtttttgctttcaaaatacagtacaaaagcacaaatcccaaagatttagtaagtgagataagatgaaggtggaggtacaaagaataggttccagtgatgaaaaatgcccactcagtggtgtttgtaatttgaagatcatctgttttcttttctgtggttctccttttccttaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgacttttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagtttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggggtgtggggatatgccagagtcctgtgtttggttttagaagtttactgaatgtttcccacatggagaataatggatggcatgttagtttctttaagagtggtaaagttgtacatctgtcattgttgcatttcgaattgaacacatagatgcttgcctgtctgcttgggtgaatgcctcttgggagagcgaagattacgtgcatgatgtatgttaagaaacagtttccggtcaggcacagtggcttacacctgtaatcccagcactttgggaagccgaggcgggcggattatgaggtcaagagatagagaccatcctggccaacacggtgaaaccccgtctctactaaaaatacaaaaattagctgggcatggtggcacacacctgtagtcccagctactcgggaggctgaggcaggagaatcacttgaacccgggaggtggaggttgcagtgagccgagatcatgccactgcactccagcctggcaatagagcgagactccgtctcaaaaaaaaaaaaaaaaaaaaaaaaaaaattaaaacagtttccataaatggagcttaatttgctctgctgtccttaagccctcgtgggtttttttttaagagagtctcattctgtcacccaggctggagtgcagtggtgcgatcttggctcacttcaacctctgcctcccaagttcaaacaattctcctgcctcagcctcctgagtagctgggattacaggcgcctgccaccatgcctggttaatttttgtatttttagtagagatggggttttaccatgttggttggccaggctgatctcaaactcctgacctcaggtggtgatctgcccacctcggcctcccaaagtgctgggattacaggcgtgagccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtatttttagtagagacggggttttgccatgttggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttctttaaaactgcgcagtcatttggcctttgtgtttaggaagggcagattgatagagcacaaagtccaaccccttcatctagcagaagctgcaaacccagacagaggaacgagggctttacctgagtcttgtctgctgctggggctggcttcgggttgcatccagttctttggattctgaggatccaaagcacccaggtctcctccaggtcctcaacctctgggagctgccccaggcagaacttggcaggcaggcataacaggtggggtgggagggggaacctcaaggcaagaaggtgtcatgagacccctgggccggcagagttccttaggagggtggcatggactttgcattttgccagttctctgagctcctactccggggtggatatgcattgaggatgtagtctctgtgtgatgatggggagggcggggaggggcacctggtgcctgtgaaggcgcaagagagggccctaaggtgcaggaccaggactaagctgctacaaggaggtggtgcttaggttgaagcctgaggactaagtaggggcgaggggtgggcagaggggaggagcttgagctagtgtttttgagggagctgcatggaagcctgcacgtggccaggagagggggaatgggtttgatcctgggggcacaagaaggcccttcaggggtttaaactgggtgctggcactaaatgggttttttcttgtaataaactttgtgttgaggtctgtagcacatactgaaaagtacataaacacacaccttgatagtttttcacaaagtgaaagcactagcatatccatcatccagataaagaaaaggaagttggagtttattttaacacttaaacatctgattacagtctggcatccaggaagggcagagcagcatgtgtcagaccagcctacgcctgatcattacacacactatttgaaaagcactagagcctgctgagataccggcaagagagggagagcacgaaccatcagaagaagtgaaacctcatgtggctcacagggaataaaacagaaggtggcaggcttactaggcccaggagccaagtcacttcaggacgttcttggccgctgcacacttgtgtgggggcacatcccagaaaggaggaagccatagaagcccccaactttgccttgtatagtctcatcaagttcttggcgggttcctgtattatacataaacagggcagaattccaaatggaaagcaacacttggaaggctggaaaagctgagtagagatttcagaagatgtgctggggagaagaagtttagaattcattttccatcaaattagagggatttggtaactatttcagactttgcatcgaaaacccagggtgtaggccttaggattaggaccacatcacagaactcaaatctagggtctaggactgagggcaacactaagatagacctaccctcgtaaagcctaaaatgaaggcttcgcagaatcagggtgatcgctagtaaccaaactctgctaaaacaaaagtttttgtgggaaaaaactgaatccagagtgtctatagtatattattcagaatgtcctgtatataaccacatcagtaggcacgacaggaagtgggaacatatgacgtgatcaagaaaaaaaatcaggctgggtgcggtggtgcacacctgtaaccccaggactttgggaagccgaggcggttggattgttggagcccaggagtttgagaccagcctcggcaacatggtgaaaccccatctctacaaaaaatacaaaaaattagccaggcatggtggtatgtgcctgtagtcccagctactcagaaggctgcggtgggaagatcatttgagcctgggaggttgaggctgtggtgagctgtgatagtgccattgcactccagcctgggtgacagagtgagaccctgtctcaaaaaaacaaaatcaaaacaacccataaaccaaggtgttgaaatcattcaataaaaatgttaaaataattataaacgtttttctcagacataagtggatgcttttttattgccttttgatacgtcctgagtttgtgtgtgtgtgtaggtatatgtgtatatatatatttattaatttaattgacaaagattgtgtatattccaggtgtcccgtgtgatgatttgctacacatgtgcattgtgtgattatcaccactgaattaggacacccatccccacctgtgctgcacattagatccccagaacttatctttttttctttttttgagacggagcctcggtctgtcgcccaggctgaagtgcagtggtgtgatcttagctcactgcaaccgccgcctcccagattcaagcaattctcctgcctcagcctcctgagtagcagggattataggcgtgcgccaccatgcccggctaatttttgtatttttagtagagacggggtttcaccatgttgttcaggctggtctcaaattcctgacctcatgatccgcccgccttggcctcccaaagtgctagggttagaggcgtgagcccccacacctggcctatcgcgcaggcttaagtgcaatgttgcgatctggcctcactgcaacctccacttcctgggttcaagcaattctcctgcctcagcctcctgagtagctgggattacaggcaactgccactgcacctggctaatttttgtatttttattagagatggagtttcaccatgttggtcaggctggtctcaaactcctgaccttaggcaatctgcccaccttggcctcccaaagtgctgggattacaggcatgaaccaccacgcccagccccacagaacttatctttaaactgagagtttgtactcttttgatctgcatctccccatttccccatttgcagaagaaaagtcagtgaacttgaagacacgttaatagaaattatctaaattgaaaaacaaagtggaagaagagattgaaaaagaataaatgagcagagactcagtaaactgtgagacagtataacaaatgcgtaactagaatcccaggagaggagagaaaatgtggcagaaaaaaaaatacggagaaatattggccaaaattgtttgttttttgaaaatgcggtcttggcccagttttgaggccctagctttgaggtcctggctagaggccagtcagtcctctagagcagccaatcaagtttacaccctcaactacctcccttcttcagctcaagctccaggccagcactctgacaccccagggcagtaccagacatcctgcaacagcccctgtggcccagcgccagctgagattattccagtcagtctcagtctgctgcccctgcctcacctgttccttcctgggaaaccacaataaggggtcttgcccacattcccctgctccctgtgccccataaccagtggttgcttccactgagtggccctgcgtggagtgctgtttctccccagggaactgagtgcgacatgtcaaatttaccgtttctctcttgatctgcatctggcctcaccggaatcaccactccctccccttaaaagcaggatgaatataaagaaggccacacctaggtgcatcatagtcaaatgctgaaaattaaagataaaatcatgaaaaagtagtagccaggaaaacaaaaacacctgatgtggaggggaacaacaatgaaaatgacagctgacttcccatcaggaacaggggagtgacgtcatagaatgctgaaaggagctaacatcctacatgcagggaaaatattcctcaaaaatgaacctggggccaggcgcggtgcctcacacctgtaatcccagcactttgcgaggccgaggcgggtggatcacctgaggtcaggagttttgagaccagcctggccaacattgtgaaaccctgtctctactaaaaatacaaaaattagccgggtgtggtggcaggaacctgtaatctcagctactcgggaggctgaggcaggacaatcgcttgaacccggcaggcagaggttgcaatgagccgagatcatgccattgcactgcgcctgggtgaccgaggaagactgtctcaaaaaaaaaaaagaagttggaataaaaacattttggggtaactgaatgctgacagcattcattgtaggagacaagtactacaaaattgctttaaaaaaaaaggctcccaggggggtggccccaagagttggggttcagtgtcctccaagccctggtcctctccaataggcctgggatctgccccacctgacccgttctcccgaccctgaggttggcttcaatgctaaggaagcccacaatattgtcaaagagtgtgtgctggtgaagattataatcacatcatcaaccaagcatagtggaacaatccttaacacatctggttaagttgggaaaagcttatacatatattgtgacctgtgcagtggtccagaagagcgcatatggctttcatacagccagctcctgtttttgggataccacatctgatggaacctgtaccataagatgggagaactggaccatgaaccgtattgtcaacgtttttgccattgctagtgttctttaacttactaaaaatgttgggctaaagccattaacttaaagaatttgtcagtgtatcttttcaaaaaatgagtaatatttattagtgtgctagatgacaagcgtgcattatataagcaaaatgctgtaatcccagcactctgggaggccgagacgggcggatcacaaggtcaggagatcgagaccatcctggctaacatggtgaaaccccgtctgtactaaaaaatacaaaaaaattaacttggcctggtggcgggcgcctgtagtcccagctacttgggaggctgaggcaggagaatggcgtgaacccaggaggtggagcttgcagtgagccgagatcgcgccactgcactccagcctgggccacagagcaagactccgtctcaaaaaaaaaaaaaaaaaaaaaaagtaagcaaaatgaaaagcacttagtgctttctgacagaattatagatgtaattttaagagttgctcctagcaagttaaaagtgcatataaaatatgcaactcttagttaaagggtttagtatcagtcttatctatacaagtagtaaattttgtcattgctttagttacaaccatctgtaaataattttaaagacttattacgtggggttcaaattgagtggaataaagtatagattaaaagtatacaattggctgggtgcggtggctcacacctgtaatcccagcactttgggaggctgaggtgggtgtatcacaaggtcaggagattgagaccatcctggctaacacagtgaaaccccatctctactaaaaatacaaaaaattattcaggcgtggtggtacgtgcctgtagtcccagccactcaggaggctgaggcaggagaattgcttgaacccaggaggtggaggttgcaatgaactgagatcgcaccgctgtactccagccttggcaacagagcaagactcagtctcaaaataaataaataaataaaagaataatattaacaaaataaatgagtttaatgcagtgatctttgtttttggcacatcagaaattctcagtcattactcatgtttctttatgctgctggcttttgtgcccttgaagattataatagtgaccaaaatatatatgcagacttattttttattgttgttgaagcctggtttaagaaaaaaaaattcatacctcgtgaacttgctatcttctgtgtttctaattaaaatataataaatattatcttcctgtgctgaaaaaaaaagggccaggcacagtggctcgcgcctgtaatgccagcacttttggaggccgaggcagtcaggtcccctgaggtcaggagttagaaaccaccctggccaacatggtgaaactccatctctactaaaaaaaaaagtacaaaaattgctgggcacggtggctcacacctgtaatcccagcactttgggaggccgaggcgggcggatcacaaggtcaggagatcgagaccatcctggctaacacggtgaaataccgtctctactaaaaatacaaaaaaaaaaaaaaaaaaaaaaaaattagctgggcgtgggcgtggtgacgggcgcctgtagtcccagctggaggctgaggcaggagaatggcatgaacccgggaagcggagcttgcagtgagccgagatcgcgccactgcactccagcctgggcgacaagagtgagacttcgtctcaaaaaagaaaaaaagggaaatgatgccaaatataaattcaaacctccagggaggaagggagcactggaaatagtaaatatgtgggtaaatacactatttttttctttacttgagttatttacaagaccattgattgcttaaaacagaaataacattggtatattgcggggtgtatagcatgtagagtaaaatatatgacaaccacacaaaggatgggagttgtaagtttcttaaatctactgtgatttgttttgaggacagggcaggagaaactgataagctaaggcagcatattgctttctgtagcgcagccatctgaaaaatgcaaagtgttatagccaaaaagcaaaagaagaggtacaatggaactgcttaaaactttttaaaaattagggccggtgggtgcggtggctcatgcctgtaatcccagcactttgggagccaaggcgggcagatcacctgaagtcaggagtttgagaccagcctggccaacatggtgaaaccccatctctactgaaaatacaaaagctagccgggtgtggtgacgggcacctgtagtcccagctacttgggaggctgaggcaggagaatcacttgaacccgggaggcagaggttgcaccgagctgagatcataccactgcactccagtgagactctgtctcaaaaaaaattaaggctgggcacactggctcttgcctgtaattccagcactttgagaggccaaggtgggaggatcacttgagcccaggagttcgagaccagcctgggcaacatagcgagactccatctctacaaaacaagttaaaaatgaaaaaaagtttttttaattaaaaaattcccctgaaacataaaacttgatcaacccaatagaagacaggaatggaaggacaaaagaatcagtacagaggagacaaatgactaactagtagccatcaaactcaaaactaaaaaatatcagtaattacaagttaattttcttaaacactctaaataaaaggctgagattttcacattggactttaaaaaggaatttaccagaattgcacgttaaatgaaagtagatagggtgaaagagatctagggggtggtcactgcactgagtcattgatctggcaagatcaactggaagcaactattctggagctctggaccatgttcaaacacttacaaccaccagggaagcacttcctgaaggaagagactgctgatttgtgagtgagtggcatatgtgacccaccaccatcctccctcctcagtgccacctcagctgtagggttggctgcctgcactcttggaacatctcactggtgccagtgtaggcagtactgatctcctcctccaaaaaaattggatctgtaaattttggctggtctggtgtaccctgaggaagcagcacaggcacctgctttagtttgccctcttggcagtggtggcagctgcttctgcttacccttctatcagacgatttagcttcttgatgggcgccaccaacatggtgttcaggcactttgtggaggttggccaagtggcttacatctctggacctcatgctggaaagctggttgcgattatagatgttgttgatgagaacagggctttggttggtggagcttgcactcaggtaaggagacaggccatgccatttaaatgcatgcagctcactgactttatcctcaagttcccacccagtgcccaccccagaggcatggccaagaagcctggcagaaggcaaccatcaatacaaaatggacaggcacacaatgggccaagaagagtgaagccaaagaaggggaagccaaaatgatagattttgatcattttagtcatgaaggcaaagaaaatgaggaacagaatgatcaagaattaaattaagaagcttcaaaaggctgctgtcctgaaagcttctccccatatagcacctgttgcccaggctggcgtgccagtggcatgatcttggttcactgcaacctctgcatcccaggttcaagcagtcctcccacctcagcctcctgagtagctgggactacaggcacttgccaccaggcctggctagatttttttgtatttttggtagagacgggatttagctatgttggccaggctggtctcaaactcctgacctcaagtgatctactggtctctgcctcccaaagtgctggaattataggcatgagccactggacccagccaaggacaaatttctataaacatacaaactaacaaaactgggaaaaaagaactagaaaatcagactaaacctataacaagtaaggagagtgaaccaataagcaaaaacctcccaaaaaagaaattcccaggaccagatagctttactggtgatctctactgaatatttagagattaatgtaccactgtttctcaaactcatccagaaaatcaaagagagaagaacacttctgaactcattctatgaggccagcattaccctgataccaaagctttgtatcttgtagggtacaaagatcctataagaaaagtggaggctaaccttccttatgaagaagcaaaaattctcaacaaaatactaccgaaccaaattcagcagtatattaaattgattatatgccatgggcaagtggaatttatccccagagcaaaggtagttgaacatagaaaaatctttcactgtaccatgccatattaatagaatgaaggaaaaatactagattcagccaggcgtggtgtttcatgcctgtaatcccagcacgttgggaggctgaggttggtggatcacttgaggcccagagttcaagaccagcttggccaacatggtgaaaccccatctctagtaaaaatacaaaaattagccaggtgtggtggcaggcgcctgtaatcccagctacttgggagctgaggcaggagaatcacttgaactcgggaggtggaggttgcagtgagccaggattgtgccactgcactccagcctgagtgacagagtgagacttcatctaaaaaaaaaaaaaagatgatctcagttgtttttaaaaattgattaaatttgataccctttcatgataaaaacactcaataaactaggaatagaagggaatattccctgcatgataaagaccgtatgtgaaaaatccacatcatactcagtggtgtaagactaaaagctttccccctaagatcaggaaaaagacaatgatacccacttttgccacctctattcaacatagtactgaaagttgtggctggagaaattaggcaagaaaaagaaataaaagacacccaactctttttgtgtatgagacagggtctcattctgtcacccaggctggggtgcagtgacatgatcacagcccaccgtggcctcagcctcctgggctcaggtgattatcccacctcagcctccctagtagctgagactacaagcacgtgccaccacgcctggctaatttttctattttttattgagatagtgttttgccatgttgtccaggctggtctcgaactcctgggctcaaacaatcctcccacctcagcctcccaaagtgctggggctacaggcatgaaccactgtgcctgaatatacccagattggaaaagaagttatctctgttcacagatcatatgaccttatatatagaataccctaaggaatccacaaaaattgttagcactaaataatgaattcagccatgttgtaggatacaaaaatcaacacacaaatagtagtatttctaaacactagcaatgaacaatccaaaaaggaattccacttacatatcatcaaaaaagaataaaatgcttaggagtaaaacaaaaggtgagaaaggctatacactaaactacacaacattagtgaaagaaattaaagttctaaataaatataaagacatactgtgttcatgaattggaagatgtaatgttgttaaaatgacaatactctgcaaattgatctaaagattcaatgtatttttgtcaaaatcccactgttgttttctgcaaaaatataaaaattcatcctaaaatacatatagaatttcagcagaccctgactaggcattcttgataaaacagaacaatgttgataaaaacagaacaatattggagaacacatacttcccaatttgaaaacttactacaaagctacagtattcaaaacagtatggtacgagcataagaataaacatgtagacagatggaactgaaagaaaaacccttatatatgtggtcaattcacttttgatgtgggtgccaaaacaattaaataaagtaagaacaggctgggcacggtggctcatgcctataattccagcactttgggaggccaagatgggtggatcacgaggtcaggagttcaagaccagcctggccaagatgatgaaaccctgtctctactaaaaatacaaaaaaattagccgggcatggtggcaggcacctgtaatcccagctactcgggaggctgaggcagagaattgcttgaacctgggaggcagaatctgcagtgagctgagatcatgccactgtactccagcctgggcaacagcgagactccatcttggataaaaaaacaaaaagtaagaacagtcttttcaaaaatagtgctgagacagctgaatagccacatgcaagaggatgaagtttaactctactaagttggcaatggtttcttcagtataccaccaaaagcacaggtaacagaagaaaaaaacagataaattgggattcattaaaataaaaaacttgtgtgcaccaagggacatcatgagagtgaaaagacaacttagggaataagaataatatttgtgcctcatacatctgatgacagattaataccagatcatataggaaactcctacaactgagcagaaaagaaaaaacaaaaaaagcaaacaaaagacctgcccagtgaaaaactgggtgaaggatttgaatagatatttcccaaagaagagatacaaatgaacaataagcccatgaaaagatcttcaatatcattagtcattaaaaaattgcaaatcaaaatctcaatttaaaaactccaactataattatgcagtaacatgtatatttccctttttagctgtcaattattgctccatgtttttattatttttagagatgaggtcttgttatgttgctgaggatggacttgaactcctgggctcaaatgatccccccaccttagcctcctgagtagctggtagtacaggtgcccaccagcatgcctggcttgctccatgtatttttttggttgcaattttattgtggtgcaattcatataacataaaatttaccattttaaccatttttacatgtacagtttagtgatcttaagtacattcacagtgttgtgcaaccatcaccactattcattcccagcactttttcatcatcctatacagaaactctgtgccctttaaatcatcattcccccttctcttctctctccaagtccctagaaacttcttcttctttttgtttttgagatagagtcttactcgatcgcccaggctggagtgcagtggcgccatctctgctcattgcaacctccatctcccgggttcaaggaggcatgtcccctcgtgcctcagcctcccaagtagctgagattacaggtgcgtgccactacacccgtctaatttttgtatttttagtagagatgggttttcaccatgttggccagcctggtcttgaactcctgacctcaggtgatccacccgccttggccccccaaagtgctgggattgcaggggtgaaccaccgcgccgggcccagcccctagtaattcctgtctatatgaatttgcctattctgggtacctcatgtaggtgggatcgcaatatttgcccttttatgtctggcttaatttcacttagcatagtgtcctcaaagttcatccactttgtagcatgccttagtcagctctgcccttagtcagctctgctgccataacaaaatgccacagactgggtggcttcaaccagcggtccccaacctttttggcagcagggactggtttggtggaagacaatatttccacggggtgttggtgagggtatggtttcaggatgaaactgttccacctcagatcatcaggcattcgttagattctgataagtagtgcgcaacctggatccctcgcatgggcagttcacgatgaggtttgcgctcctgtgagaatctagcggggtggctgaactgagagggggtggagctcgtgcggtgatgctcgctcacccgcctccccgctcctgctgtgcggcctgcttcctaacaggccagagacccgtacccggccacagccccgggctcggagaccctggcttaaacgacgtaaatgtatttctccaccatccgggaagtgaggagcgcctctgcccagctgcccaactgaggggatgtgaggagcgcctctgcccggccgccacaccgcgtgggatgtgaggagtgcctctgcccagctgcccaactgggaagtgaggagagcctctgcccggctgcccaccatctggcaagtgaagagcgcctctgcctggctgcccaccatctgggaagtgaggagcgcctctgcccagctgcccactgtctgggaagtgaggagcgcctctgccaggcttccgccctgtctgggaagtgaggagagtctcttcctggctgcccaccgtctggaagtcaggagcatctctgcccagctgccgccccatttgggaagtcaggagtgcctctgtcctgccgccgcccggtctggtatttggggagtgcctctgcccagctgccaaccatctgggaagtgaggagcgtctctgcccagctgcccacagtctgcaaagtgaggaatgcctctgcccagctgccaaccgtctgggaagtgaggagcccctctgccctgccaccaccccgtctggaaagtgagaagcgcctctgccctgacgcccaactgtctgggaagtgagaagtgcctcgacccagccgcccaccctctggcaagcgaggagcgcctctgcccggctgccgccccatctgggaggtgaagagcgcctctgcctggctgcccaccatctgggaagtgaggagcgcctctgcccggctgtccactgtctgggaagtgaggagagcctctgcctgactgcccaccatctgggaaatgaggagcgcctctgcccagctgcccactgtctgggaagtgaggagcacctctgccaggcttccgccctatctgggaagtgaggagagtcttttcctggctgcccaccgtctggaagtcaggagcatctctgcccagctgccgccccgtttgggaagtcaggagtgcctctgccctgccgctgcctggtctgggatttggggagtgcctctacccagctgccaaccatctgggaagtgaggagcgtctctgcccagctgcccacagtctgcaaagtgaggaatgcctctgcccagctgccaaccatctgggaagtgaggagcccctctgccctgccgccaccccgtctggaaagtgagaagcgcctctgccctgacgcccaactgtctgggaagtgagaagtgcctcgacccagccgcccaccctctggcaagcgaggagcgcctctgcccggctgccgccccatctgggaagtgaagagcgcctatgcccggctgcccaccatctgggaagtgatgagggcctctgcctggctgccaactgtctgggcagtgagaagtgcctttgcctggctgcccaccgtctggcaagtgaggactgcctctgcccagccaccctgtctggcaagtgaggagtgcctttgcccagctgctgccctgtctaggaagtgaggagcgtctctgtctggctgccgccctgtctgggaaatgaggagtgcctctgcccagctgctgtgcgaccttccaagtgtgaagtgacagccttgtgtgtgatcttttctgtcttccccaagtttgcattttcgacattaaagtttactttttagttaaaagttttaaattggagaatataaaataaaaattaaaattaaaaaaatgtatttctctcagttctaaaggctggaaggctgagatcagaatgccagcatgactgggtttgctgagggctttcttttaggcttgcagaggttgccttcttgctgtgtccccatctggcacaggggagagtactcatggctcttcctcttcttatggggcactcattccatcatggggtcctgcccccatcacctcatctaaacctaattttcttccaaaggccccatctccaatgccatcatattgggggctaggccttccatacacattttgagggggcacagttaagtccatagcatgtatcagaatttcattcctttttaaagctgagtaatattctgttgcatgtgacataccgcattttgcttatccattcatatgctgatggacttttggatggttgccaccttttggctattgtgaataatactgctatgaacactgatgtacagtatctgagtctcagcttcccattattttgggtaaatacctaggagtggaatttctggatcatataataattatatgttcaactttttttttttttttgagacagagtcttgctctgttgccaggcttgagtgcagtggcacaatcttggctcactgcaacctctgtctcctgggttcaagcgattctcctgcctcagcctcttgagtagctgggattacaggctgtgatccacctgcctcggcctctcacagtgctgagattactggtgtgagccaccactcccggccctctatgttcaactttttaagaaaccaccatgctattttccacagcagctgcaccattttacattccaaccaacaatgctcaagagttctaatttctccacattttcattaacagtggtaattttttttctttttccttctcgccttcctacaactgtgctactgggtgtgaagtggtattttactgtgcttttttttttttttttttttgagacagagtcttactgtgtcacccaggttggagtgcagtgatgcgatcacagctcacctcagcctcgaccttttctggctcaagtgatcctcccactgcagcctctagagtagctgggaccacaggcgcacaccaccacacccactaatctttgtatttgtgttgagacagggtttcaccatgttgcccaggctggtctgaaactcctgggctcaagtgatctgcccaccttggcctcccaaagtgctaggattacaggtgtgagccaccacacctggccaagcatcttttcatttgcttttttaccatttgtatatcttcattggaaaaattactcagatcttttgcctatttcaaaaaatgggctatttttcattattgaatggagagggttctatatatagtctagatacaaggctcttatcaaacatgtacatatctatatacatatatcttgatgtgtcgctgaggctggagtgctgtggctcagtcatggttcactgcagcctcaacatcctgggcctgagtgatcatctcgtgttagcctcgccagtagttgggaccacacgtgtgccagcacgcctggctaatttttgtatttttttgaacacatttttgaatttgttgaggatttcttttgtctctacacataagaaatatttctctgtagttttgtgttgtaatgtttctgtttgaatcccacattgaatgggagttagcagtatttattttgggaaaataaatccacatttataatgcctttaccaaataatataaaatatatttttataaaacttaaaaaggttaacaatcagcaaagcaaggggcagaatgtgacaaagttatctgatcacacaagtaatacttgttatgttgaaaacttaatgaacagagaaaagtaaaaagaaaaaactgctatcagtgattactactattaacattttcacatatttgcatctatatccacatatacatatatattaaaaagtaggacatattgtatctgctacttttcatttatatttatttatttatttttgagacagagtcttgccttgttgcccaggctggaatgcagtggcacaatctcagctcactgtaccctctgactcccgggctcaagcgattctcctgcttcagcctcccgagtagctgggactacaggtgcatgccaccacgcctggctaatttttgtatttttggtagatacagggtttcaccatgttggccaggctggtctcgaactcctgacctcaaatgatccccctgcctcagcctcccaaagggctgggattacagacgtgagccactgcggctagccttgtatctactactttttaacatacagttttacttagcaattttgtatatgaatgcagttgtgtgtctcttcgggcgctttaagctgtgtgtaagaggaagccctcctcaggctggcacacccactcagaaaatattctaatgcttacatatcagaagccagagcaaggacggtcttctgtctgaaaggttcaggtgttccaagatgtccttaggtctcaggttcttcctgcctccctgccccatcatccatagcatcagctctgtgttaggacggctgcccgcagtgtggggcgctacatgctcccttgtccgcacggtgggaggacctggcttcctgcagtgatcaccctggatttagtgtcaggagagacctttcccaaagactgggcaagcctctcctgttccagagccagccactgggcaccagccaagcctgtcccttgagccgaggctaattactcagcctcattactgctattttgggtgggctgggagaggggtgtggctttagcatgtccatcgcagtgtgcaccacgaaagttaaaaaagtcaaatagtgcttaaaaatatcaatgagtcggccaggcgtggtggctcacgcctgtaatcccagcactttgggaggctgaggtgggtggatcacctgaggtcaggagttccagaccagcgtgtccaacatggtgaaatctcatctctactaaaaatacaaaacttagcctggcttgctggcgtgcgcccatagtctcagctacttggtaggctgaggcaggagaattacttgaacccaggaggcggaggttgcagtgagcagagagcacgcctttgcactccagcctgggcaacaagagcgaaactccatctcaaaaaaagaaaagaaaaaaatatatatatccatgagtctgggcgctgtggctcacacctgcagtcccagcattttgggaggccagggagagcagatcactaaagcctggaagtttgagaccaacctgggcaacatagcgagaccctgtctctattttttaaaagtcacacacacacacacacactcactcacacacacacacacacacacacacgcaccagcaagttgctgacccactctgtttcatttagaggcaaatatttttcaattctttatgctatttttcccaggattcccctccaagtttctcaagcatatccttctatcttcctgcattaccattgcttgatacctagtgtggagactgaggactccctctgctcccctacagctgcatctcccgcctccccacttcccctcctacggcatcaagcttaggagctattatgactggaattgtgttcccctatatatgttgaagccccaagcccccatgtgactgtattccggggtagggcttttaaagaggtaattacgcttaaataaggtcataagggaccatatgagaggaagagacactgggcttgggtgtacacagagaagggccacgttaggatacagggagaagacagaagacggctggctgcaagtcaaggagagcagccccagggaaaaacaaccctgccagcacatcgaacgtcggcctccagcctccagaactgtgagcaaatcaacatctactgtttaagcctccccgtctgtggtattttgttatggcagtcctaggagactaatacagtgttaatcattagtaattagtagacaaatacagtaacaatttggctaaatcaatagtgattttataattgtaattatgcaaatgttgtttgctgctgaaacaagctgtgtactataacttttttcctttctggaataacttattttgttttaactggagggtaaaatctctctgtctttgtctctgtctcttttgtgtctagttttctttttttttttttgtttgagatggagtctcactctgttgcccagactggagtgcagtggcataatctcagctcactgcaacctctgcctcccgagttcaagcgactctcctgcctcagcctcctgaggagctgggattacaggtgcctgccatcatgcccagctaatttatatatttttaggagagatgtggtttccccatgttggttaggctggtctcgaactcctgacctcaagtgatccacccgccttggcctcccaaagtgctgggattgcaggcgtgagccaccacactgggcctcgtgtccagtttcctatacatcagtttccccctaagtggtccagcaaaaaatgcctttctatcttcttcccgactccacacctcaaatcggcggtttgcgccttccaccctccatcctcaggtgggctctgtcctggccggtgggctcgaggccagggttctaccgcccctccccaacccacccttccgtttgcctctcccctggtggaacctgtgttctgggttccacggcttcctgtctttcggcttcccaccttgttttcccaaaggacatcctttgtgaacaagaatgcatggcaggtatcttggagtccttgcacgtctgaagacgttttaagtctccctgacccttggctgaaaatgaaatttgaggctgggagttattttcctacattattgttattttcggttatttctattttttcatattataaagactgtgttaggtgctgcctattttattattttattttatttttttattgtaagaaacaaggtctggctctgtagcccaggctggagcacagtggggccatcatagctcaatgtgatccctaactcctgggctcaagtgatcctcctgcctcggcctcccaaagcacaggacaccacgatgcccagcctagtgtttttggttttttttatatatatacagctaaaccagttctctaggataaagtcctaaatgggtcaaaggtcgacacatttttaaaggtttaaaacaatacatgttgcacaatgccatccggcaccaccctatttcagtgcctttgttctgtgctgcttttgtattttcatcagacctggatatcaacactttaaaaagttgtttgccagtttgatgagaaaaatgatgtttagacagctggctctagaagggtgggaggtgccgggaggtgtgaggcaggacctgggcctgctcccaccttccttgccatctctgctgcgctctcagggctggcgggaggacggggcaggacaagcgctggaggcagcctctcccaggtgtccccggcacgctctgcttcctgttatccctctgtgcaagcataaatacgaacatgaagatgggagtaaacctaagctctacacatgacctgagagggaattccagggcgaaaatgtaccccaccccgccctggccatggaaccctggataagtcatggtggcagccggctattacaaataaagctgtcacggacattcatgtgcgaccctttgcatggacgtgggttttcattcctcccaggtacatatttaggaatgggaagctgggattatatgaaaggtaaatgtttaactttttaagagactgcctagctgatttccaaaaataattttaccatttttcatttccaccagcagggtataagacttgctgttctgctgcacttttgcccacacttggtatggccagtgttttacaattttagccattctggggctgggcatgatggctcatgcctgtaatctcagtgcctgggaggccaaggcgggagaatccttgaggccaggagttggagaacaacctgggcaacatagcaacaccctgtctctagaaaacaaaaataaataaataaaataaaatgaaaaattagcccacacaactgtagtcctagtaaaaggtgaagccagctggacttcctgggtcaagtggggacttggagaaattttctgtcttaaaagaggattgtaaaacgcaccaatcagcactccgtagctgagattgtaaaacgcacccattagtgttctgtagctagcaagaggattgtaaaatgcaccaatcagcactctgtaaaatgcaccaatcagcactctgtaaaacgcaccaatccgcactctgtaaaacatcctgatcagcaggatcctaaaagtagcccatcggcagggaggattgaaaaaagggcattctgataggacagaaatggaacatgggtggggacaaataagggaataaaagctggccacccctggagccagcagtggcaacttgctcgggtccctttccttgctgttgaggatttgttcttttgttcttcacaataaatcttgctgctgctcactctttgggtccatgccacttttaagagctgtgctgtaacactcaccacaaataccgcgaagatctgtggcttcattcttgaagtcagcaagaccatgaacccccaccggcaggaaccaaactccagatacactagctactctggaagctgaggcaggaggatcacttgagaccagaagttgcaggttacagcaagcttctgtcactgcactctagcctgggccacacagtgagaccctgtttctcaaaatgaaaattagcctttctagtggagatatagtggtatcttatagacgtttttgttttcgctgaagttttaatctgcatttccctaatgatagtgagattattttttcatgtccttatttgccacctgtagatcatctctggtgaaatctctgttcaaaattttgccctttaaaaaaaattaaactggccgggctcagtggctcacatttgtaatcccagcactttgggaggccgaggagggtggatcacctgaggtcaggagttcaagaccaccctggccaacatgatgaaaccccgtctctactaaacatacaaaaatctgccaggtgtggtgacatgtacctgtaatcccagctacttgggaggctgagacaggagaatcgcttgaacccgggaggcgaagaggttgcagtgagccaagatggcaccactacactccagcctgggtaacagggaaactccatctaaaaaaaataaaaaatgaactgtttgtcttactatgttataatagctgtaaatatgtattctaggtacgagtatatgttttggaaataatttccatttgtggcttgcttttccatttttgtaatttttttttcttttaaaaactttttattttaaaataactgtaggccaggcatggtggctcatgcctgtaatcccagcactttgggaggctgaggagaatgaatcacctgaggtcgggagttcgagaccagcctgaccaacgtggtgaaaccctgtctctactaaacatacaaaaattagctgtgcgtggtggtgcatgcctgtaatcccagctactagggatgctgaggcaagagaatcgcttgaatctgggagatggaggttgcagtgagctgagatcgtgccattgcactccagcctgggcaacaagagcgaaactctgtctcaaaaaaataaagtaactataactttttcggctggcaccatcttccagtaattcgccaaaatgacaaacacagagggaaagaggagaggcacctgatgtatgttctctaggccttttggaaaacatgccgtttttcctttggtcacgtatatgtgaatctataagaaaggtgatattgtagacatcaagggaatgggtactcttcaaaaaggagtgcccacaagtgttaccatggcaaaactggaagagtttacaatgttactcagcatgctgttggcattgttgtaaacaaacaagttcagggcaagattcttgccaagagaattagtgtgcatattgagcacagtaagcactctaagagccgagataacttcctgaaatgcatgaacttcctgaaatgatcagaaaaacaaagaagccaaagagaaaggtgcctgggttcaactgaagcgccagcctgttccacccggagaagcacactgtgtgagaaccaaccaatgggaaggagcctgagctgctggaacctattccctgtggattcatggcatcataggtgttaacaaaataaaagacttctggactgtgaaaatatttctcttcattgagtaagagtgtggtgtcctctcccccaaagaaatatttaaagcaaattttaactgggtcctaattcattctgtaatgtctttacttttcaaatttaatgtatttattgctgaaaaatgtgaggtagctttattgtgcaacatattactcgattggttagaaaatggccagataccgggtgtggtggctcatgcctgtagtgccagcactttgggagcctgaggtgggtggatcacgaggtcaggagttagagaccagccttgccaacatggtgaaaccacatcgctactaaaaatacaaaaattagccgggtgtggtggcgggcgcctgtaatcccagctgcttgggaggctaaggcaggagaatcgcttgagcccgggagacagaggttgcagtgagctaagatcactccattgcactccagcctggaagacagagcaagactccatctcaaaagaaaagaaaagaaaagaaaaaggccagatattatttatgaaatatttttactggtttgaagatattccctcatgggttccatcatggaagaaataaaataatttttaaaaataaaataactatagactcacatgaagttgcaaaatcagtacatagagtgccattacccttcctcatcttccctcaagtgttgctgcttatgtaactgcagtacaatagctaactcaggaaactgacatggtaccatcccggtaattagactacagacctcattcagctttcatgagttttgatatgtactcatttgtgtgtgtggttctttgtgatttaatctcgtgtatagaatgacgggaccaccgccacaatcaatatggaagtagttcatcaccatgaagacattccctgggctaccctttatagttgcactcacctcctgcaccccgcccctgtctctcagcaactattaatctgtactttatttctatagtttgatcattttcaagatgttatacagaatacggactcgtactacagtatgtaaccttttgttactgactttcttctagcaaacatggttgccttgagatcagtctaagtggttgaatggatcaagagttgctactttgtactgctgagtagtattccgctgtatggatgtatactgcatccagagtgtatatccagagattttttttttcttttgagataggtctcactctgctgctcaggctgaagtgcagtggtacgatctttttttttttattgttatcttttattttcatatgaaaaatagattttaagcaaaattcaaaaataacttgacactataaataaagagggccccttttttttgttttttgagacggagtctccctctgtcacccacgctgcagtgccgtggtgcgatctcggctcactgcaagctccgcctcccgggttcacgctattctcctgcctcagcctcccgagtagctgggactacaggcgcccaccatcaagccaggctattttttttttgtatttttagtagatacggggtttcgtcgtgttaaccaggatggtctcgatctcctgacctcgtgatccgcccgcctcggcctcccaaagtgctgggattacaggcgtaagccactgctcccggcaaagagagccttaagtacattcagtggtatgatctttaggttggctcactgcagcctctaccttcaggctcaaacgatcctctcacttcagtctcctgagtagctgggaccacaggggcatgccactgttacaagtagttagacaggcatgggtggggcaggagaggactcttttcccccacccactagaaatgtcaggtgatggtttgacaatattcacaatacctctctaaaaacaattcggcagccagcaccaaaaagagacaagctcctgctgatccacagctgttaaccttaaagtgttaattgaatgcaggcgctagggagaagcaaaaagggcttccaataaaatctcagggattgggccagtgagcctgggcatgcgcattaagagacaagatggcaaagtagggttttccaggagccgtctgccagaaaagggaagaaagcctcagatacaacttgctactaaacccactgtgggtgctcgcctcccacgggtgaggagggcagtgcatgcgggcagcccaccctgagggaagaatcatgggaaaggggcgcaggatgctggaggtgggccagcctataaagtcccagctgcaaggttcagcactgcacttgttcttcatgctgcctgtctgggtctcttccaagcataccttcctttctttcctgttctaaagccttttcaataaacttccactcctgttctgaaacttgcctcggtctctttttctgccttatgcccctcatttgaattctttcttctgaggaggcaagaatcgagggtgctgcagacctgtcaggattcgccgttggtaactcagataccggccgccggtaacaccaccacagctggctaatttttggtattttttgtagagatggggttttgccatgttgcccaggcttgtctagaatacctgagctcaagcgatcctctcgcctcggcctcccaaagtgctggattacaggcatgagctactgtgcccagccttatccagagatttttaaaccattcacctattgaaggactttttggttgttttttcggtttctgaatattattgttgacaaagaaaatcgaactccataaagtatttgaagacttttattctgagccaaatgtgagtgaccatggtctgcaacacagccgcaggagatcctgagaacgtggtcagtctacaggttggttttatacgttttagggagacttaagacatcaattaatacatgtaagatgtacgttggttgggaaagacgggacaactggaagtagaggtgggtgggatggggtggggttctgggtcataggccgattgaaggattttctgattggcaattggttgagagtttatctaaagccttggaatcagtaaaagggagtgaccaccgcactcccgtgatggcctggactagtgtttcaggtttattttagaaagcccttggccgataggaggggtccattcagttggttgaggggcttataattttatttttggtttacgttatgaataaggttggaagaacattcgtgcacaggttttttgtttgtttgagacaggttctggctctgtggcccaggctggagtgcaacggcatgatcacagctcactgcaacctccgcctcccaggctcaagcaatcctcccacctcagcctcctaagtagctgggactgcaggtgtgtgccaccatgcctggctattttttttttcttttgtatttttagtagagacggggtttcaccatgttgaccaggctggtctcaaactcctgagctcaaagcgatctgcctgcctcggcctcccaaagtgttgagattacaggtgtgagccagcacacctggctctgtgcacaggtttttgtgtgagcatgagttttcatttctttgggataaatgtccaagagtgtgagtgctggttgttttataggtacatgtttagtttataatgtaaaccaaaaataaagttctaaggcccccaaccatcaaagggacttcctcctcagccagagcactctaaaatttaatctgagagactggtcatgataggaagtgggagtcagacatgcttcattatacctctctggcattcacatcaacacagaccttaagtctgataagaaacatttacaatctattatctctgaagcctgttacctggagacttcatctgtgtgataaaaccttggtctccacaactcctgatcttaacccagacattcctttctattgataactctttcaaccaattgctaattagaaaaattttaaatttacctataacctggaattccactcccacacttcaagttgtcctgcctttctggaccgaaccaatgttatttcctaaatgtatttgattgaagtttcatgtcttcctaaaatgtataaaaccaacctacatcccgactcccttaggcaccatgttcaggacctcctgagggtcgtgtcatgggccatggtcactcatatttggctcagaataaatctcttcaaacattttacagagtttgactctttgttgacaataagaaaccatcgaattattttgcagactggctgtaccattttccattccagtttatttgcttctgtgccagcatttggtattatccctattttttatttgaactattctaataaatgtgtagtgacattttattctggcctccatttgcatttttctttctttctttgtttttttgagaagaatttcactctatcaccgaggctggagtgcagtggtgcgatctcggctcactgcaacctctgcctcctgggttcaagcgattctcctacctcagccttccaggtagctgggattacaggtgtgcaccaccacgcctggctaatttttgtatttttagtagagatgggggttttattatgttggccaggctggtctcaaactcctgacctcaggtgatctgcccgcctctgcctcccaaagtgctgggattacaggcgtgagccaccgtgctcagcctgtttgcatttttctaatggctgatggtgttgaacatcttttcatttgcctattttccatctctatctcccagactagtctattttctgttgctttaatgcgtaggggagccaaggggaaacatcccctttgccctcagaaggtttgctgaacaatcactgatatgaggcagattaataggagaaaaggcacacacatttaatcaacgtgtacctatgggagccttcagaacgaagactcaatctcccaataaggtatagaagcttccataccatcttgcagttacaataagattgggagcttggatcttggcaaaaacaggtcctgggagggagaaaggaagaggcctggctggcagaggtggccttgttatgccgacgaagccttacaggtagcagaactcagagagaatagatggtaaatggctgtgttcagacctttaaaggcgtcagagtgagttaatctctctttgatccaggaaagggctagaaagggaaggcctggcatttaggaagattttcttttcttttctttttttttttgagatggagtttcgctcttgttgcccaggctggagtgcaatggcgcaaacttggctcactgcaacctctgcctcccgggtttatgcggttcttctatctcagcctcctgagtagctgggattacaggtccatgccactgcgcctggctaatttttgtatttttagtacagatggggttttatcatattggtcaggctggtctcgaactcctgacctcaggtgatccacccacctcggcctcccaaagtgctgggattacaggagtgagccacagcacccggccttagggagattttctacagatgcaagagtcgcccccaaaagacagctttgcaaggccaacttagtctgctggccctgaggcagccatttcaaaatacggcaaacaaatatatctggggtaaaatattttgatttccttctacagaatccctgaaactgggtaatttatgaagaaaagaaacttgtatcttacatttatagagactgagaagtccaagttcgagaggttgcgtttggtgggagccttctggctggtggggtaattttgtgtctaagtttataagatattggcctatagttttatttttatttatttatgttttagtactgtctttgtccgtttgtgatttcagggtctcataaaatgagattggaagtgttcccaactcttctgttttctggaagaaattgtataaaattggtgttaattctttaaatgttttggagaacgctctggtgaaactatctgggcatggagactttttttttttttttttaatgagacaagattttgctctgtcacccaggcttgagtgctgtggaatgatcttggctcactgcagccttgacctcctcggttcaagtgatcctccctcctcagcctcctgagtagttgggactacaggcacatgccatcatgtccagctaatttttgtattttttgtagagatggggttttgccatgttgcctaggctggtcttggactcttgggctcaagtgatccacctgccttggcctgccaaagtgctgggattacgagcatgaactattgtgcctggcccctttttcaatttcattgaattctgcttttttttttttttttttttttttttgagacagagtctttctctgtcactgaggctggagtgcaatgggtgtgatcttggctctgccttggcctcccaaagtgctgggattacaggcatgagcccctgtgcctggctatgtatgttttattttatttgaggctttcttttttacttacgaattattcagaagtgtgttggttaattaccaagcatttggcgatttttcctgttttctttctgttattgatttctagtttaagtccattatggtcagggaatatactctacatgattttaattattttaagtttgttaagtttgctttatgacccaagatatgctctatcttgattaatattatataggcacttaaaaagactgtattctgctgttgttggctaggctgtcttataaacgtcagttaaatcctgtttgatagtgttgctcagtttttacatgtctgatactgtttggatgtttgtcctctccaaatctcatgctgaaatgtaatttccaatgttggaagtgggatctggtgggaggcgaattggatcatgggagcagatccctcatgaatgggcgaattggatcatgggagcagatccctcatgaatgggcaaattggatcatgggagcagatccctcatgaatgggcaaattggatcatgggagcagatccctcatgaatgggcaaattggatcatgggagcagatccctcatgaatgggcgaattggatcatgggagcagatccctcatgaatgggcgaattggatcatgggagcagatccctcatgaatgggcgaattggatcatgggagcagatccctcatgaatgggcgaattggatcatgggagcagatccctcatgaatgggcgaattggatcatgggagcagatccctcatgaatgggcgaattggatcatgggagcagatccctcatgaatgggcgaattggatcatgggagcagatccctcatgaatggcttagcaccatccccttggtgatgagtgagttctcaattagttcacatgaaatctagttatttaaaagtttgtggcattggctggacatagtggctcatgcctgtaatcccagcactttgggaggctaaggcagaaggatcacttgagctcaggagtttgagactggcctaggcaacatacccagacctcatctctactagaaatcaaaaacactagctgggcgtggtggtgtgtgcttggagtcccagccactcgggaggctgaggtgggagaattacttgagcccaggaggtagaggctgcagtgagctgtgatagtgccactgcactccagcctgggcaacagagtgagaccctgtctcaagcaaaaaaaaaaaaaaaaaaaatgtgtgtggcatctccctcctctctttcttgctcctgctcttgctgtgtgatacactggctcctcctttgccttctgccatgattggaagcctcctgaggcccttaccacaagcagatgctggcaccatgtttcctgtgcagcctacagaactgtgagccaattagacatttttaaaaataaattacatagtctcagctatttctttatagtaatacaaaaatggcctaatacaatgtccttactgattttctatctaatttctatgtatttccaactgtaactgtggatttgtctactcctttcagctcagtttttgcttcatgtattttggggctctgttgtttggtgcatatgtatttgggattgttttcttcctggtggattgattcttttatcattatacaatatcgctctttgtttccagtaattttttctctgaagtctactttatgtgatattaatatagtgactcctgattttttaaaaaataatgtttttatgctgctatgatttgaatgtctccttcaaaactgatgttgaaatgtaattcccaatgtggcagtattgagtggtgggacctttaagaggtgactggatcatgaggcctctgccttaatgaatggattaatgggttaatggattaatggtttatcatgggagggaaactggtggctttacaggaagaggaagggaaacctgggcgagcacattagcacctcagtccctcaccgtgtgatacactgcattgccttggggctccgtagagagtccccaccagccagaatgctctcaccagatgtgtcctcttgaccttgggcttcccagcctccagagctataagaaataagttttatttattataaattagtcagtttcagatatcccattataagcaacagaaaatggaccaaaatgcatatatcttttttcctcctttttcagcctacctatgttgttatgtttgaagtcagtaggtagcacatagttgggttgcgttttaaaaatcccctttgcaatctttgtcttaattggtgtatttgaactatttacacttaaaaataattactaatgtgagtttttgttggttttttttttttttttttgagacagagtctcgctctgtcacccaggctggagggcagtggcgcaatcttggctcactgcaacctctgcctctcaggttcaagcaattctcctgcctcagcctcccgagtagctggaactacaggcgtgcaccactacgcccagttaatttttgtatttttagtacagatggggtttcaccatgttggccagggtggtctcgaactcttgacttcaggtgatccacctgcctcggcctcccaaagtgctgaaattccatctactttggaggctgaggcatgagaattgtttgaacccaggatatggaggttgcaatgagctgagatcatgccactgcactccagcctaagcaacagggccagactcagtctcaaaataaataaataaataaataaataaataaataaataaataatataaataaataaataaataaagtttagtggttaggaatcttggtccaaaagaggttattattatgtgcatatttgaataagagagttaaggatcatctgtatttctaatatttcaatatttccaatatttttgtagtttttttttttttctgtgtcttttcctgtttccttttcttgctctcctctgggctacttaggggagtggtctacattacaatttctctatagttttttttttttaggagtttgggaggggaggttcaataggcaagagagagagagaaagacagagaaaggaaaaagagagagggggccgggtgcaatggctcaaacctgtaatcccagcactttgggaggctgaggttggtggatcacgaggtcaggagatcgagaccatcctggcaaacacggtgaaaccccgtctctactagaaatacaaaaaaaaaaaattagctgggcgtggtggctggcacttgtagtcccagctacttgggaggttgaggcaggagaatggcatgaacccaggaggcagagcttgcagtgagctgagattgtgccactgcgctccagcctgggcgatagagtgagactccatctcaaaccaaaaaaaaaaaaaaaaaaagagagaggggacttccaagaggaaagggccatatagttttttttttaaattagctttctatgtatactttttgtgtatgtggttgctctaggtatgacaatatacatatgcaacttatcacagttgactggtactgatattttaccattgcaagtaaaatgtagaaagcttattcccatttatgttcttttttcctcctcactttaaaaatataattgtattagtgtcacataaacacatttaggtcaactgaccacatatataacagctgtcccataagattatagtacctcttctatgtttagatatgtttaaataaacaaatgcttaccattgtgttataattgcctataatattcagtataatcacatgccattatactctatgatgtttgcacaatgacagaattgcctaatgactcatttctgagaatgtatccctgtcattaagtgacacatgactatgtttcctgtacatatattgagcatcacattagaccatttttaaaatcaaacatgattttaaaaactataaggacagttattatatttaaccctattttttaaaccaatttctttgttctttcttttctttttctttttttttttttgagacagggtctcactcggtcacctaggttggagtatagtggtgcaatctcggttcactgtaacctctgcctgttgggctcaagcaattctcccacttcagcctcccgagtagctgggactacaggcatgtgccaccacatctggctaacttttgtattttttgtagaggtagagttttgccaagttccccagtctggtctcaaattcctgacctcaagcgatctgcccgccttgacttccgaaattgctgggattacaggtgtaagccactgcgccccacctttcttttctttttgatattccaggattccttttgttgcacttactttttgttcagaaaataacttttgttgttgttgttttgaaatggagcctcgctctgtcgcccaggctggaatgcagtggcacggtctcggctcactgcaacctctgcctcccaggttcaagcgattctcctgcctcggcctcctgagtagctaggatcacaggtgcatgccaccacgcgtggctaagtttttgtatttttagtagagacagggtttcaccatgttagccaggatggtctcgatctcctgacctcgtgatctgcccacctcagcctcccaaaatgctgggattacaggcatgagccactgtccaattcccagagaatggcttttaagcgttctttaggagtaggtcagctggtgacaaatttgcttgtgctcctctgcctgacagacttaatttctcctcattcctaatggaaatttttattcgccatggagttgacattgatagtttttttcattcagcactggaaaatggttttgccacttcctccttgcctccatggtttcagataagaaatctgctgttgtttgacttttttaaaaatttttttgagatggagtctcgctctgtcgcccaggctggagtacaatggcacaatctcggctcactgcaacctctgtctcccaggttcaagcaattctcctgcctcagccaactgagtagctgggattacaggtgggtgccatcaccgtggccggctaatttttgtatttttagtagagacggggtttcaccctgttggtcaggctggtcttaaactcctgacctcgtgatcccccccacacccctgccttggcctcccaaaatgctgggattacaggcatgagccactgtacctggccgattttgttttttttttaagacggagtcttgctctgttgcccatgctggagtgcagtggtacctctgcctcctgggttcaattaattctcctgcctcagactcctgagtagctgggattacaggcaggcgccaccatgcctggctaattttttattttttgtagagatggggtttctctatgttggtcaggctggtctcgaactcctgacctcaggtaatctgcccgcctcagcctcccaaagtgctgggactacaggagtgagccaccatgcccagcgtaattttttgtatttttagtagagacggggtttcaccatgttagccagaatgatctcgatctcgtgacttggcgatctacccgcctcggcctcccaaagtgctgggattacaggcgtgagccaccgcgcttggcccaggggaggtgatttttaaaaaggttgagaaacattggtttaacctaaatattatttactgttacctgttttttgaatcgtatataactggagtcctctgcagcaggcagttttgagggtcacgcatgcctgtgcattcattccttttccttgctgtctacttaccagtttcttacctgctccctccagtgaatagccacttggattgttttcaggtttctgctttacagacaaggctcctgcacacattcttctatgtgggtcctggcccacatgtgccagggtctcccgggtgtatacactcagaggagtgggcttgcagggccctaggaaagcagctttactggttgcccacatttactgggtcctgccaatctgtgtttcaaagtcagtgcacagtttacattcccgccagttgtgtatgcaagttcctttttctctaagtcttccccaacactttatgttgacaagagattttaaattttgctgatttagtgggtgtggaatggcatgtccttgttttagtttacatttcgttgataataaatgaagttggacatcttttcacacatttaatgggcctcctggttgctctctaggaagatctgttctgggttttaattctttgagttttgcctttttcctcttagttaataaacgaaaaacaaatacataaaaaatatatagtctcgatatgactccttttcaggtatatgtattgccaataatatcttttttccagtttgttgctttttttttattctctttgtgttgtcttttttttttttttgagatgagcctctctctgtcacccaggctggagtgcagtggcgcgatcttggctcactgcaacctccacctcccgggttcaagtgattctcctgcctcagcctcccgaatagctgggtttacaggcgccagccaccgtacccagctaatttttgtatttttagtagagacggggtttcaccctgttggccaggatgatctcgatctcctgacctcgtaatctgcccgcctcggcctcccaaaatgctgagattacaggcgtgagccaccacaatcggcctgtggtgtcttttttttttgaaacagagtcttgttctgttgccaggctggagtgcagtggcacaatctcggctcactgccacctccgcctcccaggttcaaactattcttctgcctcagcctcccgagtagctgggactacaggctcgcgccaccaaacccggctaattcttgtatttttagcagagaccagatttcaccatattggccaggctggtcttgaacctcctgacctcgtgatccgtccgcctcggcctcccaaagtgctgggattacagatgttcgccacggcgcccggccctgtggtatctttttttttgagatggagtctcactttgtcacccagcctggagtgcagtggcgcgatctcggctcactgcaacctccgcctcccgggttcaagctattctgccttagcctcccgagtagctgggactacaggcgcgcaccaccatgcccggctaattcttgtatttttagtagagaccggctttcaccatattggccaggctggtctcgaactcctgacctcatgatccaccggcctccgcctcccaaagtgctgggattacaggtgtgtgccaccgcacccagccctgtggtgtctttttaaacaacagaacttggggctaggtgtggtggctcacggttgtaatctcagcactttgggagaccggggcaggaggagtgctcgagcccaggagttggagaccagcctgggcgctctcacagctcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctgggcgctctcacagctcactgcagcctcgacctcctgggcacaagtgatcctcctgccacagcgcctcccaaagtgctgggattacaggcgtgggccaccgcgcccggctaaaaatcagtcttttcctttggcttctggtctcttcgcctcgtttaagaactcctagctgcggccgtccggactctccctggtgctggtggaagtttctggggcgcactctcatgttgctgcctggggagtcttgcaccccacaagtgcgcctctctcctcccgcgtgaggctggggggccggcttggttgtgcaggggagaggaggcccaaggggctgcgcccggtcacccgcgcgaccaccgcgggccgaggcgggacgcggcggcgggctgtggcggagtcaccttgcgctctacctccctgctcttcccttccaggcgagcttggggacgaggaaggccgagcccggcggcgcggcccgagcgcccgcttcctcgccagcattgggttccctgaggggccgccctgccccgcgtcagcctctgcagcctccaaccctcccggggagcacagcgggacgctggaagccccactgccttaggaggccgttctcgggagggccgccccgtttagaagatgggaaaggtgcagaaaaagaagaccaatagacgatgtccccactcgcacacagggccaggttccctgcccgccctgcccttcgctctcccggcggcgacggccgcgcgacctttccggggacggtctcgggagtgccatggggtccctggggctcggatctcggcgcccgcgtctccgccgggggcgaccccacagccaggctccttcttcggcacagaacccgcctcggctaccggcctccagccccctttctaaattcctgccggcctcggggttcgggtgacagggcccggggactgggtggcgaggagagaggacaggtttcctccggtcgggcggggtggcgcggctgcgcgaggggttctgtttggagggcagcgcggagccctctgctggccgcggtggggaccgctggctcccctgaagtcaccaggccggcgacgctgcagccagtccttcctcgtcctccttcctccctgtgcaaaggtgggctcagtaccacgtggaaatcaccgtggcacaggcaccaggtgggtgggtttgagaagctgtgcagtgtccaacatcctgttacaaaggaattgcaggtatttaagaattaaagaaaaactattctcttttctacttacgtgtatcactttctcaaacgccagctgagtaattagcatatacgtgcttgttgggtggcttggacctaactacttaataaatgcacctgccaggtgttgcctgcgcctaggaggccctgcaaattttcgaagacacggagggctccatgaactgaagttgggaactggaggttcccaaatttaaacattaacatcttcctcaggagggtggccacaggtgcattttggcagttccctttggtcaggcgggacaccagaggggcctgatgtcaggcaggaactggaaggggtggatgtctaagctacctttgccctgctgaaccctgatgggcagcatttcttttctgaaagcaaaactcaaaagaagaattcaggcgggatgtgaactcacccctgtaatctcagcactttgggaggccaatgcgggcagatcacctgaggtcaggagttcaagaccagcctggccaacatggtgaaaccctgtctctacaaaaatacaaaaattagccaggcatgatggcaggtgcctgtaatcccagctacttggtaggctgtggtgggagaattgctggaacccaggaggcataagtggcagtgagctgagatcgcgccattgccctccagcctgggcaaatagagtgagactccgtctctaaaaaaaaaaaaaaaaaaaaaaaaagaggaattcaggtgtgcattttgtctatacccacgtggtgttgaccagcctgtgaagtgtacttgggcctgagaaaaattggagaaacaacaggacatggatttgctgaaggcttcacactgagctgtgttgattgtgtggggactccatgaggccggtgatagcctggcacagctggaaggccctgtgtccacagcacgaaaaagctcaggtcttcccagggccagacatcaggccatgtggaaagcagcagggcagcatctgttgaaatttaacatgcctctgtcttcgggccagcagccccactctgggcaaccagacgtagaaataaagcacaagtgagtgaggctgtgtacagggactttaccatggggccccaaattggtaacaaagtgactgtttgtcacccagggctgggtgagtaaattgcagtcccttacagcatggaatattgtgcagccacaaaaaggatccagtgaggctgtgagcagtagatttcacagggatttctacaaggcatcattgactgagaaaatcatgatacagaaaaatgtgtgaaacaagatgccactgtgcaatgaattaactgaatacctctatgtatgcatatgtgtagaggtatatacgcatcaatatgcacacgtgtgcttgattattatatgtaaggataaaggaaaatacggagaatagatggaatacaaattaggttattgacagggtatctgggtggtaagacagagatgggagaggaaaggggagtatacagccaagaaaagaaagaaatgaagactaattaaagtaaattaaagcaaagttcttgcttatctatttctataaggtgttacacacatacacacatatatatgcgcacatatacacacttcaatgtgtatacagatatgtttatgacagagggagattacacacagttctgtggcaagacatagtggcatgagaaaaaaaccattatttttctttcaaaataaatgtatgatggccatggagtctgtgggtcaggcgctggggaaaagttcagctggagtttccacttggagtcagatgccatccaaaggcttacctgtgctggggacccccgttccaaggtggagcctcacacagctggcagtgtggtgttaactgctggcttcttcatggggctacttgatgtcttcgtggcagtgctgggcagccgcaggtgaaccgtggtagacagatagtagccatagatagggcaattgaatgcgtgtggctgtgggctttagtttgctgacccctgacgtagccttggagccatggttaagactttgactttttctttgagagacatggagaggcgctggggagcttgagcaaagaaataacctggcttggctcagttttttttttttttttttgagacagagtttcactcttgtttcctaggctggagtacaatggcacgatctcggctcggtgcaatctgcgcctcctgggttcaagtgattctcctgccctagcctcctgagtagccgtgcaccaccacgcccagctaattttgtatttttagtagatacagggtttcttcatgtcggtcaggttggtctcgaactcccgacctcaggtgattcactcgcctcagcctcccaaagtgctgggattacaggcgtgagccactgcacctaggcctggctcagttttaagaggggcactctggctgctgtgtgggggtcacacagaggggccaagagggaagccagaagaccggggtgggtgtgatcttgctgtgatcttgggggacaagggtggtgaagatggggtgagaaggggctcctggatgtactttgagggtagactcgggttggttgattaattcatttactcaggaagaaacacaaatcaaaatgctctgttacagttggccccatgtggtcatcctgaactcagctcagatggccaagaagctcagggggtgagtgtgaggtggctgctcgcgagtggggcggggcagccgcagccagggagatggagtgaggtggagcaattctacctaacagggaggccggtgtctggggagagggcctggggccaggctgccctagtgctgagggctggtttgccagctgtgtggggtccaaggagcaggcagccattctgtcaagggctggccatctgtggccatggagcacagtggcagggctgtccagcttggacaagccacagttggccgatcctcgactcttacgcactgctctgtacaaagaaatatgtagatacataaattaaaatgaagctgtgggttttgtgattcaagctggtgattcatgttctgccactgctggtcagtgctgtgtttaagtaaaaatgcaggtccagcattttttcccaacttcttatcctgacaattttctgacatggagaaaagttgagaaaatagttgaacatccatacacccacaacctagattcagcacctaacttttgccatagttgattcatctatatatttttttaacccaatcccagatataatgaggaggttgaacaagaactattgctcaacaaatgtcagctttccccagttatctaataaaaaaagttattggtgaaaataagatgtgacatagttactttaggattttgctcttggtatttatataacagtctgaggccttgatttgaaccttcctggtgagcgattgaatgaatatacaaacagacaatggccagagcatgtataaaaatagaactcagacccgcaatctgcagcaaccaggccaggaaactgacccattatctgcaggagccagcccaggaagccagcctgctgcctatatgtcagtctgatagaaagttggcccaccatctctagcaaacagtccaggaagctacacaatgacacctgtgacaatcagccccaaatggccaggattaatgactgcctgcctctgtaatttaattttttttttgagatatagtctcattccatcaccccagctatagtgcggtggcatgatcttggctcactgtaacctccacctcctgggttcaagcaatttttctgtctcagtctcccaagtagctgggattacaggcacatgccaccatacccagggaattttgtatttttaatagagatggggttttgccatgctggccaggctggtcttcaactcctgacctcaagtgatccacccacctcggcctcccaaagtgctgggattacagcgtgccaccacacccggctaatttttgtatttttagtagagacagggttttgccatgttggccaggctagtcttgaactcctgacttcaagtgatccacctgcctcagcctcagcctctgtaacttttgtccccccttttaacttaggaccagccaaagaaaaccaagtatttgcccctaaccaaaatcccataaaatgccctcttctagttagctgcctccagtttctccatgccggcagcatccatcagggcacccctgaagcctccctttttccaccatgaggcttcccctcctcagcctgcctttgagtctctgccaaacaaaagtgacaatggccgactcccttgctagagcaagctctgaatcaatagccttgctgttctcatttggctggtctttgtatatttccacaatgggattataattttcttctgcatgaaattttctgagtaaatctaccttttaaagccagggaaaaaatggtggtttccaaattggatctagaggcctggaagatgagcagatgttgtgggcagcgtgcggtgggaaggaactggatttggaggtgggggttcagaagggacctcactctcccaggcaaggggcagagggacgacctggttgagaggaacatggaacatagagccaggtgggggaggccgggccctgtggatgcaacactctcctgcattccagcctcccacccccgatcctagcagttcagagcaaacctcaggctgcgtgggcactaaagttagtctgctcaggctgccagaactaagaccatagactgggtgaattcaacaacaggagtttatttccccaaagctctggagactggaagtccaagatcaaggtgtgagcaggtttggtttctccggcgccttccttccttggctggtagacagccatcttcccgctgtgtccgcacgtggtctattccctgtgcacacccctccctgctgtctctttctcttcttataaggacatcagtcctgttgaattagggccccatcttatgacttcatttaaccttaattacctctttttttttttttttttttaaagatggagtctcgctctctcgcccaggctggagtacagtggtgtgatctcggctcactgcaagctccgcctcccgggttcaagcgattcccctgcctcagcctcccgagtagctgggattacaggcatccaccaccacatctggctaattttaattacttctttaaaggccctgtctttgaataccattacattctaaaatactggggaatagagcttcaccacaggaattttgggggaacagaattcagtccataacaggtggtcagagacatcttcccaaggtgtccatgagcaatcctggttccttttttatttcttattctgagacagggtctcactctgtcactcaggtggagtgctgtggtgcaatcagggctcacagcagccttgaactcctgggctcaagcgatcctccagcctcagtctcctgagtagctgggactacaggcgcgcgccaccacacctggctaattttcaaatttttttgtagagatgaggcctctttatgttcctcaggctggccttgaactcctggcctcaagtgatcctcccaccttggcctcccaaagtgtcaggattacaaacgtgagctaccatgcctaactagcagtcccagttctgaggacttggcactcatgggtttatgctctgccaccttctagatagcagattgtcccactgcctggagtggctgctctctctctggtcctagtggagtggtattctatagaaccagtgtccttactttacgtccctagtgggcttcctgactatagtgaaccccaggctgtggcatattttgtggacaagtgagtctatgccttttgcacttttcagggagaagatgaacgacgttcactttattctccaagggaaaatcgatagggaccattgctccaggtggctggggctggtgagtcgacatgaagccccggaaggagtaaggctgtgcatggggtcctttagaacgctgcgtggtggaggacagaatctctgacatgcctgtggtacagagatgtcagaaacacacttgggcgttatacacaaggcactttaaaagccattattttaggctgggcacagtggctcacacctgtaatcccagtactttggtaggccaaggtgggtggatcatttgaggtcaggagtttaagaccagcctggccaacatggtgaaaccccatctctactaagaatacaaagattagccgggtggggttggctcaagcctgtagtcccagatgcttgggaggctgaggctggagaattgcttgaacctgggaggtggaggttgcaacgaggcgagatggtgccattgcactccagcctgggtgacaagacaaaattctgtctcaaaaagaaaaaaaaatccattactttatatgatcctcacaacaatccagggtgaggcaggcagctgttactgatagaccccctgagacccctgtttcaaaggaggaagtaggctcacagaggttataattggcccagggtcatcccaccaggagcctagagctgctggc

SEQ ID NO: 12822 - DNA, 256171 bp, Human
  misc_feature (1)...(256171): n = A,T,C or G
gaaatgaagtgcatttgccttagctttctacattctttccataaagcaagggttcttcaatcttcatggagtccccaaataacatgtgaatgtgaagtattgtgctaggtactgcacgggatgccaaagatgaacaaggcatgagttctgggggaatatactatctctcacaggagaaataagtaagtagcgtactcaagtattaaagtgagaacttaagtgctatatggcagttacaataaagaggaaatttaaagtaaggatagatcataccaagtaggataaatcaggaaatgaaggctaaactttggaagtgagaaattattctggaaattcgtggaactgcttagcggaatagggttttctaaggaagggtactgactaagcaaatgaaacgaaaaaagggaatgactatgtttccgcaacttcaagagatccagcttccctgcagggcaaaggagtaacaggagagaaaaaaagcaatgaatccgtgcatccgctaaactcttttaccatatattttactctgacaaaacaactatcacgtattggccttttgtttgtttgtttttttgagacacggtctccctctttcgcccaggttggagggcagtggcgcaatcaccgttttctgcagcctctacctcctcggcttaagctaccttcccgcctcgaccttccaaagtgctaggactacaggcgtgagccaccatgctcaggcttattggcacttttctgtgcacttttaaatgtaatcctctaaatcactcttctccacctttcctgtgcataggaatcacctgtggttcccgttaaattggagatcttgattcattaggtctggggcggggcctgagcttctgcatttccattgagctcacagctgaagcctaccctggaccacaccttccaatggaaaaggctccagtgtgatttctagccactagtattatctgcgaacttgggagaaataaaatgcaagttctcggcccccgcaagggctctactgaatccgaaacactgtggggaggcccaccactctgcagtgttttaacaagcaagtggttaaagtttgagagccacccgtaagtcacgggtttcctaacatgattggacactggaatcacctgcggatttttttttttttttttttttttttttttttttttttttgagacggagtctcgctctgttgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcctgcggattttaactaatactactgatgccgcatctcaccccccctcccgagattctcaggtacggggcgtggccttggcggcggccttataaaagctctcccaggtgattccaacctgtagtaacacttgagaactgcgtgaggtggggacttcaactttaactggacttattttcctcctatgtaaaaggtggacaatatgcaagtggtcctgactttgcttccagattttggcaactccagagccctagttcggtctggagagccagcttcccgccccgtgtcctaaggcctctgtccgagaacccaaagtcctgggaatggacccgcgggagcggacccgcgggagcatctgtgacgccgctcagcaacccggcgccgccccggcggctccgacgtggcccagtgtccggctggcgtgggctctccaggccgcacccactaaaccgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaaggtgggtgcgggccgggccctcgtccgggcgggtgtgggcgcgctgccaccctcagccgcgctttcttcgtgctcgcagcgggtgtctggctcccacccgggttctccagacgcccccgctctggccctgagcatcaccacctccttccttcccgacccggggcggcttctcggttcccgtgcagcactcacttgcagttcctttccccctcagtcttactttacctacgatttttaaagcttccctgctctgctttaatacgttgggatgtattagcatttacgcgtggcacttaacgcaagagcttctactggggtaggcagttctgttcagacagtgcttaaagtacctagtttcgtaatgatgacatcataccatcagctcctaggcttactatggggagggcagcttcctgcaaggtaatatttttcctgtatctcttccaacggaattagttcatgacctgtcatttactctgcagaacaaaacttgtagctattgcattttgccctttagtattctagttgagtaaaattagaaagttctttctcttagcaaaaatgaagttttacaccaatgacttaatggctgttcaccacagcaacagtgtgtgtccctaaaaagagactccatgactccacataagttcatgtatttgatgctaaaagttctttttttttttcatttctatagtttattggggaacaggtggtgtttggttacatgagtaagttctttagtggtgatttctgagattttggtacacccatcaccccatcagtatatacactgcacccaatttgtagtcttttatccctcactcccttctcaacctttcccccgagtccccgaagtccattgtgtcaatcttatgcctttgcatcctcatagcttagttcccacatatcagtgagaacatactatatttggttttccatttctgacttacttcacttagaataatagtctctaatctcatccaggttgctgtgaatgccattaattgattcctttttatggctgagtagtgttccatcatatatatgccacagtttatccactcgttgattgatgggtatttggattggttccacatttttgcacttgtgaattgtgctgctataaacatacttgtgcaactatctttttcatgacttcttttcctctgggtagatacctagtagtgggattgctggatcaaatggtagatctactcttagtactttgaggactccccacactgttttccatagtggttatactagtttacattcccaccagcagtgtagaagtgttccctgttcgctgcatccacgccaacatctattatttatttttatttttttattatggccattcttgcaggagtaaggtggtatcgcattgtggttttgatttgtgtttccctgatcattagtatgttgagcattttttcatgttagccatttatatatcttttgagaattgtctattcatgtccttagcccactttttgatgggactgttttttttttcctgctgatttgagttccttgtagattctggatattaatcctttttcagatgtatagattgtgaagattttctcccgttttgtgggttgtctgtttactctgctgactattccttttgccgtgcaaaagctgtttagtttaattaagtcccagctattttttttattattatactttaagttctagggtacatgtgcacaacgtgcaggtacatagatatacatgtgccatgttggtgtgctgcacccattaactcatcatttacattaggtgtatctcctaatgctatcccccgctcccccaaccccacaacaggccctggtgtgtgatgttccccattgtgtgtccaagtattctcattgttcagttcccacctatgagtgagaacatgaggtgtttggttttctatccttgtgatagtttgctgagaatgatggtttccagctgcatgcatgtccctacaaaggacatgaactcatccttttttatggctgcatagtattccgtggtgtatatgtgccacattttcttaatccagtctatcattgacggacatttgggttggttccaagtctttgctattgtgaatagtgccgcaataaacatgtgtgtgcatgtgtctttatagcagcatgatttataatcctttgggtatatacccagtaatgggatggctgggtcaaatggtatttctagtcctacatccttgaggaatcgccacaatgtcttccacaatggttgaactagtttacagtcccaccaacagtgtaaaagtgtccctatttctccacatcctctccagcacctgttgtttcctgactttttaatgatcgcccttctaactggtgtgagatggtatctcattgtggttttgatttgcatttctctgatggccagtgatgatgagaattttttcatgtgtctgttggttgcataaatgtcttcttttgagaagtgtctgttcatatccttcacccactttttgatggggtcgtttaatttttttcttgtaaatttgtttaagttctttgtagattctggatattagcccttggtcagatgggtagattgcaaaaattttctcccattctgtaggttgcctgttcactctgatggtagtttcttttgctgtgcagatgctctttactttaattagatcccatttgtcagttttggcttttgttgccattgcttttggtgttttagacatgaagtccttgcccatgcctatgtcctgaatggtattgcctaggttttcttctagagtttttatggttttagatctaacatttaagtctttagtccatcttgaattaatttttgtataaggtgtaaggaagggatccagtttcagctttctacatatggctagccagtttttccagcaccatttattaaatagggaatcctttccccatttcttgtttttgtcagatttgtcaaagatcagatggttgtagatgtgtggtattatttctgagggctctgctctgttccattggtctatatctctattttggcaccagtaccatggtgttttggttactgtagccttatagtatagtttgaagtcaggtagcgtgatgcctccagctttgttctttttgcttaggattgtcttggcaatgcgagctctcttttgtatccatatgaactttaaagtagttttttccaattttgtgaagaaagtcattggtagcttgatggggatggcattgaatctataaattaccttgggcagtatggccgttttcacgatactgattcttcctatccatgagcatggaatattcttccatttgtttgtgtcctcttttatttttttgagcagtggtttgtagttctctttgaagaggtccttcacatcccttgtaagttggattcctaggtattttattctctttgaagcaattgtgaatgggagttcactcatgatttggccctctgtttgtctgttattggcatagagcaatgcttgtgatttttgtacattgattttgtatcctgagactttgctgaagttgcttatcagcttaaggagattttgggctgagatgatggggttttctaaatatacaatcatatcatctgccaacagggacaatttgacttcctcttttcctaattgaataccctttatttctttctcctgcctgattgccctggccagaacttccaacactgtgttgaataggagtggtgagagagggcatccttgtcttgtgccagttttcaaagggaatgcttccagattttgcccattcagtatgatattggctgcagatttgtcataaatagctcttattattttgagatatgtcccatcaatacctaatttgagagtttttagcatgaagggctgttgaattttgtcaaaggccttttctgcatctattaagataatcatgtggtttttgtctttggttctgtttatatgatgaattatgtttattgatttgcatatgttgaaacagccttgcatcccagggatgaagcccacttgatcatggtggataagctttttgagatgctgctggatttggtttgccagtattttattgaggtttttgcattgatgttcatcagggatattggtctaaaattctctttttttgttgtgtctctgccaggctttggtatcaggatgatgctggccttataaaatgagttagggaggattccctttttttgtatcaattggaatagtttaaagaaagaatggtaccagctcctctttgtacctttggtacaatttggctgtgaatctgtctggtcctggactttttttgtttggtaggctattattgcctcaatttcagagcctgttattggtgtattcagggattcaacttcttcctggtttagtcttgggagggtgtatgtgtacaggaatttatccatttcttctagattttctagtttatttgcgtagaggtgtttatagtattctctgatggtagtttggatttctgtgggattggtagtgatatcccctttatcattttttattgcatctatttgattcttctcttttcttctttattagtcttgctagcggtctatcaattttgttgatcttttcaaaaaaccagctcctgaattcattgatatttttttgaatggttttcttgtgtctctatctccttcagttttgctctgatcttagttatttcttgccttctgctagcttttgaatgtggttgctcctgcttctctagttcttttaatttgatgttagggtgtcaattttagatctttcctgctttctcttgtggacatttagtgctataaatttccctctacacactgctttaaatgtgtcccagagattctggtatgttgtgtatttgttcttattggtttcaaagaacagctttatttctgccttcattttgttatgtacccagtagtcattcaggagcaggttgttcagttttcatgtagttgagtggttatgagtgaatttcttaatcttgagttctagtttgattgctgttgtctgagagacagtatgttataatttctcttcttttacatttgctgaggagtcctttacttgcaactatgtggtcaattttggaataagtgcggtgtggtgctgagaagaacgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaaatctctttctaggtctctaaggacttgctttatgaatctagttgctcctgtattgggtgcatatgtatttaggatagttagctcttcttgttgaattaatccctttaccattatgtaatggccttctttgtctcttctgatctttgttggtttaaagtctgttttatcagagactaggattgcaacccctgcttttttttgtttcccatttgcttggtagatcttcctccatccctttattttgagcctatgtgtgtctctctcacatagcaaggagctgcgttcctttggaggagaagaggcactctgatttttagaatttgcagcttttctgctctggtttctccccatctttgtggttttatctacctttggtctttgatgatggtgacgtacagatgggattttggtgtggatgtcctttctgtttgttagttttacttctaacagtcaggaccctcagctgcaggtctgttggagtttgctggaggtccactccagaccctgtttgcctgggtatctacagcagaggctgcagaacagcaaatattgcagaacggcaaatgttgctgtcttattgttcctctggaagcttcgtctcagaggggcacccggctgtatgaggtgtcagtcggcccctactgggaagtgcctccccattaggctacttggggttcagggatccacttgaggaggcagtctgtctgttctcagatctcaaactccgtgctgggagaagcaccactctcttcaaagctgtcagacagggacatataagtgtgcagaagtttctgctgccttttgttcagttatgccctgacccccagaggtggagtctacagaggcaggcaggcctcctggagctgtggtgggctccacccagttcaagcttccagactgctttgtttacctactcaaacctcagcaatggcgggtgcccctcccccagcctcactgctgccttgcggttggatctcagactgctgtgctagcaatgagggaggctccgtggacatgggactcttcaagccatgcgcaggatataatctcctggtgtgccgtttgctaagaccgttggaaaagcgcagtattagggtaggagtgacccgattttccaggtgccatctgtcacggcttcccttggctaggaaagggaattccccgacctcttgcactttccgggtgaggcgatgccttgccccgcttcggctcacactctgtgggctgcacccactgccctgtacccactgtctgacaagccccaatgagatgaacctggtacctcagttggaaatgcggaaatcacctttcttctgcatcgctcatgctaggagctgtagactggagctgttcctattcagccatcttggaacctctctcctatttatctttgtttttattgcatttgctttggggttcttggtcatgaaatccttgcctaagccaatgtctaaaagggtttttctgaggttatcttctagaatttttatagtttcaggtcttagatttaagtccttgatccatcttgaattgatttttgtataacgcgagagataagaatccagtttcattctcctacatgtggcttgccaagtatcccagcaccatttttttgaatagagtgtcctttccccactttgtttttgtttgctttctcgaaggtcagttggctggaagtatttgggtttatttctggattctctattacgttccattggtctatgtgcctgtttttacaccagtaccatgctgttttggagactatggttttatagtatagtttaaaatcaggtaatgtgattcctccagatttattctttttgcttaatcttgctttggctgtgtgggctcttttttggttccatatgaattttaggattttttttctagttttgtgaagaatgatggtggtattttgatgggaattgcattgaatttgtagattgcttttggcagtatggtcattttcacagtattgattctacccatccatgagcgtggggtatggttccatttgtttgtgtcgtctatgatttctttcagcagtgttttgtagttttccttgtagagatctttcacctcatttgttaggtgtattcctaagcattttatttttgttggagctgttgtaaaaggggttgagttcttgattagattctcagtttggtcgctgttggtatataagagagcaactgatttgtgtacattaattttgtatctggaaactttgctgaattcttttatcagttcttggagctttttggaggagtctttggggttttctaggtatataatcgtatcatcagttaacagcgacagtttgacttcctctttactgatttggatgccctttatttctttctcttgtctgattgttctgactaggacttccattactatgttgaatagaagtggtgagagtgggcatggttgccttgttccagttctcagagggaatgctttaaacttttccccattcagtattatgttggctgtgggtttgtcatagatggcttttattacattgaggtatgtcccttgtatgccgattttgttgagagttttaatcataaaggggtgcttgattttgtcaaatgctttttctgcgtctattgagatgatcatgtaatatttatttttaattctgtttatctggtgtatcacatttattgacttgcctatattaaaccatccctgttatgaaacccacttcataatggtggattatctttttgatacattgttggattcggttagctagtatattgttaaggatttttacatctgtgttcatcagggatattggtatgtagtttccttttttggttatgtttttttcctggttttggtattcggatgatactggcttcatagaatgatttcaggaggattccctctttctgtctcgtggaatagtgtcaataggattcgtacgaattctttgaatgtctggtagaatttggctgtgaatatgtctggtcctggacgtttttatgttgacaattttttattacaattttaatctcgctgcttactattgttctgttcagggtatctaattcttcctgatttaagctaggagggttgtatctttccaggaatttatccatctcctctaggttttctactttatgcatataaagttgttcatggtagccttgaatgatcttttgtatttctgtggtgtcagttgtaatagctcccatttcatttctaattgagcttatttggattttctcttttttcttcttgtttaatcttgctaatggtctatttatgttatcttttcaaagaactagctttttgtttcatttatcttttgtattttttgtttgtttcaatttcatttagttctgctctaatcttggttatttcacttctactgggattgggtttggtttgttctgtttctttagttccttgaggttagaccttagattgtctgtgcaccttcagactttctgatgtaggcatttagggctatgaactttcctcttagcagagcctttgctgtatcccagaggttttgataggttgtgtcactgttgttgttcggttcaaaaacattttaaatttccatcttgatttcattgttgacttattcaggagaaggttatttaatttccatgtatttgcatggttttgaaggttccttttagggttgattttcagttttattccactgtggtctgagagagtgtttgatataatgtcagttttcttaaatttattgaggtttgatttgtggcctatcagtggtctaccttggaaaaagtttcatgcactgatgatgaatagaatgtatattctgtggttgttgggtagaatgttctgtaaatatctgttaagtccattttttccagggtatagtttcaatccattgtttctttgttgactttctgtcttgatgacctgtctagtgctatcagtgcagtattgaagtctccaactattattttgttactgtgtatctcatttcttaagtctagtagtaattgttttataaatttgggaactccattattgcatatatatttcagattgtaatatttccgtgttggacaaggccttttatcattatataatgtccctctttgtctttttttaactgttgttgctttaacatttgttttatctcatataagaatagctactcttgctcgcttttggtgtccatttgcatggaatatctttttctacccctttaccttaagtttatgtgagtccttaggtgataggtaagtctcttgaagacagcagatggttggtgaattcttatccattctgcagttctgtatcttttaagtggagcatttaggccctttacattcaatgttagtattgagatgtgaggtaccattctattcattgtgctatttgttgcctgtataccttgtttttttaattgtatttttgttttataggtcctgcgagatttatgttttaaagaggttctgttttgatttattcccatgatttgtttcaagatttagagctccttttagcagttcttgtggtgctggattggtagtggcaaattctgtcagcatttttttgtctggaaaagactgtatctttccttcatttatgaagattagttttgctagatacgaaattcttgactgataattgttttgtttaagaggcagaagatagggccccaatcccttctagcttgtagggtttctgctgagaaatctgctgttaatctgataggttttcctttataggttagttacctggtgtttttgcctcacagctcttaagattctttccttcatcttaactttggataacctgatgactatgtgcctaggcaatgatctttttgtgttgaatttcccaggtgttctttgagcttcttgtatttggatgtctaggtctctagaaagggtggggaagttttcctcaattattcccccaaatatgttttccgaacttttagatttctcttctttctcaggaatactgattattcttaggtttggtcatttaacataatcccagacttcttggaggctttgttcatattttattatccttttttctttgtctttgttgtattgggttaattttaaaaccgtgtcctcaagctctgaagttctttcttctgcttatttgattctattgctgaaactctattttacatttctataagtgcgtccattgtttcctgaagttttgattgtttttatttatgcaatctatttcactgaagatttctcccctcctttcttgtatctttttttttttatttccttaaatggggctttgcctttctctggtgcctccttgattagcttaataactgaccatctgaattcttttcaggtaaatcaggcatttcatcttagtttggatctattgctggtgagcgagtgtgatttttttggggggtgttaaagaaccttgttttgtcatagtactagagttggttttctggttccttctcatttgggtaggctctgtcagagggaaggtctagggctgaaggctgttgttcagattcttttgtcccatagaggtgttcccttgatgtagtactctccttcttttcctacagatgtggcttcctgacagccaagctgtagagattgttctggatctagccacctagtaggtctaacaggctccaggctggtactaggaattgtctgcacagagtcctatgatctgaactgtctatgggtctcttagctgtggataccagcacctgctctgctggaggtggcaggggggtgaaatggactctctgagggtccttactttttgttgtttaatgcactatttttgtgctggttggcattctgcagggaggtggccttttcaatagagcatcagctgtggtagtatggggaggatcaggcagtgggtgggccctggaactcctaagagtatatgccctttgtcttcagctaccatggtgagtagggaaggaccatcagataggggcatttctagggcatgtctgggctcagactgtccttgggtgggtcttgttgcaactgctgtgggggatgggggtgggattcctaggtcaatggagttatattcccaggaggattatggctgcctctgctttgtcatgcaggttgtcagggaagtgggggaaagcctacagtcacaggcctcacccagctcccatgcaacccaaaaggccagtctcactccctctgtgccccacccaacagcactgagtctgtttccaggcggtgggcgagcagggctgagaacttaggtggtgggcgagcagggctgagaacttgccccaggctaccagcctcccagctgcaaatgcaaatagggctctcatgcttccccacctgtggagtttgcacaccagattcatgccctctcccaagttctggccaggagatttcttgttcctttgaaattgttacaaggttcagctggaggtttccttctccctgtggcctcttcccagtacctctggcagccctacccgaggacccctgtgaggcaaggcagaaatagcttcctaggggacccagagagcccacagggcttttcctgctgcttcctctacccttgtattttgcttggctctctaaattgactcagccccaggtaaggtcagaatcttctccagtgatatacaccttcgggttccccagtgagagtgtgttttcaggggcagacaatccccctttcccactctcacagtttgggtactcagagtatttggggtatctcccaggtcctacaggagcaattcatttccttcagagggtctgtgggttctcttggcttttctaatttattcctgcagcagttctggagcaaaggttcagaattcaagactccacatgctgctctgtccatttgagtgggaggctaaaacggtttttatttaatacctgattctagcttaattttgatccccttcctttatcctttccccagtatttaactgtttgcctagatctgatctcacacttagctccaaatcagtctaactttttccagccttagactgcttgttacagtatctggctttacatttgccttgagagtcttagagttggaactgctgtgttatgctccttaaggtccttgacagtctagccgcagtctgatttacaaaccccatcacttgtacaaattgtccccaacttatcatggttcaatttaggattttttgactttactatgggtttaccagggtattaaatgcattttttacttatagtatttgcaacttaatacttaataaacccaacttaatgggtttattgggaggtaaccctaagtcaaggggcatctgtagtaggttgaatgctggcctcaaaaagatatgtccacatcctaactcccagaacctgtgaatgttaccttatttggaaaaatgtctgtgttaatgtaagtaaggatcttgagatgagatcatcttggattatctagatgggccccaaatccaatgtcattttaagagacagaagcagagaagacacaggcaaaaaggagaaggccatgtgaagttagagattggagttaggcagcctcaagccaaggaacagctgaagccaccaggatggaacagtctcccttagagccttcagagggagcacagccctgccaacaccttgattttggacttctggcctccagaattgtgagagaataagtttctgttttaagtcaccaaatttttcataatttgttaaacagatctaggaaactaatacagattttggaccaaaaagttgggtgctgctgtaacaaatagttcaaaatgtagaagtagctgtggagttggacagaggctagaataattttgagaagtttggtattaaaagcctagactgccttgaggagacttcagaaatctggacattaagggtgattctgctgagggcttagaagagattaaagggcatagttgaaaaaacttctgtcatcatagagaatacttatatcatcctgaagagaatttcagtagaaatatgaacattgaagtctgttctggccatggcttggaaggaaatgagagacattatattggaatctagaagaaaggtaacccttgttatgtagtgatacaataccggctgacttggtttctacagtttgtggaaaacatcttgaaactggtgaacttggatatgagctgaaaagatttccaagcaaagtgttaaaagtgctgcttggtttctcctcgctgcctatattaaaatgagagaagaaagagataaatttaaaaaggaacaggtaaggaaaaaggaaccaacacttgatgattttggaggttctcagcctatccagattgtaaagagtgttacaactaggaaactcagtgttgggaatgtgtgctctggagagaaagacagaaacctggcaggacaaccttttgctgaacaggttaagcatgtgattcatgggtcccctcaaccatctccccagaagcttggtataaagaaggtggggatatccaggaaggatctggggaggatccgtgtaatgatgtggctcttggtgaaatatacaatagtcttacaaagttttggggaatgtattagaaacactgtcagcttggaccgaaagagacaagacaaaatgaaagaaggctgttggacttccaaaattctataggcaggaaatggactatagagctacttggctgtaaacattgtgctgccctttcaagaaagaaagaataactctgcaagcagaaccatggcaggcagcacagagggtgaagcatcaggccacagagagttattctcaggctttgaaacataatggaaatttgccctgctggattttgaacttgcctgtgaccagtgacccctttattccttctatttttttcctttgggaattagagtgtccatcctatgcctgtctctccattgcattttggaaacataacttgttttctagtttcacaggtggacaggggagaattttaccccaggatggatcatacccagagtctcacccatacatgatttagatgataaaatttgtaaatgaagttgacgatatttacatgagattttggacttagaattgatgctgtaattggttgagtttttggaggttgttggcaaagggaaatatattttatgtaggggaggtggattttgggggcttttgggggctagagggtggcttgaatgatgcacccaacaaaaaaagggcagcttttagaatcttttgcattaactctgctcaaaccttgacttcagacttttggcctccagaactatgagagaataaatttctcttgctgaataggttagacctgtgattcatgaatccactcaaccatctcagcagaagcccagtacaaacatggcgttatccaggaaagatgtgtagaggatccttgggtaatggtgtggtagccctaggatagtaatatatcattcttttacagtcttcctcattgataccttacttgtgggcataccatattactctatcttgcctgatactttcccatgacaaaattaataactttctattattctctcatagcatttggccagtatttctgtaataatccttactgtaaggtatcatatatgctaatctctgttgttaaaaggtgagcttcagagacaaaactgttttttattcatgtttattttgccaaggcacagtgcacaaaagttgggtactcagtaatgctaattcaacaaaaggtactttttatagggaaaggtatactttaagccaccatcagaattacctctacaatataccttacttgtggaaactagtttgtccttggaaaatccagagaggatgctcagtgttacctcatgtgccttattgttttgttgtgaacaaatcaaaattgtaggaggtcctttattatataaactaaaatctttctctctataccttttatctactgatcctctctttcagaaccaaatctgtttctgtgtgtgacacattatgtgagaatagcaggccaaaagcctgtagtttcttcaaccactgcacttcaaaaaatttattttatatagttcgttattctgctttccttcaatttgtttatgtttctcttaaaattgtaggaaaagcaaagaggttgagaagagtaagtgtggaagtggaagaattgaagagcattgaataggttgaaggagctgggcagataggaacttaaggaaaataatgtgggagcaagtgagggaaatttttaagaataatgctttaaatccaaaaattgagcttcccaaccaaaatctataaatgcatacacacacacacagatatttttcagttcatcctggaaatttgagtgcataacttgagtatagtcttatgtaggaaacaaagatgaataaggtatgtcccctgtataaagaaatttatagtataataaaatttgcggccaagcgcagtggctcaggcctgtagtcccagcacttggggaggccgaggcgggcagatcatgaggtcaggaatttgagaccagcgtagccaacatggtgaaaccctgtctctactaaaaatacaaaaaatagctgcgtgtggtggcacatgcctataatcctagctactcaggaggctgaggcaggagaattgtttgaaccagggaggtgaaggttgcagtgagtcaagatcgcaccactgcactccagcctgggcgacagagcaagactctggctagaggtggttataggctgaagaggctagcattttacagtatgcataccttaatttgtacatctgaactgcagttattctacttgtgttgatctgactgaaaatatttttgaaattccacttataattactgtcaaactctttagtgcgtataaaaacaccctttgtagaaataactgttttctctgggtagaattttttgaagaaatacacttattttgagccatatattttgtaaggcaagtgaacaattgcaaatgccagcttgttacctttaaaaaaactttgtccaaaagagtgaactgggcatggtggcatgtgcctgtagtcccaactacttaagtggctgcagtgggaggatcgcttgagacctcccaggctaaagtaagccatgtttgcaccactgcactccagcctgtgtgacaaagggagatgctgtcttaaacaaacaaacaaaaatgttgttcaaaggtaatatcttaccttttaccaggtgcagaactggtttagatggtctcaaggatgtttgctcttcagtgattaataatgagttaccagtaaatggcctctgagattccagaagagttccaaaagtgcttagagcagtgatgtattgagggaataacttttaagtgaatactttttttttttttacttgaacttttaagttccagggtacacatgcaggatgtgcaggtttgttacataggtaaatgtgtgccatggtggtttgctgcacagatcaaactatcacctaggtatgaagcccagcatccattaactttcttcttggtgctctccgtccccttgcacctttccaacagagtccagtgtgtgtcgttacccccatgtgtccatgtgttctcatcattcagctcccacttgtaagtgaaaacatgcggtgtttgggtttctgtctctgcattagtttgctgaggataatggcttccagctccatccatgtttctgcaaaagacatgaccttgttcatttttatggctgcatagtattctgtagtgtatatataccacattttctttattcagtctatcattgatggggatataagttgatgccatgtcttcgctattgtaaatagcgctgcagtggacatatgtgtgcatgtatattcataatatgatttatattcctttgggtatacacccagtaatgggattgctgggtcaaatggtatttctgcctctagatctttgaggaattgccacactgtcttctacaatggttgaactaatttacgttcccaccaacagtgtagaagcatttttttctccacaaccttgccagcatctattgtttcttgacttcttaataatcaccattctgactggtgtgagatggtatctcattgtggttttgatttgcagttctctaatgatcagtgatgtggagctttttttcatgtttgttggccgcatgaatgttttattttgataagtgtctattcatgtcctttgcccactttttaatggggtcgtttgtttttttcttgtaaatttgttgaagttccttatagactttgcatgttagacctttgtcagatggatacattgcagaaattttctcccattctgtaggttgtgtgttcactctggtgatagtttttgttgtgcagaaactctttagtttaaatagatctcatttgtcaatttttgcttttgttgcaattgctcttggcatttttgtcatgaaatcattgcttgtgtctatgtcctgaattgtattgcttagattttcttatagggtttttataattttaggttttacatttaagtctctaattcatcttgagttaatttttgtataaggtgtaaggaaggggtccagtttcagttttctgcatatggctagccagttctcccagaaccatttattaaatagggaatcctttcattgcttgtttctgtcaggtttgtcaaatatcagatgcttgtaggtgtgcagtcttatttctgagttctctattctgttccattgatctatgtgtatgtccttgtaccagtagcatgctgtattggttactgtaaccttgtagtatagtttgaagttaggtagcatgatgcctccagctttgttctttttgcttcagattgtcttggctatttgggctctttttcatattttctaattctgtgaagaatgtcagtggtagttttgtcacaggataaggatcccgtgataagggttttggctttgccagccggaaacctctatggctggtagcacctttgccctagttttgctcgggcctgctgtgctccttttgtccactcggcctggcaggctatgctcggcttgtgttactggcctggatcccacacctgccaagggggagccaggtgcagggcggcggtgagtgtgtgagcaagcacagggtccggccactgcgcacagccaggagtgccagctgcagtggggtgggcagctccaggtactggcacaggcaccagctttgtacaagactgtggctcgaccaggcatactgcaggtggcttccactgcaggcactgtggtggaatgcagtggcacctggaagcttggagataccaggaaccacacagccctaaagagagtgagtgtcacagctctggctcagggagcctgtaggtctgggctccccaaagggctgcagctcttctctccttttcattgcctgcaatgtggtgagtggggcacgtgtttcagccctgttcatgttacagctctttcagtcctgccatttggtgagttccaagttcttgttgcatgttcaggaagaatgaggcatgtagacaactggaaggtgagcaaggcaaagaggtgctttattgagagacagtacagctcttaggagaactgaagttggtagctcctttctgctggcagatcgtcttgatgagcgcagctgtcactagagaggagacatggagtgggtagctccttttcacaggcaggtcattctgttgagtctgcagccctcagctgagaggagaaatggagtggccaccttccacctgcagtcaggtcatcccgatgtctgggagaggacacctggaatgggtagctcctatccacaggcaggtcatctcattatctgcctgagtttggctgagtctggggtttttatgggcttcagaggggggtaagtgtgtgctgactcgtccatgggaggccctgggtaggccgggacaaaaacaccgtacgttctcactgcagtccatggaagaggtagcccagcccccaggcttcaggttgtccttagcttgaaggtggggcttcaccggggacccatccctttttgcccatctgctccctgccaccattaacctgccatctaccatgtccatggcacccaggcagttcgcgtcatggggcacctttcaggcctgtgccaagctgctcccaggccctcttggcctcccttccatgcccattggtgcccaaagtctggagggggctgaggtggtagggggctggcatgtcagcactaccccaaacatgtacaaccagccgggttgtggcagcttctaggctcaggtgcaactttgctccgaaattgaagcagggattgggagcagagaagaggccaggaagcaggagcaggcactttcaagtctgtgttgggacagggggctttgcaggcccctgagagtgcagggatgcgttggtccacagctgcagctgggtggttgcagctgcacccagggagtgcagggctcccaccccgccaactcagtaggaggcatgggctcctacctgccttcagcccccaaaagcacagggatgtccgggtccggacagctgcacctggggagtgcgggccctccaccctaccaactcagaagtgggtggggcttccacctgttccttgctcccaccagctccgtggagtacacaaccctggccatatctcccttgctacagctggcgtttttgcagctgccactctagacaggtcactgctgccatcagtttactaggaatagcattgaatctataaattactttgggcagtatggccattttcacagaattgattcttcctatccatgagcatggaatgtttttccatttgtgtcctctctgatctccttgagcagcgatttgtagttctccttgaagaggtccttcacttcccttgttagctggaacactttcttaaggcgatcactttgaaggatcagacttagttagatgtacagattctggtagttggaagaagtttttacctgtggttgcacagtatatgagcatgtctgtagctgtttggtcaaatcagttaagccttgcccagtgttgatttgaagttacttattactctaaattcctatgcttgtcgtgtttatgttgatgaattaatcagtctttctgacttcctttttcctttttagtggccatgtcagactcacaagaattagttaatctgtatgtgttgtggatgttctcaatactttccatttattttaagcattagtttaagtttaccaagcctagagagaaaggtaaggtgggcaataacaaataatcagcaccatgtgtatggtggctgttttgtttctagcttaaatatttaaccctatttgttttagctctctagtgttttgttctgtgcagaactaaatctttcatttatttcattatttctgaaaggctttaaatggctttggccattttttcttaaataccatgaaaatttcattgggctttatggccaaagacatagtgcagtacactgatttcctgtttttaaaattaagatcttttctgttttaaataataaaaaagattttctacacaagtaaaggcaatagataatataacttctataaaatatttatagaaccagtttttgtttatgaaacaggtggtcttttttttctactttttacctttatataatgttctatcttaattataatttttgtatttctcagtggcatttcatatggcaagatagaataaactatcaattttttagttgttgctaataacaaggaaaagccaaaggtaatttctcatgaagccttttcctgacatgattatatgtttatagttgagaatgatatctcaggtaagaatagtcagtgtgtttttttccagtgttatagtaaatggaaattagtaatttgacattaatttttaggggtttttgtttttgccatagatataatttggttcttgagtacagtttatagtatctaaaccattttaaattccatctactaaccgattacttctatttttttaatagtgaatttatggcagaagaaagtaatgaaaaattttggcagtttttggaaactgtgcaagaattagcaatttataagcaaacaggtaggtgatatgtaaattttaacttgtaagatttgtatttatgtacacacattgtaatgtttattattttttaatggtaatggttaagtgtgaatgcttcactgggttagtaaatccgaacattaaatttgaaaatatgttttaatagaaaccattctaagcatctgtttccaaaaatacaaggttttaatactttattataagatacctcatataattagtcatgtttggatattgcattctcatcaagaagaaatcaaaattgttacctgggcatggtggtgtgcatctgtagtagcagctacttggaaggcccaaggccagaggattgactgcttgagcccaggagtcagagactagcctgggcagtatagcaagaccctgtttctaaaaaagaaaaataaaaaaataaaataaattggccaggtgtggtgtttcacacctgtaatcccagcactttgtgagactgaggtggaggatcacttgaacccaggagtttgagctgtgtttgtaccactgcactccagcctgagcgacagagagaggccttgtctcccctgtccccccccaaaaaaattaagatagttttctttttacctagatttctttgaagtaataattttgcatctagtaatagtacatttttttcttttttaaaagtagacttaatttttttagagtagttctaagttcatagcaaaattggacagaaagtacagagatttcccatattcccccttcccctacacataaatagcctcccctgttatcaacatccctcactagtgtggtacatatatatctgttgatgaaccttccttgacagatccttaatacgcaaggtccatagtttacattagggttcaatcttgctgttatacgttctatgggtttggactaatgtatactgacacgtatattgcatttttattggcagaatactttgactcttaaaccattaaagaaacttttaatacctcaaaaagtcaggtaactaatatgctctcatttcactatttgtaagatagtaatttctgtttttatatgtatatgagagtatatacctatatatacgtatatcttcctcagaattaaaaagtgtttattaatgtgtttattattttcctatctctgcagagactagaatagatgacatgagcatggaatcccttaagagtaaaatcttcagccatttagatatagagacatcttcttactattggtgattaaaatagtttattattttgttcctgagtgtaaatgtaagataaactaagtttcagatgttttaaatgctcatttactgaagcctgtttggctcaggtagccttgaagttcagtgattttgtgatttcacaaagtagattttaaaaataaagagatcagacatgcttttaataacattttaaactgaaatatttccaaaagcaaataatttttcctttcaaaattttttcctgaaaaagctttttagtcataagaaatgctggaggtactttagatgatgggaatacaaagatgaataaatgggatctacatccacaggactttgtgaaacaatgaaggagacagcaaaacagtgatgtacactattaggcgataagagctttaattgggtcatgcataacatgaaaacacataaaagaggcacctagtcagtgttccagagagagcaagacaggattttcagtgctgaatgctggagctgagtttgaatgatgagatttagccagggagtagggaacacaaatgagtagaagagaccggaatggaatgtgtggaggaacctcgatcacttagtaatgtttactttcaaatcattaggaaattactgtctgttgtcctcatatttgtcctagtaattttattaatagttttggtgattgaggtaaaagtaggctagattaatatgtaaggttttcatggttaatgtcaagtatccaagatagtttaaaaaaacctaacaccaaatttcgtgtctctcacctaaaatcctcaatatatctgtcccatatatgttgttctcagtacatgctttttggccttattcagtgctattttttattggagacgcaatcttaaaaattactcctgtaaatttcaaattcattttaagttacttaaatatatcagcatattttatacctaaatgaaatgatatacctggacaatctggtggcagatcattcacaagctggaatataagctcaggagtacctaaactctacatcaagcatatatggaaggaggtatttcaagtgttttcagggttgaacctaaattgtattaaagtaggaattactagcacagcacagtggctcatgcctgtaatcccagcactttgggaggctgaggtgggcagatcacttgaggccaggagttcgagaccagcctggccaacattgtgagaccccgtctctactgaaaatacacaaattagctgggcgtggtggtgcgggcctgtaatccagctactcgggaggctgaggcacaagactcacttgaacactggaggcataggctgcagtgagccgagatcacaccactggactgcagtctgggcaacagagtgagactctgactcaaaaaaataaataaataaataacacttaaaatataattctattggctttatttataatggcagagtctaatgcatgtggtgatattattgctgaccttgttaaatgtggaaaagaatggtacaaatgagaaataatgagcagagatttttttttgagacggtgtctcactgtgtcgcccaggctggagttcagtggcatgatctcggctaactgccagctccgcctcctgggttcacaccattctcccacctaagcctctgaagtagctggggctacaggtgcccaccaccacgcccggctaattttttgtatttttttttttattagagacggggtttcaccgtgttagccaggatggtctcgatctcgtgacctcgtgatccgcccacctcggcctcccaaagttctgggatttacaggtgtgagccaccgtgcccggcctaatgagcagattttactgaatttgttttcaagacatcttagaggaaacatttaataatcctctgttacttgtactaatttaggttgttgaatctccatgagaccttctaaatactctttactaaagcatgtcttagtgatccacctgcctaaaaaaattgtaaatattgaacatttaactttttgaattcaagtactagttttataccatttaatgcaattactttatattatatgccagcaaattaagactttttaagcaatgaattgcctgtttaaaaaaatttatatggttctgccagacttacatatttattgatgcttcaagattcaagtggcatattagttaacctatgtagttttgtgaggtgagaaatgtcacccaagatttatctgatttccaaatgcctgtttatttttacttcttcacatgctgctcagcatataagaatgtcattttcaaagtccttgaagattttagtggtttttacacaaattaagttgcttttgtattttattaatggaagaaattttcaaaaaatgttaaggctttctaacatagttacttttacccaagaaccagatttgggggaagaaggtaattggaatttggacgtgccacatttgaaatgcttgtgaaatatccaaatataaatatatcggtaagctgatatatgagtgagagatctagataaaataaattataggataaagggtaggatttcagagtgatcaatatgaaaaacggtaatttaagttgtagggagaaggcacagaatgagaataaaatagtgcccagtggcagaaccctgagaacagcaatgtttaagggaatctgatgagaagaacagcacacagtggagactaaggaagagtacctgtagtggtagctgaaatcctgtaaaagtattagatcatgaaagccaggagaatattaagttgtaagtgattgctgttatcaaatactgtagacagatcaagtaatatgaatattatgcacctactacttttaaaaacagagaaattattagtgcctttggtgagaaccatttcactggtatagtaatcaagactttagtaagttaagatgtgagtaaagcttttcatatctctgttatttggttatctaatttctgagtttcttgtcaaattgtcacaatcagcaaataacccagtctccaaccacccccaaaatgtccccttccagtagagctacgtgtcgttaagtcttttaagacctttgactatgaagggaataagatgagtcagtagctgtctgtggaggctgccacttattttttttaataagagtgatttttgaatattaggtgccagtagtcaaaaattgagtaaaagctgaggttgaagataaaggcagaaaatattgaaggggcatttttagcaggtggttggtgagcatggatttagttatttaacaaatcagccaaaatagcccaatgcatccatttcataatagagatgatcttgctagttacatctaaattataaaagtttactttctataaactcctgaatcctacattcattactacataagggacaaccttgatggtgaccttgatgaaatttggtatctgttgtcaggcactactcacatttcttttgacttttctctgcttccctgggtgaccagtcctttgactgatgtagtcatattttagatgttattacattaatttttattattttcttgctgaccttgtaactataagtattttaagaatattatttaaaataacatttattttctattttgcttttactgttgaacacgaatcttatttgcattattttttgattcttggaggaaaactcaccatatctcccaagttctgagaaatcatctatagtttgttaaagaattaagagtgggctgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggagggcgcctgtagtcccagctactcgggaggctgaggcaggagaatggcgtgaacctgggaagcggagcttgcagtgagccgagattgcgccactgcagtccgcagtccgacctgggcgacagagcgagactccgtctcaaaaaaaaaaaaaaaaaaaaaaagaagagtgaaagaggcaatgcttattctcatatgtcaactgtttaaagcaactggattaggaaaatattgtttagaatgaagaaacttatttataatatttattaaatattaaagaaatttattgaatgtctattttgtatgccaggagtagaaatgtacagttgaaaaactatgatagaaaagatcctttccttcatggtttatagcttaataagaggcaccaaattaaacaattataccaatactttttaatgacttctttgtgaattgatgtagagatggtatagagctcacaatcagactttatgctgcaatttctccaattatttcttggttatataaagtttgctctctggttggtgcctcatgaataactcttggaaaaatagcccttgagttcttcacatacttaattgttcatgtgtgaattcgaaacttctgatttttaactttagagccccagagttgttttttgtttgtttgtttgttttttaaactagagaatgttgcaatgctgatcattctgtgtcttttttgttttaggtatgtaagttcattatttttaattctggaaagttttcttggattatagttttctttaattattctgttccattcccttgattttctgccttagggtctacaagtatacatatattaatctcctttgcctgacctctgtgtttgtcatttactctcaagtcatttttcccttctctcctttttatttgtttcatttttatcacttttcctctgcatattctgtttctcctactgttttccacagtgtctctttactcttgtgctccttctaatttaatctgtattttctagtattattttctttctagttcttatttgtattctttcaggaaacttctcatatctccctctttttttggtcatctcatttctgagctttttgtcaagagctgtgaaggggctggaatttttaccctgcttgcaagctaaaaacttagcttgccacagtttcaggaatcagatggacaacataagactcttggatcagagctgaaagactttataactgactagaggaaatctcctgagtgattcatagcttctttatatcagccaggacctattgaactaaactctgagactttttattgtcatctttgaaaggatctaatattggcaagttggactgtaggaggaatttagtcataaggtgccactaagacattgtttgggagatatttttgaacttatttcccttggcctataaccttttcttcttctcttcattaataggcagcaaaattaagatgactcattgcctgattgactgtacagttttgtcagaatatccactattacttctcaagcactctcctcaaatcctattaattggaccatgggactgggtcttttattctccagaaatccacgtatcttgtcagcattccattttgttgtcagatctgtcaagtactgtgaagggtctgagatgttaccctatttgcaaagataacagattagtttcatggatgctgacagatgacctgaaacccctgattcagagacagaagaaggctttattacatataacaaaagcaataaccacaatgtcccatatttgcactggttgcctgagcctcagttcccacaggacaacttggagggccagataacacctgtaccctgaatgggttgtggtaaagagaggaactgagggtcaagggcccagcactttcggagcaaatagtaaacattgtcacaatcagcaaacaacccagtcttccagccaaccccaaaatgtctgcttccagtcagaacatccttttcctcctctcagaaagagagtatctggtgttgcagtctggtgtaaccacattcttcttgttatccctttcacatcagatatccacagggaactgctcttcatctacctcaactctgttcttttgtatgagaaatttccatcacttgataacccagtgccaagatgtagaggagaataaattaccagagaatgtctagaggccagcctctatggatgcctataccaaatggactccagagctgccctgttattaccttaccatctctggctggccctggaatgacattacagttttctgacacaatgcagtcaatggttacacccagggaagagtagagaaaggaaaagggcacagacagaaagttctgcccacccctgcttatccccgttagtgccaccaggtcttcttcagctctaggctgcacttttctgccttctcccattcaagtgatctctgtctccccaggggtgttggagaatttttaattaaattctaggatccctccttctcctttatgtctttgagttctttgaatagggtttatagtaggcaactcgcagctcaggttagtttgttcaagttccagacaagatgacatttagttttgaagacctggttcaaattttgtctcctaaaagtattctggatacactaattatacttggctattggcactaaatctcagtagaatttattcatacaggtactttaaaattcattaacaatcatattatttaacttttctgctgttcttaatttctaccttgtaggtaggacttatatcttatccttgtaatataaccccacaactttggagtaagttggtctgaaatgttggtgtttccaaatagattttaatggcaagattattttcacctggtctcatgttgattacttggacattactggaagatccaaaatgaagttgattatagaactgagatcttgatttttccatttttctctagcattatccataaccaaacttcagatatgattatatgacattaagttagccttacagtggaagatgtgccaatgtgcagtgtataaaatgctaacatttattttcttttgacttctttttatagaatcagattattcttattacaacttaatcctgaagaaagctggacagtttctagacaatttacacatcaaccttttaaagtttgctttctctataagggcatactccccagctattcagatgtttcagcaggtgcgtaaaaatacccaatctgtatttgacaaagaggcacgctagcaatgtacatagagttctttaatatgaacatctttagttcaaaatgatctacaagtttatagttggttccatagcctatcattgattatattattattgttgtcatttattataatgtaattgaatatattctgtaatttttatagttatttgggataaggaaattatgaggacaaataattgaaatgaagtatcataaaattttaatagaattttttcaataactatgaagcatgtctttcctaggataaagttgattttattaaaatatttcttagattctacctacgtatagatgtttttttactttaattagagcaataacttaatagtagttgatgagttattttaatcaaagtaatgtgtgagggttttaaaatcatattgtaattatcaactgctgtagctaaatataatctttgaaatcttagattgcagctgatgagccaccaccagatggttgtaatgcatttgtggttattcataagaagcacacctgtaaaattaatgagattaaaaagctgctgaagaaagctgcttcaaggtaaattaataatagcctataatgaaagaagtggttatagagaggagagttcaatagcagaaacttcttataataaaaaaaatttaatattctaagacattgtatattcaagaatgtgatttgtattgaaaaccgtaatatatctgagaatgttttgtcttgattagcttttgattttagcatataaattgtgccaaaataacataaaatgtatgaaatgtttcatataagcataacttgttttttgaaataaacatgcaaaactgagtttatttggcctatagctctttaaatataaactgaatatatacctggggaataacaaagtaatcaaaacaatagatgaggttgcttcctatattcaaaactatttttttgcttttttgcaagtatttaatttaaaaaatggcaaatcagaagtaaattattaatttattagtgattttttagagtaatactaccagtatattttttttgcctgattatttatactttaaaaaataataaagtagtttttttaattttgaaagagctctattaaacagtaatatatatttatgcatattaatacttaactcacttgttaacaaaccatttctaacattttcttatacttgtattgaatttcatatacaaaagacttttatttttatgtagccaaattttcctgtgtatgtgacttttatattgtttttatactaacagtttttcccgaacctgattgggagattttactaattctttctgtagctttctaaaagtttttccttttattttacattaaacttttaatctatctgtaatttattttcatcaaaaggtaagaatccaaccagatttttttcctcaggtacctagtcaattgtattcattatatttatattatggtctatttcatagctctttgttctgctccattatctatttcttatagtagtgccatactgttttaatatttattgctttattatccagtttctgacaggaggatttcttcttcattgtggctcttttttcctccagaatgccttagctccttgtatttgttgatgcttttaagtcaacattggaatccttttcctccccaagctccccttccccaaaagccttgttagggtttaattagaattatgttaaaagtattggttaatttaggaaaaatttacatctgtgttgtattgaatctcttatcaaataacatggcatgtttctctgttcacacctgcttttaaaacttaaaggcagaaataattgctttattttatcaattattttttcaactattgggatggatacaaggtttttctcattggacatactaatatattacaaaatactttgaaatattataccttcttttcaattctgaggaaaactactgattattaatggtgtgggattatcttaatttgcttttgaattaagattgctttcattttgttttcatgtttctgtgttaataaatgaatagctgtacatttattgaaattatttgacatctttaatttttatcggtcattctactttcgtaaagtgaattaggcagccatattattcttattctggatgagttaatataggaattatctattcctttatggcattattagactcactataatataactcactagtgcatcttttaaaggaaattttgtaatgtttaaaatttattgtcattggtttctgatgtcaacttttataattatagaaactaaagtatcttgaagattacaaaaaaattaacatcaaactattaggaaagtccatctgccatgggccctgtgagtccttgcatgttctttcttggtctgaccagcaaaaaatgcaaggtcctgaccactctttacctgggccatttctcagggttgtgtttgcagtgagcaaccttgaggaatgaggtaatgtttgcctttgggattggggacagggagcaagtgtgttttattgcttactataaaacagtgcttccccaagcccagtgttccttaacggaaacatatgccaactctgtaggatccatctaagtccatattttgtcaccccctgtgggactttgggggcaagcatagtaacgcttatactgcttgctctatgtcatgagcagtaaagtcatttgtctttgacccaggagtctgtcttatgtcttctatcagaatccataaaagaataaaaggctaacttattagtttgtaagtcaggtaaaatcataccttagacttttacagttcttggtagttttggagactgtcatgggtgggatgttgactgacacacagcttctggaagaggaagttcgtaagggcccatgggtcgagaagaaaaaggtcaatacttacatttcttcccactgctcacctctttctccctgtactcctggtgggtgatagtagtctcctgataactgtgttgtagtctgacacatgttccttgatctgggctcctaaggaaaaggcactcaaacttgactgatttaatggtttattgttttggctctgattatataactggtattggtattttacatgcttatactgtgaatgctgtcaatgtttgtgaagcccagagggaaactgtcattcagagactaccacacatggacacccccaggtggtccagcagaaacaacaaagaatcaatcccaggaggagaaaggacaatcacaactttgtatagacttcatagctgctggactaccccgagagactgtttctaagtacaatagtgccacctgcctgactcagccacttagtacacccctttttaaaatagcagttcttaagctcttgttgaaactgaatgcctgacccatggaggccttgtgactctaccacatgacatttacattttcacgtagttcaactaggagtcagtgtctcgcaaggtaaaagggacccaataagcctccctgctcaaatggaaattatatattcaaaagcccagcttctgggccctagcatggtatcaggtatatgtgaaaaagtggcagctactcttttgggagtgaactaaataacccatttcactacctgaagtaaggtcactggctcaaaagggccctcagttcacagtggtttccctaaatgcctgggccaggctgctgggacgtttagctaagttaacagctggtgggctcttcgggctgcctctgctaccatttcaccaggcataagccttgtaaaaccaaaagctgaagtggtcactctactcagtgggcagaactcaaggccgtcatcctctccctgaacaaaatctgaccccttggttaaatataatacattcatactgactcttgtgctgttgccaatggcctacctgtctggtctgccacttggaagactacagatgggcagcttaaaaataccactccttggggcttgcacactgtgaaagtaatttgcacttgcccatctgacagtctggtttactcctttagatgtacatattatagacccattccctgataagtgtgaatagagacaaactgactatgccaagaccgtgtgaggccctgactgctctttaccatggccttttctcggggtgttttcagtgagtgactttgagggataagtgagtgtttctccctgggacaaagggcaacttacttactgcttgttattaaatgatgggtttcccacattcagtgttctttagatgtgatccatacccactgcctgtgtagaattcttgtgggtccatcatacttctccctatggaatgtgggcccatggggaacccatgtaaacatactaatgttcatgttgcttgctgtgccacaagtaatcaagctctttgactcagaaatctctgtcttttgccagaatccatgaaacaatgaaaagctaacttattagcttgtaagtagggtaaaacaattctacagcctgacagaaacattccccccccccccccccgctatgtagggcaaagttaataattttttttttccttttgtgaacttcaggcatatactcttgggtttgtgatatcttatcaatattggtcaatggtttttttttcttatttaagcatataatttatgtttttacataggttatgtatagtaatataaatattttaattttttcctctctgtagatatgtttctccttcctagattttctttagttttcattttctttcagtttttccagattaggtttttatctttttttaaagaaatgactgataaattttttctgcttttttattctaataggttttgcatttatgtattttcttctgtctgtggttgagctaaacacttggttttttgtgttttttttgttttttttttcaattataacatatttaggtcatcaatgttgcctttctttactatgtgatattctcattgtcccaatttcgtaaaattcttcttaacagtagttttatttacatgttggaaagtagagtgaccactgggagaaagttatactcatttaggatggtaatgattgctgtcactttcccccagatatataactcatattttattttgttttatttatttatttttttgagacaaggtctcactctagtgcccaggctagagtgcagtggtgcagtcttggcttactgcaacttctgcttcccaggctcaagttgtacttctgcctcagcctcctgagtagatgggactacaggtacaaaccaccatgctcagctaatttttgtattttttgtagagacggggtcttgctatgttgcccaggctggactcgaattcctgagctcaagcaatctgcctgcctcagcctcccagagtgctgggattacagacatgagctaccactcctgatcttcattcacattttcgtattatgtctataaagttttggggcagttccagaccatagatttttgaaccagggaataggaaatagggagagatgaagaatcagtttactattctttttttactagcatgttcttgttctaagtggtagttgactgtcagttatgattctaagttgaacagcataggttttatagttagtagactttactcccaatttatgtatgatacaaagttatttttagtttgcaacttcattaagaatttttgtatctgagtctttgtaaatatttttggagatactgtaaaatttagtgtcagggactgctctccaaatgccacttcaaatcaatatgaccatcttttttgtggctttaaacttttgtcccaaatggaaagctgtatgtttaaagttaaaaaaatcccatatggtcattataaaagaattcaaatactttagaaaaatgcaaagtagaaagggaaaatggcctataattctgctaacagtttagtatatgttcttttttaatgcatatatgcatatacagacatacttaaaaaaacatttattgtactataaagggtatcttagatccttctcccacaaagttattgtgttcttacatgtaaataaataaaattactggtatgtaccgattttatgtgttaggctgtttttgtgttactataaagaaatacctgaggctgggtaatttataagtaaaagaggtttagttggtttatggttctgcagtctgtacaaacatggcattaacatctgcttggcttctggtgagagcctcaggaaccttacagccatgacagaaggcgaagctggaacaggcacgtcacatagtgagagcatgagcaagagagtaaggggggcccctgggaattgcatttcaacatgcgatttggaggggacaaatacccaaactatgtcattcttttcctagcccccaaaatctcatgtccttctcacattgcaaattacagtcatttcttccccatgtcttaactcgttccaacatcaagtccaatgtcctaagtgccatctgagactcatctgcttccacttatgagcctgtaaaatcaaaacaagttatttacttccaaggtacagagatggtgcaggcattgggtaaacattcccgttaccaaagggagaaatcggccaaaagaaaagagtaacaggccccatgcaagtctgaaacacagtaggcaggcactaaatcttaaagctgtcatgtaatccttgactccatgtcccacatcgtgatgtacatcctggtgggctccctaggccttgggcagctccagcgctctaactttgcaggatacaacccacgtggctgctgtcatgggttggggttgagtacctctgggttttccaggcacaaggtgcaagctgctggtgaatctaccatccttggttctgaagggttgcagccccccctccactagctccactaggcagtatccaggtggggactctgtgtgggcgttccaaccccacatttcctctatgcactgccctagtagaatatctgtgggggccttgcctgtgtggcaggctcctgcctgggcaccaggcttttccatacatcctctgaaatctagatggaggcctccaagcctccttcatgcttgcctcctgagcatctgcagacatgagaccatgtataaactgccagggcttatggcttgtgccctctggagctgtgacctgagctttacctgtgcccctttgagccgaggctggaactggagcagctggatgcaagttgcaacctgctggcatggcacagggcagtgagcattctttccttttaggccttggagtgtatgatgagaggggctgcctcatatatctctgaaataccttccaggccttttcttcattgtcttggctgtcagctcctggctcccttttagtcatgcaaatctctctagcaaatggttgcccaatagcccacttagattcttcccctgaaaatggactttttcttttctggctagggctgcaaatttttcaaacttttatgttctgcttccctcttaaatatgaattccaacttaaagccatttctttgctcctacatctgaacatatgttgttagaagcagccaggccacttcttgaatactttgctgcttcgaaatttcttccaccaaacgtcttaagtcatccctcttaagttcaaacttccacagatccctagggcataagcacaatgcagccaagttatttgctaaggcataacaagggtgacctttactccagttcccaaaaagttcacctaccatgtagtagatgctgaaaaatattgagtgagtgataccgtaatgaaatgaataaataagtttcattattccactccttgcggtgtatatataggtagtttacagtaaacaatatctaattgaacttccttgtacatatatctttgcatagttaccttggttattttcttaaatttctagaactaaaatctctaggtaagtacatgtatattaaagtgtatactacaaaattgtcttcagaaagctgaagttttatactctacttctaaaatttttaccaatgctaatttgtattaattctctttaacaccttagtcaattcagtaaattgctacttttaaatataattatttaattttcaaagatcattttcctcttatccagccatcctctataggtataatttttctacctatgatatatccaagcagttcctgaaataatcataaaagcaaattttgaaagttatgtgtctataggtacaggaaggaaggtactgtcgattacagactcagcaaatggtagagagcccttacctttgtgtgtaaagtctattccatttcctctaatttttccttttatattcaacctcaatatttatctcctagcatagttttattggcagcctttctagttttctttctttttttttttttttgagacggagtcttgctctgttgcccagactggagtgcagtgatgcgatctcggctcactgcaagctccacctcctggattcatgccattctcctgcctcagcctcccgagtagctgggactacaggcgtctgccaccacgcccggctaattttttgtatttttggtacagacagggtttcaccatgttagccaggatggtctcgatatcctgacctcatgatccgcccacctcggcctcccaaagtgctgggatttcaggcctgagccaccgcgcctggccgcctttctagttttcaacagtagtaaattctttgaaggaagaatttttcaggcttaaattaaaatttaagattccttatataaattactaaatgtacttctatgatactgatttgataaaatcaggtttataaaatgataatccagctgctatataagtgacatttgagttccaagatttcagttaaaatttatgagaataattttaatagtttcatgcaagaatctctttcacttctcttttcaaagtgaagtatgattttgtatccttttagcatttattaatagcctctcatgaagaaagacagcaaattcagtgtctcttgttttgcacattcatgtctcttcatcggttacagaagattaataatgaagtgaaattctatttggggttaagattctatttactttatgcttcagctgtccaagcattgacagtagtaacatttctatattgctgttgagtaatggcacaaattctaagccaaataactgtggaaatctctcaaattattctgttagtcaataagattgaatgcttgaatgattttgatttagaatatgttgagtcagtaagtagttaagctagaattgaatccaattctgcctgatctcaaaacccaccttcttttcactaacgtgctgtaggaatgttactcataccttttttcttctgtccttaatatttgttatccaaaggtagtaattgactgaatgattgtagagatcagaattcactaaataaaaggttatttctcaacatccttgttactctgaacttccttatctcttggtttgctttctacctgtataaattgccaaaacatatgggctttggaattccataaacatgagttgaaattctggctttccatttgatcttttcctgaatagttaacttatctgagcctcagaaacttaaaagtttcagtgatggtagctgtctaatttttcttgtgaaatagaatttactaataagtgtaaagaacctagcacagtgcctggcaaataagaagtcagttaaagtctgtttctgatgataatgctagaccataagagtcctggtttctttgcttatacttggggatttgatgagtacttgttcatactaagtactgatagtctttgaataaggtagtacttttgctttgtgccttaaatatttataccttgttttcaggaaatatgagctgtaatgaaaaattataacctaactgcataaaatataaattttatttcactgaaaattgtgctgccattatatgttattgtttaaagataataaaccttgttgggaaataaagtatttttaatattagatttgggttaaccaaattcttttctttcttttctgtcatttagttcaagttatgtgtacaaagtcatcacaggaaatttaaattctttttctgtgattatgtatattatgaattgtttgataagcagtaattatacagaattgatatgccattaactttcagttttttcaaaactttgtgttttgcttttatcttaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcaggtatgcgcttgttttttccaaggttgcttttggctgtagaaaaaaacaattattatgataatcgtcttactagatttaaatattaattttcaccagaatagttatctaactttttttaacttaacaaatgtgaatttcatgtggaaaaatatattgggattctgtctcttctgggggtatgatgtctataattctttgccttatatctggcacaaatttaaaacttggataaaaaacaaaaacatacttcaataatgtgtataatatttgctaagaatttgcaattaagaaatctgatttactcaacatactgataatatatacagtactagatcaaagtgcaaagcatggtgttggaatactgttaactctttcttttgagacctgactacttttcattcaggtatctggtatgtgctgtattgttcccgttcctctagcctgccgttgctatgacactatcacatttttctgttttaatgatttcatagcacttattactgtatctcctcaagtttatttaacactttcagagcacatacatgcacacacacacacacacacatgcgtatgaatataatggccattagaggaaggactatgctttgttactactgtcttcccaacatggagtgctttaatttgcatttcccaaattattaagatttatatactaatatttaatctaattaaaaccttaaaaatatatttgtaaattgcctgtccgtagcctttgcctatttttgaattgagattctttttttctcattggtttataggtgtttttaatatattttgaatactaatattttcttccatacttcgcagtatcttctcctagtgcatttctggtcttctgattttttttaaaaattgtttatgacatcttttacaaatattacttgtgatatagtcagatttactcaactttacctgaacgatttcctttatgctgttataaggacattctcttgtaagagttgaagttctattttttgttttggtttttaatccatctggaatttatttgaatatactacggggtagagatataattctgttttttccatatgaaaaattattggtcttcacatactttgttgaacagtcaagtctttattctactccatcatatgctaatttttcatatagacatgtatatgtttttagactttccattctgttgcagtgatatatatgtctattctacacaaaaataacatcattttaattgctgtagctttaaaatatattttgatatctggtagttcaactctgcttcttaatttttgtttttctaaataccttggctgttcttgcatgatatgtagccatgttaattttagaattagttggccaggttccatgaaacatgttgggatttcatacgggaatgaattggacctttctgattaattttgaagagactttttcttcatatatattgagctttgccttctatgaacatatttttatttcacaatctagtcagatgtctttttgaaaagtatcatctgtgatgtacaatgttgggtttcaacaatcacacagagtcatctgtcagtcaccttagtaccatcatattcacatacagattcttgtaggaacatatgttttcaattcacttggataaatgcctggaagttctattgctgagttgtatggtaagtcagtgtttaacttcataataaactataccaaactgtctctcaaagtggctgtacaatttttcattccccttagccaggaaagataatttcgctgctctaaatcctaaccaccatttgttaatgtcagttttttttattatagctgttctaggtacacagtggtatctcattgtggttttaatttgcatttctctaatgactaatgaagttgtctggcttttcataagtttctttttggtgaactttttttgtttagttttcagaattctttttatgtcctagatataaatcatttatgagatacatgatttacaaacatattctaccagtttgtgaattatcttgtaattctcttaatgtgttttgcagaggaagagtttttaattttgattaagtccagttcatcatttttttgtttatagattatattttttgtattatatctaaaaactcatcaccaatctcaaggtcattcagattttattctaagcgttttatagttttatgtttacacataggtttatgatccatttaaggtttgtgcaacttgtgagatagatgttgagatttatttttctacatatggatatctagttgttttaacatttgtttaaaagactgtccttctccattgaatttcctttatccacttgtaaaatataattgactgtatttgtatgggtctatttctggctttgcttttctgtgccattgatctgtctgtcccaacatcaatactacactgcttgattactttaccttgatagccttgagatcaggttgtgttagtcctccagctttgttattctttttcagaattgttttagctaatctaattcctttgtctcttcttgtgaactttaaaatcggcttgtctgtatctacaaaacattttgctggcattttgattgagattacattgaacatataaattaaatttgtgggagaacatcttaaaaatattcagtcttccaattgaaaattatgtctcttgatttatttagacatcctttgatttctttcatcagtgtttttcttctttttcaacctatatgccatttatttttttttaaccttattttaatgattaagacttctagtcaatgttgaatggggagtagtgagggaagatatccttgcctttttcctgatttgcagagaaagcatttggtcttctactattaactgtcatattagaggaagggtttatttttaattttttaagttctggtgtacatgtgcaggatgtgcaggtttgttacataggtaaatgtatgccatggtggtttgctgcacctatcaacctatcacctaggaattaagcccggcatgcactgtgtagtatttcgtggtgtatatgtaccacattttctttatccattttactattgatgggcattcaggttgatttccatgtttttgctttgtgaaaagtgttgcagtgaacatatgcatgcatgtgtttttatagtagagcaatttatattcttctgggtatatacccagttatgggattgctgggtcaaatggtagttctatttcaggttctttgaggattgccacactgctttaaatgaactagtttacagtaccaccggcagtgtatgtgcattcactattttctgcaacctcaccagaatcttgttattttttgactttttaatagtagccattctgactgatacaagatggtatctcattgtggttttgatctgcatttctctaatgattagtaatattgagcatatttttatatgctttttggccatatcatatgtcttcttttgaaaagtgttcatgtcctttgctcactttatttatttatttattttagacagagtcttgctctatcgccaggctggagtgcagtggcgcgatctcggctcactgcaacctccgcctcttgggttcaagcaattctcctgcctcagcctcccaagtagctgggattacaggcatccaccaacatgcccggctaatttttgtatttttagtggagatggggtatcagcatgttggccaggatggtcttgatcttttgacctcgtgatccgcctgcctcagccccccaaagtgctgggattacaggcgtgagccactgcgtccagccttcgctcactttttaatggggctgtttattttttgcttgtaaatttaagttccttgtagattctggatattagacctttgtcagatacatagtttgcaaatattttctcccattctgtaggttgcgtgtttactctgttgataatttcttttgctgtgcagaagttctttagtttaattaggtcccatttgtcaatttttgtttttgttgcaattgcttttggtgtcttcgtcatgaaatctttgccagggcccatgtccagaatggtatttcctaggttatcttctgagggtttttataattttaggcttcacatttaaggctttaatccattttgagttgattttttatatggcataatgaaggagtccagtttcagtcttctgcatatggctagccagttttcccagcaccatttattgaatagggagttctttccccattgcttgcttttgtcagctttgtcaaaaatcagatggctgcaggtgtgtgacattatttctgggctgtctattctgttctgttgctctgtatgtctgtttttatgccagtaccatgctgttttggttactgtagccttcagctttgttctttttgcttaggattgccttgactattcaggctcttttgttccatataaaatttaaaatagctttctctaattctgtgaagaatgtcattggtagtttgataggaatagccttgaatctgtaaattgttttggcagtgtggctattttaacaatattgattcttccagcctgtgagcctggaatgtttttccatttgtttgtgtcatctcttatttccttgagcagtgttttgtattaataattctcattgtagagattcacctccctagttagttgtggtcattagtattttatttttatggcaattgtaaatgggattacattcctgatttggctgccagtttggatgttgttgctgtataaaaatgctagtgatttttgtacattgattttgtatcctgaaactttgctgaagttgtttatcaggtcaaggagcttttgtgcagagactatgggattgtctagatatggaatcatgttgtctgcaaacaggtatagtttgctttctctttccctatttggatgccttttatttctttctcttgcctggttgctctggccaggactttcaggactatgttgaataggagtggtgataaagggtatgtttaagttccttatgtattctgatattaatcccttgtcagatgggtatttgtcaaatattttctcccattctgtggattggctcttcactgtgttgattgtttcctttgctgtgtagaagatttttagcttgatgttaactccacttgtctatttttaattgtgttgcctgtgcttttgaagtctcacacaaaacatttttgcccagaccaatgtcctggagcatttcttcaatattttcctctagtcgtttcatagttttgggtcttatatttgagtcttcaatcaattttgatttgatatttgtatatggtgagagatagtggtctagttagtttcattcttctgcattatggttgttcagttttcatattgaaaagactgtcctttccccagtgtatgatcctggcatgtttgtcgaagatgagttggttccaaatgtgtagatttacatctgagttctctattctgttccattggtgcatttgtctgaatatgaattcttccatgaacatggaatatctttccattttttggtgttctcttcgattcctttcatcagtgttgtagttttctttgtattaatgtaggtctttcacttttttggttaaattaattcctaggtattttatattatttgtaactgttgtaacattttcagaatgttgtttgctatttgtgtatataaatagtactgaattttgtatattgattttatatcttgcaactttactgaattcatttattggttcaaacagttttttggtggagtctttaggtttttctaatataagatcatattgtttgcaaaccagggtaattttacttcttcctttccaatttggatgtcctttatttatttctcttgccttattactctggctaaggcttctagtattatgttgaataaaaatagtgaaagggggcattcttgtcttgttccagatctttgagggatggctttcaattattccctgtttccatatgatattagctgtggatctgtcatatatggccttaattattttgaggtatgttccctctatacctagtttgttgggggggagggacttgtcagaaagagatgttgaattttgtcaaatgccttttcagcacatatttaaattatcatatggtttttgtgttcttggttcttttaatatggtgtattacatttatcgatttgtgtatattgaactatcctgtatccctgggatgaatctcacttgatcatggtgcatgatctttttaagttgttgctgaattcattttgctaatatgttgttgaggatttttacatctgtgtttattagtgatattggcatatagttttctttttttgttgtgtccttgtcttgttttggtattgaggtaatgctggcctcctagaatgaatttggaggtgttctctcctcttcaagttacagagcagagttagaatttccaagactggggatggcagtcctgcctttcctctttgtctttgtcctgaggcatatttctccctttagacactcatgatgtttcccatgtgtggtactatcccacagctcctgagtgttctgctcagtttcttgctgttgtttgctttttggattttttcctttctttctctactacattttcttcttaaattcaatttgaataatttctattgacctgccttggagttaaccaattcttttttttttttttttttttttgaggcagaatctcgctctgtcacccagtcttgagtgcagtggtgcaatctcagctcactgcagcctccgcctcctgggttcaagcgattctcttgcctcagcccccaagtagctgggattacaggcacacaccaccatgcctggctagtttttgtatttttagtagagacatggtttctccatgttggtcaggctggtctcgaactcctgaccccaggcaatccatccacctcagcctcccatagtgctgggattacaggcatgagccactgcacccagccagccagttctttctttggctatatcaagtttacttgtgactctgttgaaggcattctttatttctgttacagtgcttttaatttctatcattgccatttggctccttcttacagttttaatatgtgtgatgaattttcctttctgatcactcatatgttctacttttttcattagagcatttaacatgttaatcattattttaaattccctcctgaaagtttcaacttcttttttacatctgattttgaaattgttgattgatttgtctcttcagacttttgttccattgacttcttggacatcttgtgattttcgttgttattaaaagctcaacattttgtgtaggagccttgaccctgcctttagtttaggccatgcctttcatgtatgcaggattgaggtgttctggtcaggagttgggttgggtttcacgtttgtgttccacttggctttaggtctccccacttagatttggatcttccctttgtacagctccccaaagacaatgtgtttcttatagctttcccacctgtatttcagcgttatctttactcaacccttgttagattggccttgaggtgaaggtgagggggcagctaaggaaggggatattctctgatgttccaattaagtttcctttctaggcatactgtaaatttgggcctcaaggtttctgatcctctctcagaatgttgggcctggcaggtattcccgtccttccttcagactaagactttcatctgttccatttctcccgtcttcagtgggcttccaccagtacactatatagctacaattttgttgcccttgcctctgaagattaaggctttggttctataggggagataggtctgaagtggatttcagcagtgatttttctttcctctctacctgtcaccattagagtggaagctttctcaggaccttccccagtcttccctgtgcaagagggtttcagccttgctatgtctggagctaccaggggcttcacactctcacgttagcccacatttagcctttagcaagctttatagatttctagctaaatatctttaccagcttcactagcatttggtggtatctgtcctgggtattcaaatgttcaccttcccacaggtgcctttttcttctgttatcattctcgttccttctgctttattttttcttcagaaaattttctaatacaaaaagcctaaaaataataaactttttgtatatgctacccagaattgacagctaacattttatcttttcaagtttattttttaattgaagtaataaaactttaaaaataaagttgaagattattttgttttccattatcagtctcattctctaccccaacaccaattggagtgttcttttaaataataaagtgctgtcactcctagagatctttcttcgttagatctggcacattggttgggaatatatagcatatgattctgaggccctctgatatctgtccactgaagaaagagaaagatgagacattctagttctgagagaggaggtcataactaggtggctgtttaataaggatacaatgcttataaaattatttttccttgttttgaaacatacaataaattatttttttggttttattacatttttttctgttctttttttcatttattattattatactttggggggaggggggagggatagcattgggagatatacctaatgctagatgacgagttagtgggtgcagcgcaccagcatggcacatgtatacactaacctgcacatatgtaactaacctgcacattgtgcacatgtaccctaaaacaataaattattaaccatagtcactcgattgtgctgctgaacactagatgttattcttcctaactgtatttttatacccattaaccatcccctcttaatccccacatccccactagtttttccatcttctggtaactaccatcattctagtctctgtctccctgacttcaaaaattggaatgttcctaacacaaagaaataataaaatgtttgaggtgatagatatcccaaataccctgatttgatcattacattttgtatgtttgtatcaaattataacatataccccataaatatgtgcaacttttctgtatccataataattaaaaataaaaaattttaaaaacaaatatgttttttttttttttcctagagttgcttagataccatagctttgctgcttacctggggatagctttgctgcttacatggggaatccaaaatttaagtttcttagtgctgattgaagctatcttataacttctgaaagcagtaatatatgattgtagaggatgaaaatctcttaagttactactatttatgaggaaactaggtattctttgaattagaaatttgttagaggaatctgtcatctcttccttctttctttcctccatgcacatttattagatgctgtgtctgtgtctgaattgctttgtaacaaatcttctcaaaatttagtggcttaaggaaatattgacttactgtttctctttattctgtgggttgacagtcggggcactttttctgctggtattgttcatgcagtgagggtcattcagtactagattagagcttggggattcaaattattctgacagacctgtgtggcagttcaggctgatagctggagtttcttgtctttttctacatggcctttcatcttccaagagttagactatgattcttcacatcatgatggcttagggtcccaaaaagaaaagagtagaacttgcaatacctcttaagccctatgcccaagaactcatacagtgatacttctgccaccttgtgttagtcaaagcaagtcacaaggccagccagattcaaaagaatggaaaaatagactcaatttcctggtgagaagtagcaaggtcacattgcaaaggagtctggacatgggaaggagttactcatttgtggcctttataataatcttccacaaatgcctgtaatttgggcactgtgcttagtactggtgatagaagataagtagcttatttcagtatcttaattttgttttatatatttgataattttatgatgcaggttcactgtgcactggtatcaatcccaggggaggactgtaaacaccttgccaatactgtgtaccagtatcaatccactggcatgagtctggtgagacagaacacacaataagtttagggaagcaactttattactcacagacaggcagcaagggacaatagacacctaaggattcatggcaagctcatcccccaaagcttaggatagctgtccaggatggatggagtctcacgtgcacgtcattcatgttgcaccgcagctgaggaactctgaaagcctgctctgccctgggttttatacctaggagcaacttgatgagctgtgctaaagcattgcaagacatcctgttctaggagctatgggaacagagcttggctttactggcaattccttcatatttcttgcatttccagcacatcattctacagttattctgagatttacaagtgagaaagcgaggaagagctgggttgccaagatcttttggggacttgccctacaataacatcatataaaatgtgttttttccctcagtgttcttcacattctcaattttaattgttcattgtataattttgagttagttattgctatttagtaaaagtggaaaatcttaaatattcttgagtgtgttggcatatagatatttgcataatctacataaagattatctgtaaagtgagatgtaaagagaaagtgtgggtgtgtgtacagtttgtaaatgattacatatttaagtcattaatttcataaatatttggatgcctctgtgccaggcattggttcatgtagcagtgaataagagagaaacattccttattctcagagaacttcaattttagtggcaagagatgtaaaacagatttatgttagatggtgatgaaagtgttttcagaaaagataaatataaaagaagaggacagagagtcatgggtctagagtgtgcactcaaaacattttatattgtctaatcatcttatgccaagaattctcaatttttcccaactgagtttgctagaaggatggatacattaccatcaataacagtagcaccttaagactatgattctctgtcagataaggcagagctgagaggcaaatgagaataggaacgggagtgggagatacaagtacagtttacccttaagcatgtgtgagttagagatactgacccctcatgttgttaaaaaatatatgtataactttggactccactaaaacttaagtagtaataacctactgttgactggatgccttactgataacagaaacagtcaattaacacatatttttcatgtcacatgtattattctgtaattcttacagtagagtaagctagataagtaatgttattaagaaagtcataaggaagagaaaatatatttttcattaaatagaagtggatcatcataaaggtttttatcctcatagtcatgttgagtaggctgaggaggaaatggaagaggagaggctggacttgctgtttcaggtggcaaggtgggagaaaatctataagtaactgtctataaaagtagatatctataaaatatctgtttcttgtaaaaatttataagaaaatctgtaagtaaacctgtgcaatgaaccttgttgttgttaattgtctgtgtttgtcttttttaaatgttctcccaagtggttctaacatgcccctggggagctatgcccatctgttgtgagaatctgtctcaagttattatttagagtttcatgcgcgtccgtgtgaagagaccaccaaacaggctttgtgtgagcaacaaggctgtttatttcacctgggtgcaggcgggctgagtccgaaaagagagtcagcgaagggagatggggtggggccgttttataagatttgggcaggtaaaggaaaattacagtcaaagggggtttgttctctggagggcaggagtgggggtcgcaaggtactcagtgggggagctttttgagccaggatgagccaggaaaaggactttcacaaggtaatgtcatcatttaaggcaaggaccggccattttcacttcttttgtggtggaatgtcatcagttaaggtggggcagggcattttcacttcttttgtgattcttcagttacttcaggccatctgggcatatacgtgcaagtcacaggggatgcgatggcttggcttgggtttgggctcagaggcctgacatagagaatgtgaccattaagtgtgcttctgtgaaatcatattaactatctgggcatttagtaacatcaaattatagccttatatttaatgaatgacatcttttatgttcaaaataactataatgtaaatctagtcaacatgtaattctaataaaaatagacatatttatgctacatttttaacatatgcctttttgtgggggaaatagaaaaacaaagatttttttttttaacctgttgatttggtagtttggtttgcaaatccaaacttactaaaactacaaaattacaattcaaattttatatcaacacacttccaaatgaggaaagtaaatatgaatttaggaacatttttattactgaggagctaataactttccagaactgataatggaaattggctatgtgaaattgcatttcttttatgaactataacaagatatacggccttatagtttcgattcacttagccaccaactgattggtcttttgactagatattcaaaatgtagttttaaattgagctgttatgaaattgaaaactctaaaaaattttcatctttgtcagattactgtaattagaaataacccagtttctacatgctatctttcatataatgtgggcctgagaaattagcaaattaaattttagtgtgggcagcaatgttaagtatttgtctgaatagctgaagctaacttttacatattcttacctggaaatagaacaggccaaagaacagtcactctggccatatacatatcaataaggcttggtagaaagtttagggaggaaagaagagaatacaaagaataacacactactaaagttctccttccctccaatctctaccttttcctctatcatgcaaaactgtccctgtgcaaacctgaattaagcaaagacacatggcttcttccagggagtttgctgagctctaggttaaagttgttttctaaccccttgagatgtgccaaatgataatggttgcagtacagccaacaagaatttcagtctggaagctggaacaactttaaaactattatgtgtgttcatccaggtttcttccttttgaataaaatatggtgacttctcttgtttgatgaggtaatctctaggagtacatttaatatttgccctttgtagaaagaataaaataaaggtactaaaattctgatcataaacatttcagaccactctgttttagtgaactgtagccccttattgcaagaacagatgttaatttgtggcatttggtatattttaatcattgagaaacaaagaaaacttttatcaggtatttcacggcactaactttttttgtctcctttgccactactttccagtgtttgcttttggcagcactctagtcctacatctagacaaccagcaagtgaagaggatttttggtttagcaaatcttttgggggtccccaaaaaggaaaacagttttgttgaaacttgtctgttattggatcctctgtttaattaactcattgaagacatgttataacaggaaaagatcagatatttattattttaattgtaaaaattaaaaagtaattaaaacagtagtcatgacaaagtttttacagagtagtcattaaccaaattctagttccttgatagactagagacaatataaacaacccccaaatttttcagagtgattaaaaaccttcaatattagtaatttacccttatgtccaaatacatcgtggtactgactttaaaacaaaatgtttgactaactcttttcgctttttataaaataaatgtgtttgaacagaaaccaagctcacggaaaatgtacttatctgggtatggtgtggagctagcaattaagagtacagaatacaaagcactggatgatacccaagttaaaagtaagttctctatctcagtacttgagtagaatgaaaagttggaggcttttacatactttagttttttaaaaatttaatgagtataatcctacatatgttcatttgaggctagagatggggtggacatattcttcattaaaatttggaattaaattttcagctgaaagaaatgtatttaatattattggttatcaaaatttctttaaaaatatgaaatcgtatgttattttgctgatacccgatgggctcccaaccatttcagcaccatgtaacaattgatagtatatgtaaggtacactgtggcaatagatgaggctgattattgctagaggtgactggcataggcatctgggtctcgcccatgtaaggaagttttgtctgaaatatttatttgaaatgaaattaggatggtagtttttttttttctatcctgaagcaggatgagagagtcctatgaattgtttagatgaagtagattcattagatttgtgatctactaaccaatatctatctgtattttatgaactaaatgcatactctagatgaagagactctgaagacttaaataaactaaacaagttctcagaacacttatggaagtcttttattacctggttcatgtcaaatttatttatgcctgattcttggtcaagagttttatgtttattctctatatgcactcagatgaggctcctgcttcaactttgttttttcatatagaggccctgccttgatcacagacttctctctggctcctcctactgaatgtgcttcagataaagatcgtattactgtaatttaaatatttttggttaaagagttactgaaaaagtatagtaaaaataatactctgattttatgtatttctctatagcttgtgtatagctctacaatgctttataatttactctcttgtagtcacgatagcaatttaaggcatttttagctttaaaaagtcagatggtcacatatgtatcatctgtattattatgcactgcattctgtcatcaaccttttacacacacttggaatatgtcttcgcctgtcaattctagttgccactccttagtgcagttctttttttctctgtatacatgtatcagacctttaactagccatctctctgatcttaggtcttcagtgcccttaatctcaccacccctcaaaacagattaatcaatctaatctccacagtactttccaaatgaacttctgatgttgaaaatctgactttgtgattccactggttaaatcctttagtggctccctataacctctctcaaaaattcagaacatagcaaacaaagcttttcacaatctgatttcttactgcctttttactgtccttcagccctctctaatttgtgtcctcttgcctgaaacactaaactacttactatttagaataattttctgttccctggatgcttttatgcatgggctccatgggaagtctttatgacctctcctacattcatcccttagcatatgctgttccttttgcctaccgctgtcttcacttctttcatttcttctaaagacttcacatctttttcttttttttcctgagatggaatcattgctctgtcacccaggctggagtgcagtggtgtgatctcagctcactgcaacctctgcctcccggattgaagcaattctcttgcttcagcctcctgagtagctgggattacacgcgcctgccaccatacctggctaatttttgtatttttagtagagacgaggtttcaccatgttggccaggctggtattgaactgaccttgtgattcacccacctcagcctcccaaagtgttgggattacaggcgtgagccaccacacctggccagactaataaatatatcagtctgtgcctctgagatggctgcctatcttgctgctctgttagagaatgctcttctcttttctatatcccatatctttctgtgccttcttttagaaaagttcatggtctgtattttttgtgtctctgttgttcttggtgtctatcctgtcatagacacctcatagtaagcagtcaataaatgtttgcccaatgaatgaatgaacaaacaagaggaaaaggatgactagatcaaagtacccagggttgcttttacttatagtcctagagattcagagtctcagaaaagtaagaaagagtaagcgtaattgctgagctctgataaactctgatagagagccaccccacacactataagaggtcacagtctttatgatcctaaagcacccttcacatattacaccaaccagactgtatagtataattatttggtatgtaagggagaagggaaatgactataaaatattatatctttattctttgagaccatgagttttggtgtctttctaaatgttccttgattatctttaaaggtgttggaaatatgtaggaactcatatttaaacttagggtttggacctcctgcctcacttaaaagctaaacccagcatttgttacaggccttttggcttatttctgattatgaaatagaacttgactattaactaatctataaagcactttattatagttgctaagtatttaatcaagcatgttaaaaaagatagctcacacttaggaatgttagcctgtacacatgcatatatatgtattaatctggtccatgaaggaaaaacaaggtaaaacgaatggaatttcatttcattgtgagttctaatttttttttttttttttagacacagtcttactctgtcacccaggctggagtgcagtggcacgatctcagtccactgcaacctccacctcccaggctcaagccactctcctgcctcccaagtagctgggactgcaggcgcacaccaccacacctggctaatttttgtatttttagtagagacaaggtttcactgtgttggtcaggctggtcttgaactcgtgagctcaagtgatttacccacctcggcctcccaaagtgctgggattacaggcatgagctgccgcacctggccaagttcttctaatttttgattacatgttcttttcccagtctgaaaatatttttgttgttttttggttttgtttccaaaatgtagctgtgactaatactactgtagaggatgagactgaaacaaatgaagttcaaggatttctctttgggaaactaaagtaagtctgaatggaaatgaaattggtattattatacccattggtttttaaggaattaatttgatatactgttttgccatatgcttcacctttcttttatgtagaaagtacaaacacacacacatacgattgtttttatttattacagaagtaacacatggctaatgtcaaaaagctacagaaagcagaaaagcacatttaaaaataatcactaatttcacaattaaagagataactcataatgttttggtgtacagtatgtttttccagtctttctgtgaatatttttatagcatcaaataaatgcatacacaacatattgttttgcacagtagaaccatagtgtgtagctgttttttccacatcttgtggatagtccatcatttattgaaacagtcccatagaacaggactttaaattctttccctactttttcatttaattttttttttgtgtaccagtttgtgtgtattgcagattttccttagcacaaatttcaggaaaatagttgataaagtatatgtgcttcttgaaatttttgattcatacttgtaaactaccctcataaaattgtactaacatggacactcaccccagaatgtgaaatgtgttcatttcccagaactttaattaataaccactcatactatttttaaaatctttttcagtttaataaatgaaatgttgtttctttttttaaaaaagtgtatttaattcactggattgaaccaattttataatttgtctccaagaaagtcaactattggcagtctattattgcaaggattaactttttttcatgtttattggccttggaatttcttcttgagtaaattgcttattcctaacttgtgctcatttgttcttgctgtgtttatctttttttactaattataacagctctttataaaaaattctgaaacctttgccacatattgaattacttactgtcgaagtttattttcatattaatcttaaagatggaagtttttttcattagatacaactgttatgtttacattgagagtgggattttatttctgaaactctggtggtatccctgggataactagaaaatttgaaatttaagactttcgatacctatggttggtaactgttaaatatgcatgtttttctccttttacccagaataaattatttgtcccataaataaagttcatttatagaatggctaaacctcaaagacatgaaacaacaaacataaggcaacaaataaattgttaaatatttattagccttgtagcattttttgatcctgttcttcatttgcactatatggtgctatcaccatacaaattatgatttcccatattcgaaagtagtacttttctttattctaacacagctgccataaaagtcaagtaaataattggtatagtacatacttgtttaggaagtttttaaatttggagagaaaaaataatataatttagtaataaagcattttaacaattcatggaatataataagcattaatgtgtttgttaaacatgaataaaataaatgaaaattataattattaagttattatttattaaaatagtttcacaaaatgctgccaagaaaaaactgcctaaattgaatttcttttgaggaaaaaaattaagtaaatcattattttttaaaataaatattgtaataatgttagctaatatttactatttttaaactcagtgttatttttactgttttttaataaattaacttggcaagctgtggtaaatattcctctttattatattggtttctttatttttagggagttctaatacatctgacattcataaagtatgagatacttaaaatcacttttcatatgataaatttgacttagtgtgcttagagaaacaggagttgataaagttctgacagaaaactaaaaactttatagaatctagaactttactgatctaatgagttacaaaaatcattgataatattggacctttagcttgaacaaatgtatagccccaaagaaaagaaaacgtttattactcaaattttctgtactacagattaccatttcatatacatatataagtaagctttcaaaaattaaagttatacccccccctttttttcctgccacgctgattgaagacaaggaatagcatggtgagtgctctatgaatactcatgaatggggatggctgtaatttcatgtacattttcccttatttacaagtgaaagtttatgatttctttatccaggcaaaattaattaaagaaatatttttattaacacctttagttcttgtttagtattacagtcatttatgaaggactctcagggtggttctcctggtgatgagtagataactatagacagtaaggataagatttttggagactatgctaatttatatggataactatgttacatttttaaagtatgttggccagtcagtatactctagtggccttaaaatgttaatacagcttacaaaatggttttattctaagtaaggtatttatttagcagctaacaatacatttttatcccattttcagctatctcaacatcttggaatttatagttcttttctcttttgaatataactttttatgggattaaattgcattttctccaaaagatcacgtggaacactgggctattttaattttaatttaattttattttatttcaacttctattttagattcaaggcatacacgtgcaggtttgttacatggatatattttgtgatgctgaggttaggggtatgaatgatcccatcacccaggtagtgagcatagtacccaacaggtagtttttcagcccttgccatcttcccactctaatagaccccagtatctattattcccatctttatgttcgtgtatacccaatgcttagttctcacttataagtgagaacacagggtatttggttttctgttcctgtgttaattcacttaggataatggcctaccgctgcattcatgttgctgcaaagggcaggattttccatggtggtatatgtatcccattgtctttttccagtttgccattgatggcacctgggttgattgcatgtctttgctattgtgaataagtgctatgatgaacatatgagtgcatatgtctttttgtcagaattatttatttttctttgggtgaatacccagtaatgagattactgggttgagtggtagtttgaagttctttgagaaatctccaaactgctttttgcagtggctgatctaatttacatttccaccaacagcatataagcattcccttttctctgcagccttgccagcatctgttactttttgactttttgataatagccattctgactggcgtgagagggtatctcgtggttttgacttgcatttctctgatgattagtgatgtcgagcattttttcatatgtttcttggctgcttatatgttttcttgtgagaagtgtctgttcatgtcttttgcctaggaaaccctaaagactccgccataaggctcctaaaactgataaacaacttctgtaagtttcaggatacaaaatctgtgtacagaaatcagtagcattactaaaagccaataatgttcaagctgagagccaaaacaagcaggcaatcccatttacaatagccacacaccaaaaaaagtatgtaggaatacatttaaccaaggaggtgaaccatctccacaagaactacaaaacactgctgaaagaaatcatagctgacacaaacaaatggaaaaacattccatgctcatggattggaagaatgaatgtcattaaaatggccatactgccaatctacagattcagtgctattcctgtcaaactaccaatgtcatttttcacagaattagaggaatctattctaaaattcatatggctattcatttttttttcttttctttgagacggagtctagctctagctctgtcacccaggctgtagtgcaggggagccatctcggctcactgcaacctctgcctcccgggttcaagcaattctcctgcctcagcctcctgagtagctgggattacaggcgtctgccaccactcccagctaatttttgtatttttagtagagatggggtttcaccatgttagccaggatggtcttgatctcctgacctcctgacctcgtgatccgcctgcctcggtctcccaaggctattcatttttaaaagggaatactcaaaattagtcttccacagtgactcagtgactgctcatttcaaagcaaaaatcctttgaggtactttatgaataatatatatgttgcctaaattatataaagaattttagcagtgaaagttattaagatgatgattaaatatgaaaattggtatagtagctcttataaacttataatctgataacttaaaaatattgaaaaaggaaatgtttgcttaattcatagtgaacttcttttagaaagaaatgccattgtacttttattatcatagcaattttgatttgttttcaaaacatgatcccacattgtagtaaacctgtaagatattgacactgtactatatatatttattcgtaactataagattaccatatttatgtatattctgtattttttatttcacttttcaaaggcttgtctattgactattgaaaatacgtgttttcaatgagacaccatctcacaccagttagaatgacaatcattaaaaaggaaacgacagatgctggaggggatgtggagaaataggaaggcttttacactgttggtgtgtgtgtagatgagttcaaccgttgtggaagacagtgtggcaattcctcaaggatctagaaccagaaataccatttgacccagcaatgcccattactgggtgtatacccaaaggattataaatcattctactataaagacacatgcacacgtatgttgattgtagcactattcacaatagcaaagacttcgaaccaacccaaatgtccatcaatgatagactggataaagaaaatgtggcacatatacaccatagaatactctgcatccataaaaaaggataagttcatgtcctttgcagggacatggatgaagctggaaactatcattctcagcaaactaacacaggaacagaaaaccaaacaccacatgttcttactcaaaagtgggactcgaacagtgagaacacatggacacagggaggggaatatcacacaccgtggcttgtcgggggtggggagctaggagagggatagcattaggagaaatacctaatgtggataacgggttgatgggtgcagcagaccaccatgacacgtgtatacctgtgtaacaaacctgcacgttctacacatgtatcccagaacttaaagtataataaaatgaaaatatgtattttgtaagttgtgctgatagtaacttttttaaattgtatttctccatttaaatctgaaatggcaccatgtcttgatttcatgagtgatagaggaaagaagattacagtttagattgtgtgtatagtaaaataccattctactacatcattatttggctctctaaaagatgcctagagatgtttaacaatgggtaaaattatcttattttagttttttataagaatcaaagatggaacttttcagaaataaactctgattgtatgaggcatttttgactttccttatagtttttattttcaattataaaagcaaggcttgcaatttataaaatgttaaacaaaaagtatgtaatatgaaaacataagtctgccctcatccttgcatcgcttacagttgacactaacaattgagagtatattcctccagattttgttttgtttcatatatttaataaaagagacctgtatatcttcctcattatttttaagttccgtgaatatagctgtatcacaatttatgattatcttaatgatgaatgattcatttatgtctaattacatggaatatgtaatttcaaaaatatgctgtttgtataatggtttgtgataggtgatgctacttaacatcacttaatattttgatgcagagaaatatattcagatcttagagataatctgacagcattccaaaaatacctgattgagagtaacaaacaaatgatgcctttgaaagtctgggaactacaaggtatagtattttgagatactttaacacagcattttggtaactgatctgttttgttaaataagcttttatatatcacatgatatagattattttatggacagtattaatgactagtgaataatataaattatgattttttgtggcaatacctatttaacagatcatccctcaagcaagctatatttttatatttgcaagacttaaaattatatgaagtgaggttattcaatgttatttcaaaagtatatactgatttataggttagtctcaagtattaaatcacatttgtggagactataactgattaaaagtcctaactcctaggtaaggagaaaatgaaacttaatcttggttttcttctttttgaaatttagatcctgttaagactattgcatgtttcattgataaatgtttaatggaaacatcaaatggaggacatgcagttttacaaagttaggaacagcttctgtactgaaaacctacaagcagatattttgtgaacaaaatttgatttggtttgaacttttaagtccttttcaatttataatttttcttctttatttgtaatgatttagtaggtcatggggacatgtcatctttctgcataatctaacttttgtcatcttttatcaacttttaaaaatataacagcttaataagctcttttgttaaataagcttttatatctcagatgatatagattattttatagacattagtgatgtaaataatgacattactataataatactattcatactaatacgttcacatactattcaatttgcccttttaaattctaccattcaatagtttttagcatatttttagaatgctgccactcttaacacagttgattttagaaaattctcatcatccccccaaaaaactaacaccctcattagcagtcactcctcatttcccaactccccagttgtaggcaaccaccaatctactttctgtttttaaaataacaactaaaaggatatttacaggccactctcactagtataacttacttataacatacaaataatattttatatttcatctggattatagtttacagagtcctttcatataaactatcttatttaagtgccagttaccacacagctaataagtgaagattttggtccaagtaaaattctttatactgtaccatatggtatctaggtaaactttatatacacttaacagaatattgaatgttacattttaaaattatagcagaatgtgcaagacacaatctattaagttttataacttctgctattctttacctacctaatacaaatgttgtatcaactaagccctgtatcattagaaaatcaatatatcaatagaaaaatcattcagcagaatgagattcaaggccattgttatgatagatttactgtaaagaatctacctctttgaactgatagaatctattctccctggacccttctggtgtacagtttcctatttaatgtctcatctagacctcatgcttagacctccttttattataccacagcccttgtgactgttctttcacttgacatcatgataacactaaactgaggtagtagtttcaaattcattctcaataaggttactgagataatctttctaaaatgaaaatctgattttggccttgtgtcaaatcagccaggctttatcacttgtacatccctgatcaaatagtggccttacattagtccccacaggaaaatgttggcacacacaaactaaaaagtttaataaagggactttttacagagacaggcatgattgagggaaaccaacaaggaatggattattcgattccagtatttgcaactagatggaaacattttctacccctaatcttgagggagcaagaggagagagtggttaccaaaacctggagagtgtgtcgagagagctgcttgacacagcagtagtaccccgagggactgtcctctgtgtatcaaggaagggatctgggtagtaactattccactccttactcttttcttgcttactgatcccatattagttacttggattggctgaatctaactagaaatctgagggcaagggagcttattgatgcagttcagataggccagccttttgggggcccggagcaggaaagagtggatgcggggggcaaacaaagtatgcagtcctcttctctgagaaagttctgtttttccaaggtaaatacttctggagagacttcgaatgtaagaaggggttgataggactagctagccaagtcatttgcatcattaaggactgatttcatgcacatccattaaaagtattaagtttaaaccccttagcatggtttgtgaagctcttgtctaagttctaatagagcttatattcctaaatccataatttcagatagtctctttctagtatcttcaattatttttagatccttttttatgtctctattttagcactttttaaaaagtataattatgttttaagcctccttcaaaatgttctctaaggggcctttgcataatttagaaaagtataagtgatggggtgtttttgaaggcctttaagcaaagagtatgcatagtcagcttagttctagttgactccctaatgtctgtgtaagatgtatttcaatggactaaaagcaagaaatctaggtagacattactgaaatagtgatagaaggcatataaatatttagaaggtgaaaaggagtcaaagataattctaggatttctagcttgagcctgagtagagagaatatataaaacatgtaagcagactttggggctgaatatgggactcagaaataatgagactagtgttgaaaggttgatttaaagtcattgtaagatatccagatggttaggttcagtggtggggtgagtatcctgtccttaagctaaaggagaaacaatctgcctcactgttgaggtaggtaatgaaagaatttagttttaaatcttttctgactcttgacaaagtaataatactaagatgaattcttctgacatgtttgaaactaaccacagttagcaacacacatttttctttttataggattgtcatatcagataaaataatactaagtttaggattttatttcagcacaaaggtaaaacaatgttgaaagagaaattgaatgtttctatttactgagttaaacacagtggagctttcttagaggtcttttcagaattggctctttaaagctctttttactcctcttcattattcttttgactttttgtcatatgtttcatttaagtatagaaaaagctttgcgagagcatttcttttcatatatctctctcgaaattatactgtaatttgtgaaaacaagaggtattaaatagtcattcataaaagtataaagcttatatttggaaataagtgataactttacatttaaaactttttaaaaatgcagatgtaacagtattaacatgtttgtatactaatacttggcaagaagaattgagtcaagtatttcaatttcatggaaatgtctataaaggtctaatattatgctagattccttaataatatttttccttccagatcttagttttcaagcagcttctcaaataatgtccgctccagtttatgatgccattaaattaatgaaagacatttcacagaacttccccataaaagccaggtatgttaaagtttataggtttcattgcagctataactctttctattaaatgagttttatgaaaatagctgatttcatttaacatgaaggtgtcaattagttctagtatatatagcttttgtgaaatcagggccttttcaatatatatatattttttgattagagcaaaatattggcttgtgcatacatgtgtgtatgcactgtaaggtagaactcttgttagaggcaaataggaaaaaaagtcctaaaaaattttctaaaatcatgcatagtaatctaaggaaaaacttgtttaagcaataaataatgaaggagtgttttttctttcccttatggaggatgataaaaagtattactctaagtaggaggtctatgcccaaagtactgccaaatcatattcttaccctttcagagtccaaatgattggtaatgtcttaattggatgaatattgtgtggagtacttttttgccaagaggatgtctcgttgaactgcttccatgaatactgatgttacattaaacatatattccatttcaataggaaatacatttgcatagcttaaagagaccggtgcatgcaatgcaagttaccacgtattatgagaatttgctatataacacaactttgatgcaattgtattctggttagggatgacagagtataaaattagcaacaagtaaaatatgagttagcttatactaaagagataaaatatgtgacaagtcgcagtgcatgggcaacaatggtgttttactgagaggaattggagagcagtctactagcttagcataccttcctaagcatagaatgattgctatgcctcttattgtcccaaacactattttgtacatttattcatcatacagattacagaatcttcaatatatgtattctttaattttgaaagtaaataaatagtacatggttggctacaagataccaaggattttttggtggtaccttgaaataaaggagtttgtttccttatttacagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttattaaatttttaattgtaatttctcacaatgctgccaaactttaggaaataatatatacttattgtgggctgtttcaaggtacacctttctacttgagttttccttaaagcagaactttgcattaacaatcttttaattttttaattctatttataaaatttgtaaaagctagtcatgtttaggaattatcaagttgaatacagtccataggaactgtattttgaacacttctgctgtctttaaattataagtgaattataaactcttcaagagtgaataggctgggtgcaatggctcgcacctataatttcagcactttgggaggtggcagtaggagggtcacttgaggccaggagttttagaccaacccgggcaacacaggaagactccatctctagaagaaaattgaaaaattagctggatgtggtggtgtgtacctgtagtcctatctaattgagaggctgaggcaggagaatcacttgagcccaggaacccgagactacagtgagttgtgatcatgccactgcagtcctgctgggtagaagagtgagactctgtctctaaaaaaatgtttttaataaacaaattgaaaaaattgaaagagtgagtgatgtaaagccatgatttcagttttttagaacatttctactctggtaggttcccaggttaactaaaaaattcttcatgtacgtatattcatgtacttatacattggtaatttcatacaaaatttctctattgggcaaaataacgcaaaacagctttttcaatgaagtgttttcaaaaaataagtcatagtaaatgatgacaatccatactgcatacagctagtacacatgaaattttgagaacctccattccacttgaaccaaatacttttgtcaaatgaaagctaaattaggccatatggaaatgtatacttttcagtcacaaaggatttggagtttttagcttcttatccaaagtattagattacattgggttatatagatcagttctaaacatttaaggaaggatcaattatattagtattcatttttccagatctctaaccagaattgctgtaaatcaacatatgagagaagaaataaaggaaaatcaaaaggtttgtttgaattccttttttaaaacatttacccaactaatatcactgtttctgactttggatcttcaatattcatacaaaaaaggaaatagtaatttgtgcttttttgattattaaaacagtctgggttcttctatttttatactgtggactatatgagcatttaatcagccaatcttttctgacataccttctacttatttcacagtatattccagaatttcttccgaggtagtatggttttcttcataggataaagaataaaggctgtgagttaattattctgtttcttgtaattagttttgcttaaaagcttgtgaagactgagtcagtgttagaccactggaacggtagaatcctatagcagatagaatacaatttatcagtggtttgataagattctgccaaatggtatcttaaattatccatagaccccaaataattctagttgtgttaatatttgtaaagtgcttacaccactgcctggctttattacataggaccggtttggctttaagtagtatcataccagactcacagggccctaaacactaggagttcatttttctcacttcttacctgtatttaaagccaaaagaggcagggtggatggtaccaaccacatttatcctcactaaagccttcttggaacattttagcagactggtttctatctcattggtgaggattttgccatgtggccaccttaggctgcgcgggaagctagaaaagctagtgtttacttttctaataacgaagcaaaggagaagtggcctgggtatggtgctaacttagccagccagcagtgcccatcatactgagacagagtgagctgtcaacaaatgtcagctgttttgatgacaactacaatgatggtaatgaagaaaaagatgcatagttcattggagaacaggtgttaggaaccacaacacatcattcctacctgggacattctttgcctcattgaccaccttacaaattcctgtgtatccttcaaaacggatttgtggtattggtccattctatgatgttcctaattgttcttaccattcttcatgcagaatggattgttttcttatgacacacaaaggagtgggtttgggagtggaggcttaatacgcaaaagaaagagaaaggagaacagctctctctctcttatgagagagaggggcacctgaatgggaattcgggctgcctacagagtgcactggattttacaaataggcttgaggaggcggtgtctgatttacatagggcccacaaattggttggagcaggtatgatgttttacataatgcatggggaaggctgaccactccaccctattatgcatatgggctttccacttggctgctgccatgttatctgcttcttactgtacatgtggactggaaagaagggaagatggagctgccgttttgaacatgcctggtcccaggtaacctgttcctactggcacaatgccagcatttacctatgcaagcttctagcttgcttgcctgtgtctgcagctcgattttacaggctgttctttgttagaaaataaaatgatttgggggcggcttttcattaaaaggaaaaccttaccgaggactcactatctgcctaaataatttcttcctaactgctatatcagaaccatgctggcaacctgagtatgccagcttactcagggccactatggccatcaccttatctacctgtcagccatttggaattggcagtgaaagagttttgaaatgagctttgactgcagagcaagaaatcttgaatttagtaaactaaataatcatgacactgcagatagtcttcttgatcacctactacttccagagaacactgaaaagagaaagacaaggatgataatgtctttcatgtaactaatctaggctaaatgggtatttggactagcagtccatgttacccactagctcatgagatgtgggagaagtaattaaagaaactgaagttccaaccttggggaagagggtggttgtgatgagaaggtaagaaaatcttggactattcattgcaattgcattgcacacggattggacacgagaaagccctggaaatgtgtttctgttacagcatctcatccatacaaaccgaaaagtacatttcctgcaaaacatgtaaacaaaatgttcaccgaaaaaagaagtaataatggtctttttttcttcttcttctcatgctgcagtttatttacaccaggtcaattgctctggtgtaaattacactttttaaggatttacttaagaaatttgaaggattttcctctgggtctgggactaaactaaaacaaaagtgtcttaagcataatttttctcacttgggggtactgcagagctcctggctttacttaaggagataaagaggatatgaccttcgagtagaggagataagaaacatttagtttaaaataaatacataaataaaagaaacatcctgcccacaaatataaaaggaaacaggaagaatctttgagatggagtcttgctctgtcacccaggctggagtgcagtggcatgatcttggctcactgcagcctctgcctcccgggttccagcaattctcctgcctcagcctccttgggtagctgggattacaggtacacgccaccacacccggctaatttttgtatttttagtagagacagggtttcgccatgttggccaggctggtcacgaactcctgacctcaggtaatctgccccgccttggcctcccaagaatcttgattccaaagcgacatccagctctgaagagcacacactgtggatgctgggctgctccatcttcccactagagggcgcaaaggctttagttaaaaaccaagccaaacccaaaccatctactttgatcagttgtttgttttaatttcagtaggttttttgggaacagatggtgtttagttacatcaataagttatttagtggtgatttctgagattttggtgcacccatcacctgaacagtgtacctggtacccaatgtgtagtctttgatctcttgccaccccccgccctttcccccgagtccccaaagtccaatgtatcattcttatgtctttgcatcctcaaagcttagctcccacatatgagtgagaacatatgatgtttggttttccattcctgagttacttcagttagaatgatagtcttcgattccatccaggttgcacaaatgccatttcattcctttttatggctgagtagtattccgtggtatgtatagggtatttgggctgattccatatttttgcaattgcatattgttctgctataaacatgcatatgcaagtatctttttcatataatgacttcccccccacccctctgggcagttacctagtagtgggattgctagatcaaatggtagatctgcttttacgaatctccacattgttttccatagtgattgtactagtttacattcccaccaacattgtaaaagtgttcccttttcaccacatccgtgccaacatctgttactttttggttttttaaattatacccattcttgtaggagtgaggtggtattgcattgtggttttgatttgcatttctctgatacttagtgatgttgagcatttttccatatgcttgttgcccacttgtatatcttcttttgagaattgtctaattcatgttcttagcccactttttgatgggatttttttttcttgctgatttgagttctgtgtagattctggatattagtcctttttcggatgtgtagattgtgaagattttctcccactctgggctgtctgctaactctgctgtcctttttaatttaaggtctttaaatacataataacaatctttccttactcataataagaagaatacagatcagaattaaactgagaaagaaagatttcaaaaagttggcagggcattctgtaagcaagtctgtatttttttttttttttttttttttgcgtaagagaccaggggaaatgagaatatatatttacctattctagtttttgcatgaagaaatactagaggatggagaagaaactttgggagaaaattttgcctataagagccagggatgaaacgggtgaagggtgccaggattggcataattcttctagtgtagctttttatatagtttttgacttgggactcaagcaaagattattcaaaaactatgactatgctcaagttgtataactgaatttgagtttggttttatttaggagacaactgctttaactccaaagtacagcaaatttcctttggaagttcataattgttgttaatttgctgtgagtggccagaatctgcttttggtgattttaaattgtcaacccaacatacgtctttgttgtttattgcaagaattgttatagtccatgacattttttatttgcttcaaaataaaatgaggatatgatcaggtggtcaggtaactttttatgattcagcagagtggaacaaataatttcaattacataattgcttaatgaaccaaatgcagatacttgaattaactaaaatgcagatattcaaataaaggattgcaccttacccaaataaaagttgatgttgcttctaattatttctaactactttgtgtgagaattatacagagttctggagacattacctatattagaacatcatctctcaaaactacatctgtaaatcatactttttaagtcttatcttgtcttattccttattctgaaaatgacaacatttctattaagatttatatctgatttgacttcaaattttaatcgtaaagaatgaaactagacccccatctctcaccatatacgaaaatcaaatcaataggggttaaagacttaaatgtgagacctgaaactgtgaaactgctagaagaaaacattggggaaatgctttaggacattggtctatgcaaagatttcttgagtaagaactgaaaagcacaggcaaccaaagcaatttggacaaatgggatcatatcaagataaaaatgttctgtacagagaaggaagcagtcaacaaagtgaagagaaaatctacagaatgggacagagtattttcagattattcaacagtcaagggattgataaccagaatatataaggagctcaaacaacagcaaaacaatgaataatctaattttaaaataggcaaaaaatttgaataggcatttctcaaaagaaggcatacagatggccaacagtgatgctcaccatcactaatcgtcagggaaatgcaaatcaaaaccacaatgagatagtgtctcacgtgttaaaatgacttttttcttttttgtaagtttgctctttttttaattttaattttactttaagttctgggatacatatgcagaacatgcgggtttgttacgtaggtacacttgtgccatggtggtttgctgcccctatcaacccattatctaggttttgagccctgcatacttaaggtatttgtcctaatgctctctctccccttgccccctaccccctggcaggccacatgtgtccatgtgttctcattgttcatctcccacttatgagtgagaacatgcagtgtttcactttctgttcctatgttagtttgctgagaatgatggcttctagcttcatccatgtccctgcaaaggacatgaactcattcttttctatgactgcatagtattccatggtgtacatgtgccacattttctttatccagtctatcattgatgagcatttgggttggttccaagtctttgctgttgtaaataatgctgcaataaacatacgtgtgcatttgtctttatggtagaatgatttataatcctttgggtatatacccactaatgggactgctgggtcaaatggtatttctggttctagattcttgaggaatcgacactgtcttctacaatggtttaactaatttaaattcccatcaatagtgtaaaagcattcctgtttctccacatcctctccagcatctgttgtttcctgactttttaatgatcaccattctaactggcatgagatggtatctcattgtggttttgatttgcatttctctagtgataatgaactttttttcttatgtttgttggctgcatagatgtcctcttttgagaagtgtctgttcatatccttcgcccactttctgatggagttgtttgttttttcttgtaaatttgtttaagttccttgtagattctggatattagacctttgtcagatgggtagattgcaaagactttctcccattctgtaggttgcctgttcactctgatgatagtttcttttgctgtgcagaagctctgtagtttgattagatcccattagtcaattttggcttttgttggaattgctttttggtattttagtcatgaagtctttgcccatgcctgtgtcctgaatgatattgcctaggttttcttctaggatttttatggttttaggttttacatgtaagtctttaatctatcttgagttagtttttgtataaggtgtaaggaaggggtccagtttctgttttctgcatatggctagccagttttcctagcaccatttattaaatagggaatcctttcctcattgcttgtttttgtcaggtttgtcgaagatcagatggttgtagatgtgtggtgttgtttctgagacctctgttttcttcctttgatctatgtatctgttttggtaccagtaccatgcggttttagttactgtagccttgtagtatagtttgaagtcagcgtgatgcctccagctatgttgtttttgctttggattgtcttggctatacgggctcttttctggttccatatgaaatttaaagtagttttttctaattctgtgaagaaagttgatggtagcttgatgggaatagcattgaatccataaattactttggacagtatggaaaatggcttttttctaaaacaaaaaaaataacagattctgggaaggatacagagaaaggggaacccttgtgcactgttggtgggaatgtacattagtaaagccacaatggaaaacagtagtatagaggttcacaaaaaaaatgaaaaatagaattaccatatgatccaggaatcccactgctggatatatacccaaaagtaaggaaattagtatatcaaagagatatctgcactgccatgtttattaaaacactattcacaatagctaaaatatggattcaagctaggtgtccattaatggatgggtggataaaggaaatttggtacatagacacaatggaatattatttagtcataaaaaagaaatcctgtcatctttagcaacaatagaggacattatgttaagtgaaataagccatacacagaaagacatactacaagttattactcatatgtgagagctaaaaacactgatctcatggaggtagagagtagaacgatggttattggaggctggggaaaatgaggaggggttggttaatgggtgcaaaaatacagtcaggaataagatctattcattagcataatagggtgattatgcttaacattaatttattgtatactttaactggaagagtggatttggaatgtcccctacattaagaaatggtaaatatttgagatgatggatatcccaattaccctgctttgatcattacacattatatgcttctatcaaaatatcacaagatctccataaatgtgtacaactattatgtacccgtgaaaattaaaaataaaatttttaagaaaaatttaaatttcagagtgtgtatcatttcaccttaggaacacccaaacatgtttataaaccattttaacattgtaaatctcaaccagtcttctgagatccaatcaattggaatttctttagcttcaggtaatagctcagctccattggttattaaagagacatattagaataaatgggttccctcttctttaaggaaaaatgagcttatatttcttcattaggatttgcatttatttctgctcaagcctaagagggctgctagtttaattgcactttaaatacaaaaatctaagttttttggactataaatatagtatgaaatccagctccaaacccatatgaaaataagctagaggccatgaattcatttgggagacttactcttcctccaccaagaaccaaggtgaggtagacaaatttctatgctgttactgcagagcattttgttttctaattcaccttttcaccataagtgtagcactttatgtgtgcataaggatatctggatgtgggtcctggatttaaatttcttgttcttctgagattggcccttaaaaacccaaatcctaggtcatctaggaagctctaaatttcctccaggcaaggtctttagtgtttatttacatctctatattcatattcctacttcctctctgtccttaggtgaatactttcttcaactcagagccgcatttaggggacatttttcatatttatttttttgagacagagtatcgctctatcatccaggatggagtgcagtggtgcgatctcagctcactgcaacctccacctcctgggatgaagcgattctcttgcctcagcctcccgagtactgggactacaggcatgcaccaccacacccagctaatttttctatttttgatagaaacagggtttcaccatgttggacaggctggtctcatactcctgacctcaagtgatccaccagcctcagcctcccaaagtgctgggataacaggtgtgagccaccgcacccagtctcattattaatatttaaatctagcattttgatacttttagtaagaaaatgtttggatctttggttcatcatgttgctagaaattgaattcttactcctcatttaagaaaggccaccttaaattacatactcaaatatacactagtttttcaggacttaaggctaactctctggggcagaggaaagagaagaatttgtaattacttatctctgataggcaaacctcttctctctgacagtgtttgagcaagcagacttgctgagttcagtctgttacctgttttctgagcattattgttcaaggccctgggcctgacataaacagtcttgagggatttagcaatttaatatggatctgcatgcttggtgtactttgtacttacaattgagctccactaaaacgaatgtatgaggtgctggagaaagcttcaatcagggtgtgtgaagtttcgatgccagattgggggaaaacagcaggaaatataaattcactaggcatctgtagattttgaagttggaatatggatttcttaattaactttgataggcacatctaaagtagctaaagacaaataaaaattttacctctgaaccttttcatatcagggtttaatcttttgccagtattctgtataaaacaagtagaaatactttaagttcttctccctcctctgtgtgtagctcatctgttgagtgataatcgtacagaaaaattcaccattgtcaagctttctctgaatctcttcaagttagttgcttcctctgcctttacagagtagttcacacaagtccctattatgtgacttatcatatgatgttgaaatacactggttgtttttcctcctaaatatatttgcctaccctgataataacagctttcatttgtgagcactttataggtgacaagacatagatgtatattacatttaaactatagcaaacatgtgagatagatataattattcccattttatagatgaggaaactgaggattatgaaagtgatttgaacttgcccaaatcttaacagctaataagtagaaagatcaggattaaaccaagcatgatcttcacactgtgatcttgacaaccgtactggatacttacactgtgatcttgactactttgctttagtgacaagaacatccccctttttacttttgttaactgttctagcgcctggagatgtttctagaacatagcaggcactcaggaaatgtttactgaatgaaagacagtgaaaaatcaaatatagctttaatggaaacttttatgaatttagagtgagctccaaatatttacacataaatcaaagttttacttttggcatatcattgcctcaagaaataggaatgtgccaactagcaaattgtatatgtacacatacacacactatatgaaatgtagataagtaattattgtaacattagaactgtaatatcatgtattgtaaaatcagaatattcaggtattgaattttatctctaatctatcttaagattccccccatcactgagatcagggctgggcaaactgctacctttaggccaaatatggtctgccacctatttttataaataaaagcttaatttttatttttatttattatttattattttatttatttttttgagatggagtttcgttcttgttgcccaggctggagtgcaatggtgcaatcttggctcactgcaacctccgcctcctggattcaagtgattctcctgcctcagcctcccaagtagctgggattacgggcatgtgccaccacgcccagctaattttttgtgtttagtagagatggggtttcaccatgttggtcagggtggtcttgaactcctgacctcaggtgatccacccacctcggcctcccaaagttctggcattacaggcgtaagccgccacgcctggcctaaaagcttaatttttacaataaacattgcaatgtccatttgtttacatagtatctaaagatacaaaggcagagatcaataattgcaacagagactgtatggcctgccaaacctaaaatatttactctctgactctttatagaaataatatggtgacccctaatataggtcactattgttctatcactggttaactattgctttgctctacttcaaggatcttcaagttagatttaaaattcagccaggcgatgctcgtctatttataaatggccttcgtgttgatatggatgtttatgacgcttttaggtaagtattaaattattgctgtaaatgaactatggtttatataaaaataaacattgtcttgaatttagtgtaagtcaaaatatgaagatcactttaaagataaatacatgtttttgattgtacaaaacagctttcttctaccaaaatgggcaagcccaaagtgtcttagaatatcagaactgggagaaacagtcaagatatttgtttggatgagggttagacctataattactttgttattctaaactgtcttttattgaagagtagattgatgatttgcagagaagttatttggaactggactgaacaaccagataccagataaggactgaagtcaacatggggtatttccccagaagacagaaattgacaagaggaatttaaaatgcttgtatttgaatgctggatgctatctggtttcttgtcaaaaaaaaaaaaaaaattcttcaaaatttttttgctcagaattttgaacaggacagaattaggaagtccttgctttatcaatggtcactcacccaaaattacagttgtgggccaaacagaagagttacttttatagagaaacataaaactacattaaaattaatatttgaaacattagatgaacttaggatacatgatactttaattcagatgttcagttttaattcaattgaatatacttttgttgaagtgaaattatttgaattgtttatttaaattcttaccagtttggaaatacgttggaaaatatattggaaagactgagaagtagttttactgaacattttttacagttttatctcaaatggggcttttctctttagttacttgaattcttggacctagtattgtaaaaataataagatagatacatataatacacatagaaagagtagagaagtttgtaaatgctagcctgtaaatttcaggggaacaaaaattatatatgtgcccagcagcagtgaaaacaggtttaaaggaagtagtgaaatggtatgtagattttagaaagttttctaaggtagtgtatgaggaaatttttatggcaggaatattttcacgtataatttaggaaggctgtaggttattaaaaaaataaaaccccccagctcctacacctggtcattagtgatttgcaggatgtgtgctacattgttattcctcattgatttgatcactgcttagtgctaccatgattctcttaaaagaggaagagacaaaatgtgagaatatttgtgtcttcagaggatgtggaataaaattaatgcaaagaggaagatgaatggaagaaaataaggaaatggaagtaaaatgtcatattacagagacattatatatagagaggttttatgcagccaatactttggaatcgtccatgtggggaaagaacaggagtaaaggatttattttgtgctcccttcctatctcctttcagtcattgcattactgggttgtggagaaccaataacatgccccatacatggcccagcccttcttgctctgatcctgagagtagcgggaggagccagagcctccatgggttaggattagatcagcattggttctataaaggcctacatctcacccccagggagactgagacagtaagaacatgtgactttgactggggagaaaggcaagtaggactgatgaagtccataagcagggtcttatatatctacattaaaacattctgttctagcccattaaagagtcccttttatatttttgcctctgaatagtcgcctcagccacagacttgatgaagagtagtttaaacatttagattccccaatttgttgtcaatggggttattgttgatgttgttgtttacagtaatactttctattatgtttaagaactttcaaattatatgtaataaaaaatttaaatttgtattcaaacacacgtgaacttcatgatttaatggagcttcctctgtattagaattttatactttatgtcttgttcgatcttacattatttttgtagtaggtttgtcaaaagagtgacctaatattttttttctcatttttggctttctcagggctgatcatatcctcactactttgataaagaatacaatagtctttgttgttttatcttttatataataataagtttttactaccactaaaattatgtaagtttactctggataactaattagaactgtttgccttatttcttaatgagtttaatatatttttcctgctattaatgaagataccaaaaaatctcatttctaatgctttaagactatcaaactttaaaacatttgtttttaatttggaaaatcaaaataaaactgttttttctttgaatatatagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatggtaagtgcttatgctattccttgttctaaaacctgtagtatacttaaggcttaacataaaatgaagtatcggcaggcctgatgataaatgtcagcattttggaacagttctcagtgaaaagagaaagtcaaactatagacccatctcctctcccacttgcagcttccttctccttcttcatagtctctgttttgtcacaagaatacctactcaatctcattcagtgtcttttccaccttcagagataacaacagaataaccacatgaacaataacaacaagacaccaaatacatggttaaaatctgaggtgtatataaaagtgctaccttaacatgatgaaagtcctgccgaaacaatttgcagcggcctccaaaggttctggtgtgtgtattacagcccaagtgatttttgtgaaaaacatttgatcatatcaccctttcttgcttaagcagagaagtggtcttcagtatggcctatgaggctgcagatggctgctgtcacctttcatttcttagactgtgaaacgttcttttcactactatcctttgtctcatgcttagaaagcactttttttttctctatccagttaactcctattcctttttcaaagttaggttgaaatagccctttctgagagaaactttccttaacaatccagatggttttttaaatctacatgttgtgttaagagaatccccagagaccaacctctaatccagtgatttgctagaaggacttgcaagacccagaagttgttatattcatggttatggcttagtagagcaaaatgatgtgaaaaaatcagcaggggtgaagtccagagtaaaccaggtataagcttccaagagttccctcctagtggagttgtgtgcttaatgtgatatatgacaatgtgggcaaagtgcttcctaccagggaagctcacttacttgagcctgagttcaagattgtgagagacgatccatcatgtagacatacagtggctctctgtacctgccatcagtggctgaatctccggactgaggaaaagcagatgtttattataactcagattgtataaactctttagacaaactgctggaactgctgcagcatggctcagggtcctaactgtgcaaaacactcttttatcaatcagaacattccaagagcttaattatcaggacccagtcaagagacagtcatgtaaacagacccttcttgggaatatccaaggtgtgagcaacccaagcctcttgagttaaccctttcatacacacacacgtatatgtgtataatgtgattcttcatacatgtatacatgtatgggtatagcacatgtattaggccatgcttaccttgctataaagaaatacctgagactgggtaattcataaaaaaaagaagtttacttgacttacagttctgcagggtttataggaagcatggtgccaacatctgtttggcttctgggagctttaattcgcagcagagggcagagagggagcaggtatctcatatggcaagaacaggagtgagagagagtgttggagggtaggtgccatacatttaagcagcctggtcttgctagaagtcacatcacaaagacaacaccaagacatgagggatctgcccccatgacccaacacgtcctatcaggccctacctccggcattggggattacaattcagcgtaagatttgggtggggacaagtatccaaattatatcagcacatatacatacattatatgtcagaactattaatccattcgtatacttagcacagttatagttttacatttatcctgtgatgcttttatatctgttttttattaggctatatataaagttcttgaaggtagaaattttttcattttttctcttaccattatgtccctggttttagtggtactcaataaatataaatattccctaaatgaataagtaactatttatctgaaaacaacaaaaaacatcatttttaatgatgaaactctggaagcattacaattacaacatgatcaatataattatccttaagatttaatattattataaaaggagtaactgttagaaatgaggaaataaaagtgttgtgtgacaagattgtataactgaaactcctcaaagaaagctataataaaaggctttaataaaatgggtttgaagtgacatgataaagatcaaaagcttttctttcaagatctatttggaagataatgatttatttacaataacataaaaatgtaaataccctaataataaccactatgaaataatatctcaatacctattgataaaaactagaatttaactgaggacgtgtaaatcagcatatccttttaaaaagttatgcctggccaggcacagtgtctcatgcctgtaatcccagcagtttgggaggccaaggtgggcggatcatgaggtcaggagattgagaccatcctggccagcatggtgaaaccccgtctctactaaatgtacaaaaattagctgggtgtggtggcacgtgtctgtagtcccagctacttgggaggctgaggcaggaaaatcgcttgaacctgagaggtggaggttgcagtgagccaggatcgccctactgcactccagcctgggcgatagagcgagactccatctcaaaaaaaaaaaaaacaaaaaagttgggggtgcgcgtgggggctgggcgtggtggctcacgcctgtaatcccagcactttgaggagcacgtggtgggcaaatcacaaggtcaggagatcaagaccatcctggccaaaatggtgaaaccctgtctctactaaaaatacaaaaattagctgggtgtggtggtacgtgcctgtagtcccagctacttgggaggctgaggcaggagaatacgttggaccttggaggcagaggttgcagtaagctgaaatggtgccactgcactcaagcctggcaacagagcaagactccatctcaaaaaaaaaaaaaaaggttatgcctgtggtgcccttataacgatacatagtttgtctagtaatttctctcctggaaactatcataaaaaaacagtgggaaatggaaaaaaagctttgtggccaaagatatgattatcactacatattttgaaaacaaagtagaaactagttatctaacagagaagcgttataaattttacattcacacaatcgagtattattgacatgaaaattatgtttataaatatgacttaagataatgattctgttaagtaaaaaatatagaattatgtcatgtaaaaatatgggcagaagatcagaaggaaatatatcaaaatttaaggcattaatgggtgatgtggtttaatgggtagttttaatttttttcatcatgttcttctgtgaattccaaacttttaaccatgggtatgtattatttacatgatcataagaaaatagttttttggttttttaaattgatacacaatattttacatatttatgagattcatgtgatattttcttatgtatgtaaggtgtgtaatgatgaaatcagtgtatttggggtatccgtcactagcagtatttatcatttctatgtgttgggaacattttaagtctttttttctagctactttgaattatgtaatatattgctgctaactatagtcaccctactttgctattgaatagtagaatttataccttctatctaactgtatagataactgtttgtacctattgactaacctctcttcatcaacccctcccaccagcatgcccttcccagcctctggtatctatcattctactctaactccatgaggtcaatatttttatttcccacttacgagtgagaacacaggatattggtctttctgtatctggcttatttcacttaacacagtgacctccagtttcctccatgttgctgcaaatgacatttcattcttttctgtggccaaataatactccattgtgaatatataccacatattctttatccattcatctgttgatagacacttaacgttgattatatatgtttgctatcgtgaatagtgctataataaacaggcaagtgcaggtatctctttgagatgttggtttcttttcctttcaaaaaatacctcataatgggattgctggattggatggtagttcagtttttagatttttgaggaatctccatagtgttttccattgtggttatactagtttacattcccagcaactatctataagagttccttttttccacatcctcaccaacacctgctattcttttatctttttaatgatagccattctaactggggtaaaatgatattccgtgtcacttttatttacatttatctaataattagtgatgttgaacattatatacttgtttgccatctgtataatttctttatttttttcattattattatacttttaagttttagggtacatgtgcacaatgtgcaggttagttacatatgtatacatgtgccatgctggtgtgctgcacccattaactcgtcatttagcattaggtatatcacctaatgctattcctcccccctccccccaccccacaacagaccccagagtgtgatgttccccttcctgtgtccatgtgttctcattgttcaattcccacctatgagtgagaacatggcggtgtttggttttttgtccttgtgatagtttactgagaatgatgatttccaatttcatccatgtccctacaaaggacatgaactcatcattttttaaggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgtcacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagcatctgttcatgtccttcacccactttttgatggggtcgtttttttcttgtaaatttgtttgagttcattgtagattctggatattagccctttgtcagatgggtaggttgcgaaaattttctcccattttgtaggttgcctgttcacactgatggtagtttcttttgctgtgcagaagctctttagtttaattagatcccatttgtcaattttggcttttgttgccattgcttttggtgttttagacatgaagtccttgcccatgcctatgtcctgaatggtttcttatgagaaattcagatattttgctcttttaaaaataagattgtttattttattgttgagttgttcaacttccttgtatattcttaatattagcccctgtagcaatagtttgcaaatattttctcccatcgaacaggcttgctcttcactctgttgattttttttcctttgctgtgcagaaggtttttcccatttgtctatttttacttctgttgtctgtgtttttgaggtcttagccataaaatctttacctattagaccaatgtccaaaagtgtttgccttatgttttcttctagtagttttatactttggggtatgtttaagtctttaatccatcttgagttgatttctgtacatggtaagtgatggtggtctagcttcattattctgcatatcgatatcagattttcccagaaccatgtattcaagagggtgtcctttcccaaatgtatgttcttggcacctttatcaaaaatcaattggctataaatacatgaatttatttctggattctctgttctcttccattggtctgtgtgtctgtctttatatcaataccatgctgttttggttactgtaactatattttcaaatcaggtggtgtgatgcatccagttttggctttggatattcaggttcttgtttggttccatacgaattttaggattttttttctatctctgaaaaatgatgatatcttaatagagattgcattgaatctatagattgctttgggcagtatcatcattttaatatttatctgaaccatgagcatgggatgtttttccatttatttctgtctttttcaattttttcttgtacagatcttttacctccttggttaaattaattcctaagtattttttgcagctactgtaaatgggattacccttttgatttcttttttggctatttcattatttgtgtatagaaacactactgatttttgtgtgctgattttatatcctgcaactttattgaatttatcagttctaagaattttctggtggagtccttggtttttctagatatacaatcatgttgtgtgcaaagagggacagtttaacttcctcttttccaatttggatgcatttgtttttcttgcctgattgctctggttaggacttccagtaccacattgaataggagtggtgaaagtgggcatccttgtcttgttgcagttcttagaactcagcttttccacagtgcgtatgatgttagctgtgtgtttgtcatttctggcctttatattatgctaaggtatattcctttggtgtctagtttgtttagagtttttaatcatgaatgaatgttgaatttaatcagattctttttctgcatctattaagaggatatggtttttttttcttctattgatgtgatgtatcacatttattgatttgtgtatgttgaactatccttgcatctctggggtaaatcccacttgatcatggtgtattatatttttgatatgcttttggatttggcttactagtattttgttgagaatttgtgcatctgtgttcatcagtgatatggtttggctgtgtccccacccaaatttcatcttgaattcccacgtgttgtgggagggacccagtgggaggtaattgaatcatgggggcaggtctttccatgctgttctcatgatagtgaataagtcttatgagatctgatggctctataagggagagtttccctgagcaagctctctttttgcttgctgccatccatataagatgtgacttgttcctccatgcctcccaccgtgattgtgaggcctccccagtcatatggaactgtaagtcctttgaaccctttttcctgtttaaattacccggtctcgggtatgcctttatcagcagcatgaaaacagactaatacaatcaggaatattggcctgtggttttcctttattgttgtgtcctcgtctggttttggtatccgggtaatgctggtttcatagaatgtgagttaggaagaattctctcctcttcatttttttgggaataatttgaggagaatttgtgttcttttttgaaagtttggtagaattaggtagtaaagccatctagtcctggactcttctttgttgggagactttttattactgattgaatcttattactcattattggtttgttcaggttttctgtttcttcctaattcagtcttggtgtgttgtatatgtccaggaatttatccatttcctccaaggtttccagtttgttagtgtatagttttctataatagtctctgatgatcttttttgtttatatgatatcagtgtgcttcttcatttctgacttttttggaggtcttctctgtcatggttagtctatcaagtggtttatcttttcaaaaaacaaacttttcattttgttgatcctttgtattttttctttagtatcaatttcatttagttctgctctgatcttatttatttttttctgctaattttgggtttgttcttgcttttctatttccttgagatgcatcattaaattgtttatttgaatctttctcctttttgatataagagcttactgctacacacttctttattggcactgcttttgctatatcccacaggttttagtatgttgtgtttacatgttcatttgtttcaagacattttttatttcctccttcatttcttccttgacccagtaattcaggagcatgttgtttaatttccatgtgtttgtattgcttccaaagtttctcttgttattgatttgtagttttattccattgtggtgtgagaaaatacttgatatgatttcaatttctaaaaatttattgagacttgtttttgtgtcccaacatatggtgtatcctggagaatattccatctgctggtaagaagaatgtgtattttgtagctattggatgaaatattgggtaaatttctaaagtctatttcatcaaatgtacattttaaatccagtgttcttttcaattttccatctaggtattgctgagagtagggtgttgaaggttccagctattattgttttggagtctctctctctctttagctgtaataatgtttgctttatatgtgtaggtactccagtgtttgggtgcatatatgtttaggagtgttttaacttcttgaagaatttatccctttattattatataatgactatctttgtccttttaactgtttttgacctaaagttttatctgataaaagtatagctattcctgcttgcttttggtttccatttgcatggattatctttttccattcctttacttccagtttatatatctctttacaagtgagatgagtttctttaaggcagtgtatggatgggtcttgttttttaatccattcagccagtctgtatcttctaagtgtaaagtttaattcatttacattcaaggttattattgatatgtgaggacttatttctgtcattttattagttgatttctgtttattttgtgtgttctctgtttctctctctctctctttaacaattgtgtcttgttggttttctgtattggtaacatttgaatcttttctctgacttcagtggtttgttctaccagtggtatttatgtttcaggatggtagataccattctttcacttctgggtataggactcccttaagcatttcttgcagggctggtctagtggtgaagaattccctcagcttttgcttgtctgggaaagactttatttttccttcatttatgaaggataactttgctgggtatagtatcctcaactggcaggcattttcttacaggactttaaatatatcatgccattttctcctggcctgtaaagtttctgtggagaaatctgctgttaatctgatgggtgttcccactagatgcttttcacttgctgtttatagaaatctctctttctctttaaattttgacagtttgactataatttgccatgggcaaaaccttttggaattgtatctatttgggaatctctgtgcctcctgtatttggatatctaaatctcattagacttgggaagtctttatctgttatttcattaaataggttttctaatactttttttttaatcttctgggacagcaaaattcaaatatttggtcactttatggtgtctcatatgtcacataggctttgcttattcttttttgtatgtatttttatttgactgggatatttcaaaagtcttgtcttaaaattctgagattcttgattctacttgatttagtccactgctgaagcttttcaatacattttacatgtcattcaatgaattttctatttggttctggtaaatttctcacttatttcctgaattgtttttctgatatttttggattgttttaaagtattctcttatagctcactgagcttaatttcaatattttgaattgtttttctgggatttcataaatgtcttttagattgggatctgttgctggagaattattgtgttcctttggagattgcttatgttcctgtgtccttacgttgacatctgtgcatctggtgtaacagttacttattccattttttaaaaatttccattgttaggggaagactttttcctgaccatttatggtgttagttgcatagtacactttttggcattgattctcaatgtgtgcagtagggtaatctctgtatgatttcttcatctgtaaacagcatcagtggtgtctctgtttgctaggtggcttgtagcacagttgctagtggaggctgtgatgaagttttgctgaaatgtgggacaccagttgggccagacttagggccctatgggtggcgatggtgggttgagccttggcccccagggtggtgtacactagcaccagtgttagcaggtgcagggaggttgattcttgggcctctagatgacttgcttgggtgctgggaatgacagtggtaggtaggttcttgagcacctgagcagtggttgtggcacgggcaatggcagtaagtggcgggacaattctctaggacctaagggtccatgccagtgttggcagtagctgtgatgggctgggtcagccattgcccaggccctgaggtgatggtagtggcaggttgggtgggcatgacactgggaggtgtgctcagatgccaatggtaatggattgtgctgggtgatccccacgtccctggacagcatgcttaggtactgggggtgatagaaccaggcaagatggttcttaggccccatgttggtacattcaggctctggctatggttggtgggcagcaggggagcgggatgatccaccggccataggtggatgctcaggtagaggcagcagcagcagctgtgctgctgttctgctactggagagggtgaagtcactttcaacaggagcaattggaggcaggtggctggggcatgctttgctcatcctatgtccccccaccccaaaacacacacacacagtttgcagcaaatggaatttgtcctcaggtgcatggaaatgtgtgattgtccctctgctggggaggcagtgtgactgccagtggttctgccttggccctagcagggaatgtcagtgggaccccagagatatggagatgcgggggctgttaggccccagggcaggacacagtctgtgggagctgggctctcaaaatgatgccatactgcagtggcttaggactcaggggtttgtgggactgggcatgagctccctctctggatcagtggcattgtgcaatctccaggtagctccctctgttagtctcagaagcccataagggtgaaggggcttttccatggttaggttggtaggagtccgtagtggaaacgtggactgctgagggtctctcacttacactttccttgcattagggaacctctctaggcttccagccaatcccagcctagcagtctgccttatttccctctcctttcttgctttcgggtactcctgtcacttctctggtgaattccagtgtgctcccttagacgacctattcgaagtgtgattatctgcttactatattggttcctttccatggaagaggcaagtagcagatacatctattcagccatcttgaagccccttcttaaaaaaaaaaaaaaaaaagatcttaaggggaaaaatcctctctgaaatttttgctaattgttttatataaaaatgtaagggattctctctgaagcatctcagttattatagttagttttgccttacttgaaaaaccttcctgctcataaactacctgcctttggccaggcgtggaggcttacgcctgtaatcctagcactttgggaggcctaggcgggtggatcacgaggtcgagagatggagaccatccaggctaacacggtgaaaccccgtctctactaaaagtacaaaaaattagccgggcgtggtggcgggcgtctgtagtcccagctactcgggaggctgaggcaggagaatggcatgaacctaggaggcggagcttgcagtgagccaagatcgtgccactgcattccagcctgggcgacagagcaagactctgtcttaaaaaaaaaaaaaattctgccttctcagagccaaaggactatagcagcccgaaagaaacgccatattccctgaacatcagaaacttcagattcaggataaataacaaattactaagtagttatcatttgtgttttctagaacacgaagtgacttgttatatagatgtttgttactgttttctaccactctttagaccgtattctttcattggctagattttacttttactttgtctttaatctcaatagcagatgtcttttctaaaaatgttatgtcagaaaaaggaatgaccttgtaagtaatcttaatacttgtatctgatatttaagaatttgtgctttttagcttttgtagaaaagaatgctgagagagagtcacacagaaaattagtgcagtaattgtcaaggctcttctagacatagtaaacagacctataaagaaaccttcctattctctttgtaaaataatatcctagcttgcttctaaggttggcagtgaaggacagtcactctgtgtgtggaggagcagttggacttttaagcccttatgctgctcccattgtccccacactctgcaaagccccatttccctgagttgtctctcagattctggcaagctttcagatatcagtctcagacggtgtgcctcccttctctgccaccctgctgctttcagcagactatctcttcataagcactgataagactgctaatttgtcaagactaccacaggccccaaaccccaggaattccagtccataaggagtatagctggttttggaacccaccctccataaaggttgtgttcccacgagattgtcacaaagtagtttttattcaggttagatatacatggcataaaatttgctcttttaaccattcagtggcattaagtacattcacagtgttgtacaaccatcaccaccatttattttcagaactttttcattatcccgaacgaagctctgttcacattaaacattaaatccccatacccttcttcctgaagactctggtaagctctatctactttctgtctttattaatttgcctattgatatttcatataagtggaattatacaatattcttttgtgtctggctaatttcacttagcataatattttcagggttcatccatgttgtagcatgtatcagaattttgttcctttttaagactgaataatatttcattgaatgtatataccacagtttgtttatccattcatctgttggacatttacactgctgctaacttttggctattgtgaataatgctgtgctatgaactttgatgtacaagtacctgtgtgaatctctgctttcagttcttgtgggtatatacctagaagtagaattgctgaatcatatggtatttctgtgtctaacttttttgacaaactgccaaactgtttttcacagctgttacatcatttgtcattaccactgtcagttcacaagtgttcccatttctccacatcctcaccaattcttgttattttctggttttggcatgttttgctttgtggcaattgccatcctaatgagtgtgaactggtatctcattgtggttctcattacatttccttaatgactagtgatgttgagcattgattcataatacctgttggccatttgtatatcttctctagaggaatatctattcaagtcctttgcccattttaaattgggttctttgttttttgttgagttgtaggagtcctttatatattctggatattaattccttatcagatatatgatttgcaaatatttattcccattctgtaggttgccttttgactgttagtagtgtcctttgatgtacaacaaaattttaatttttatgaattccacctttttttggttacctttgcttggcacccttgtcagatatcagttgatcataaatgcagatttatttctgggctgtctagtctattccactgatctgtatgtctgtccttattctagtaccacattgttttgattactgtagctttatagtcagttttgaaatcaagaggtgtgagttctccaactttatacttctttatcaagattgttttagcttgtcgttaaattttatttcctgctctgctttgtgattgccttttactaacaacagtggcttaaatttattgagcagagtgccagatactatgttcagcatttaaaatgaattatctcattttatttgcacagcgaccctattaggtattgatagcatccccattatacagatgaagaaactgagacactaaaaggttatttgaactcatgcttgtaactgtgacatcatattacttagttacatttactgcatctgtttaaacatttcctaaagttcaaaagaaatatcactttatagactttatcttaaaatgaagaagtatgcacaaaaaatgaacaataatatgcagcagccctgtttgagcgctttgaaaactgaaaacttagggaggcttgaccctctaaccaaaccctctactgcccatgtgtacctggttgagggaaagagtgtggggctaaactctgagcacatttctcctggccgtgtcttgtgtgtgcccttcctgataagaggaagggttacatccttttataatttgtcctgcagagagggaacacctttattcatttcgtatactcagaagtattactgttttgcaactaacagaaaagaaccttatgagtagcaacagcctacacccaggtaccacctgatttgcataaatatcctatctagattcttaagcttgcatttcccactctcactaggtttctgttttgtttcattttttacctttttggcctattgcaacttttctggaaactaatctacctatttaccaggtgcacgtaacttgtaaaaaaatgatttgcagctgtatcatagcctggtggacacagactttaggccgcctgagatctattcttgtaattcatcctgtttcaagattcataattaaaaataggaacatagtattttgactttttaaaagatttgttgaatctacaaataccaatcatggttattatgatagcagtttgtcctacctgaaggattagtgctacactgagtaaacaaaccaaagtagttcacatttcttaagtaattcagtgatttgttctttatgccctctactttcttgtaagacatcgggcatagacaactgttacacattacaagttgagtgtcccttatccaaaatgcttgggaccagaagggtttcagatttcagttttttggattttagaatatttgcatatatgtgttgatgaagtgtcaaattctgtaaaatatttgaagagattcatttggagccaaatatgagtgaccagtggcctgtgacacagcccttaggagatcctgagaacatgtgcccgaggtggtcaaactacaacttggttttatacattttagggagacataagacatcaattgatatatgtaagatgtacattggtttggtacatctggaaaggcaggaaatctggaagcaggtgccttccaggttataggcagattcaaagattttctagttggtagttggctgagttgttatctggaatcaatagaaaggaatgtctgttttaagataagcagtagtggagaccaaggttttatcatgcagatgaagccttcaggtggcagcttcagaaagaatagattgtaaatgtttctaatcagacttaaagcatctgttctatcagtcttaagatctgctttaatgttaatgctgctcagctgtgtctgaattccaaaaggaaggagggaataatgaggcctgtctgactcccccttcccatcatggcctgagctagtttttcaggttaactttggaatgcccttgccaaaaggaggagtccattcagattgttgtggggcatagaattttatttttggtttacatacataatgagatatcttggaaaagggacccaagtctaaacatgaaagttatttatgtttcatgtataccttatgcccatagactgaaggtaattttagacaatatttttttaaattgtgtgtatgaaactaagtttgtgtacttgagccatcagaaaacaaaggtatcaggtgtggaattttctacttggagcatcatgtgagcactgaaaaagttgcagattttggaacgttttggattttcagattagggatgctcaacctgtagtatatttgacttatctctgaaacatttccttttgagcatgcttagggactctcacaaacactaaaagttctttttaactatagtaactattttcttttagatgataaaataatcagcacatggcctctggcagccttcccttcaaactgacctctttattctttaaacactacccccttctgacagggtgtctcatagatcatcttgattcttttttctccaaatgtggaacggcctattcaccaagttttttttttgtagaaaatagtgctaatgaccaaaatctgggcattagatgtgcacttcatattgtttcatataaaatattcagagtagaaaagagtgaagacagagcaagaaaaaattttcttcttttaaaagggcatatatttatgttggtagttctaattaacctctacctttatttcatctctttaaaccagtttcctccttttccattatatgatcttactcaataatgtgttcaaattacaattttggtcctcccttctgcactcccgccaaagttaaaaggctcttcttcttttgtaactcttggcactagtgccctggtattgcattcaaagtatgcaggttctgactgtccccttgtcagcatcatttgtccttcagctctctgaaaagaaaaagacattgcaaaatttttcttacggaatactaaagtatataatgcactcatagatttccataaacttagacgtagcatgaagggaacaaagacagtttcaaggttttctggatttaaccaaaactctccttttgctttgcactttgatggtaacaatgtcatttatcttttattacagccagctttggtgttgaaatttcacatataatgtgttcattcactgttgtagcagtcaactttttaaaagccaatttaaaatgacagaaaatatgcccaaagtaatgttaagaatcataatcataatagatctttaaaatttaaaaaacttaaagtataataatttctttaggtacatattgtcgtaacattgtctcattcagtaagagtcactccataaaagacatcaagacatttggatcatagcatattttcattatagtttttatatagttgtcttacattcttgatcaatctctagaggttttcttttccacatgagtatggagaatttagttaatttaactgccaagagtagccttggtgacaataatacaattttagggtgaattaaaacatgtcagtctcctaatctcataagctatgattttcatattatcttcatagaagggaaaaaacccacaaactcactttttcctcgtgacttggtaaataggtttcaataagatcatagatgcaaaatatcattggccttccatatccaagggttccacatgcctggattcaactaaccatggaatgaaaatactcaaaaaaagaaaaacaataaaaaaatacaaattttaaaacaatataacaactatttacatagcatttacattgtattaggcattacgtgtaatctagagatgatttaaggtatatggaaggatgtgagtaggttctatgcaaatactatgccattttatgttagagacttgcatattcttagattttggtatcctcggggagtcctggaacctatccccctacagatactagggggtgggtatatcttttgccaaaatcttatcagtatcagaatgaccacagataatgctttcatcttggaccctagcaaagcctggggccgtcgtatctttttttgttaatttctttttttcttcttttttttttcctgtggtttttcagagatagccctcatcaagtgctagagcactacttcttaaactatccatagtaagagaataacattttttccttaacctgttgccaatcaatatgttgtcctactcctatgactaatatgtatctttttttttttgagacagtctcgctctattgcccaggctggagtgcagtggtgcaatctcagcttaccacaacctctgcctcctgggttcaagcgattctcctgcctcagcctcctgagtagttggcactacaggcgtgtatcaccatgcctggctaatttttgtatttttggtagagatggggtttcactatgttggccaagctggtctcgaactcctgacctcatgatccacccacctcaggctcccaaagtgctgtaatatgtattttgtactacatgtggcacaccacaggagtttgatgaaccccaagctggcttataccatgttcagtgaaatgagactgatacatgctcaaatgtcatggccatgtcaaattactgcaagttgttgaacacttaatttctgtacttataggttattaacagtcttcagaccacaagtttagttgcactgtagttgagagtctcattttgtctgtctaggcacacttgcttttagtcaggaaaagtggcactgcttgaaggctctgtatgattctgagctccattgggaatgggagttctgattgccctttccaaagagctgccaaattctcaccctcagctgcctttgggtcaagataaggcctgtttcccctttggggctagactcctctgcacctatatcttcctttctcttttcttcctcagactgagtaagctcattgacttaccttcaaattcattaattctttcttctaactgctcaaatatgctgttgagctcctctcattaattttttatttcaattattatacttttgaattccaaaatttttatttggttctttttgtaatttttatctgtttattgatttgtcttcatgccttcctttatttagacatcgtttcttttagctattggaacatataccctaaattcctctgttttattcatccatctgtgtgtgtctcttaattctgtcaccttttctctgaagccactgcctctgacttagttcagtccacaataaactcatacctggattatctgaattactgtagaaacctaatttcttcaagtattatttgctccagactttctctcctttcctcttggatttttagttacctatatgctagatctttttcatatattcctaatctctctcacactttgtttggtttgtttattcttttctttgtagtttagttactataacagttgatctgttgtcacgtttactaatccctgtctcttctgcgtacagtctgcaattaaacccacccaataagttcttagagttcttaattataaatattatattttaaaaaccttaaatatctctttgattctttttaaacagattttagttctgtcaaaatttttctttttagaaatttttgtgctttttaaaaaatatattgatagttattttaaagtccttgtctaagtaatctttggggttttttattgtctttttttttttttcctgtttcatttcaatatttggtccttttctctttgcatgacttttttttttttttgtgagagccagaaattgatgaaaagctgtagaagcaaagagctaaggtttgttctggtagcctcagtgccagatgctcacttgcttctgttgaagcttgtttttaggctttgtgaaggctctactatttttgtgtcttacttctaggatctggccttactgggtctcaaatgaaagtctacagtgtatatagtactatatagtacttggactttggtctctgtcttctcagtactattttatagctgtggtttcaacctctccgtttctctttccttctggcttttgtagaggtgttaccatgtatatgtgcaggataggagtcagcaaatgacttgagaggaatttgtatggagatttttctggtttcctgcagtttccttctctcctaccctctcaccctgcatcctgccctcaaatctcagcactttggcagcccgtactttgacttctgctttccaactcagtatttctccaggacgcaatctggggacccagggatgaagtttaggtgaatgtggagcttgctgcttatgcctcctgctttcaaggaccataatgcctcacttcttgattggtggttgcttccccgaccacatgcctctaaacagcagtttatatgttttctccagcttgtatagtggattagaacttgatttctaagatgttgattttataatttaatttttataagccattttattttccttatatccaagcctttaaattgagaggggaggtggagagggcttcatttactgctgataattaaaataaatattcatctctcttaagtggtttatggagagtaattttcatacaattttacgttgggatatgaaaaacaaacacaagtgaaaggaattgtttttgagagaaggcttaatgtaaaaggctacacaagtataaaattgttgcacataatgtattccttaatttagagaatattaaactagctcctctatttaatcagaaatatagaaaattctatgtatatttttatttatcacgatatagtaaaaatctggctttgaaaatgatttcagtgttaatatagctttcacaagtgtctgcgttcttttctagtggattaatgacttagaaaatgatgatttgtatattacatggcctacaagttgccagaaacttctgaagccagtatttcctggaagtgtaccttccataaggcgcaattttcataatttggtgagttttatattttgattatacatatatatcttataaagatatcagcattctttctggattatccttctgtcaatgaataggcatctgagttgtaaggaagttaagtatttgcctgaagcagcaagcttaggtggcatggctgactgggtatcaacaactagccatgtcactgtattagtccgttctcatgctgctaataaagacatacctgagactgggtaatttataaaggaaagaggtataattgactccccagcatggctggggaggcctcaggaaacttacagtcatggcagaaggggaagcaaacgtgcttcttcacatagtggcaggaaggagaagtatgagcaaaaggggaaagccccttataaaaccatcagatgtcctgagaagtcactatcacaagaatagcatagaggcaactgcctccatgatttaattacctcctactgggtccctcctacggcacatggggattatgagaactacaattgaagatgagatttgagtgggcacacagccaaaccatattagtcacatgttctgcctcttactctttagcccttatgtcattttataataaccatattaatgttacttttacattttttcaaaagaatttatgacagaactttttcttctttattaaaaagaactaatgattaaagtgtagtaattttagggaaagatacataaataccactttatcatctatgcatataattttattagcccaataatatctaaacattaatattggaactttgaaagttggagaaaatacctacggctgttttttcacataggaaatgaataagatattttttgcagcagtcttgataaagcagttatgttaatgctatttttttttggtcaaaattcaatctctatttccttttgaaaaaatttatcatagaaaatctaatgaacatttagaataaggtatttcaattcaggcaaaataaaatatactgggcttccaaaaagaagatgagtagcctgatgttaaattccatgtataattatgtttggatgtgcagcttttagaaatccttcataaattgtgaaatcctttatatgtgtgtgtgtgtgtgtgtgtgtgtgtgtgtgtgtattccttagaattgctagaatttctttaaaaattacacattgaatttcatactttcagtcacaaaaattagtctaaacttgaatttcatgaagattctaaggtgttgaaatagtgatatatactatctttcttttaggttctgtttattgatccggcccaagaatataccttggattttataaaacttgctgatgttttctattctcacgaagttcctcttaggtaattgtcattttatagcattaaactgtcaactaaaggaaattcaatgttattcatattgtgttacacagagtattaatagggcattcaaagcgatggttagctctagtgcctgacataacacagctgcacgttgtgaagtattatatacctttatgttagactctgtttatcaaatctgtctggtaatgttgtttattacctttctgagagaataatctgatcactctggaaacttatagaaaggtccagcttcatatgcttgtaatcccagcactttgggtttgggaggccgaatcaggcagatcacgaggtcaggggttcaagaccagcctggccaatatgatgaaaccccgtctctactaaaaattcaaaaattagcaaggcgtggtggtgcgcacctatagtcccagctacctggaggctgaggcaggagaatcacttgaacctgggaggcggaggtttcagtgagcctggattgtgccactgcactccagcctgggtgacagagcgagactcttgtctcaaaaaaaaaaaaaaataaaaagagtatatttaccctttttgtacaaaagaacatggccatttgataatgttagcactagagggagagagagtgatattttataggaatccagtagctatgtggattttggtgaataggcattacattcaaacttttgaagtgataaaattctccttttctctgtctattaatacattctctccatctagatattgtagtctaataacgtttctaaataatggtttattgtgattcaagaggtaattataacagtccttgttcatcttctttttccagaattggttttgtgttcattcttaatacagatgatgaagttgatggagcaaatgatgctggagttgctctctggcgagctttcaactatattgcagaagaatttgatatatcagaagcatttatttctatagtacacgtgagtttatgcactaaatgtgatttgtttagaaggtaaaattcttgcattactatattatgatttctttagaatgtataatttttgcattacatttattgtaacatttcaaagtttataaactgtcatggagattaatacagatgatgaatttgttttctgtaactcccttctgaagtacatattatcctcacattataaattaggcaactgaggttctaccaagatatttgaatttactaaggtttactcagccaataaagtaatttaaattttatatgtaactttagaggaaaacatattaatagaaaatgattatttaagaaaaaattcttgaactaggctttgattaaagagatcattgcaggctgggcacagtggctcatgcctataatcccagcattttaggaggccaaggcaggaggatcgcttgagaccagcagctcgagaccagcataggcaacacagtgagaccctgtctctaccaaaaaaaaaataaaaaattccaggtgcagcggcacatgcctgtagtcatagttactcaggagactgatgtgggaggatcatttgggcccagaaggttgaggctgcaatgagccaagatcgagccactgcactccagcccaggcaatggagagagcctgtctcatggaaaaacaaaaaatcattgcagagttaaatattctgaatgacatagcatataaacacttcctagagactttcaaagaagggggaagtcatttattgacagcaaactgtgtgaaagaggtaaggttgatacagaatctgacaaagagatcatataacagatgatagaaattggtaagaacctgattaaggaagaacaagagatagtaagattatttcgtaattgaggttttgaaattctgttatggatcattgtggaaatatatatgtattaaagagctatattgttgttattaagaaaagtcaagtcatagcttataaaataacttataaaataagtcatagcttataaaatagaagttttttttcatttttatattcattgggctttagcttgtcaatcaatattatatcaaggaatgactcttcttccaactgagaaaggaatttccaaagtagtgcaaatttcctaccctacttctgtaactcccaggaaaatcattaaataccttattaattcactgagctagagtatagaaactacacttcagtgatttggcaggggtacagtttgctctataaaatagtgccatggaatatgcatcaatattatgtctcagcttatttgttttactaacttactggtgtaagagtttataagggacatagtcaatttgagttacatcttttattaagattcaagattcagccattttattgtaaaggatcattatgatattcaaaacttagaaacctgaagatattcagaaattatctttacctaagttatcttaattatcaatattgaatctctgttttgtaagtgttttttatcagacattaatttacatgtgatggcattaatctacagtgttcagcacaatactgttaatatataatctcctggaaaaacaaattatacttgaaaccacagggtttaatacaaagcagcataaaagtaagtattaaatttgtggcacagcctgcaagttgtgctaaacaattagaaggagagggagaaggagaaataatttgaacaaggcatagtttttaggaaaatacatgaattataaaatcttttaaaagtgtttgcctgttttcagtgagctaattaccttatctcaattaagtaatttgaagctatttagcactataaagagagaagaatataagaccaaaataataataaaatatatggaagttattgaaatgtgataacaaatagcaaatattaaagttaatccaaccatatctgtgaccatattaagtgtgaggaaattaaactttagcatactagcagaaaagatataaaaagacagaaagttatacacaaggtgactatcacaaatgaaatctaaggtagccataaaatattaggggaaataaactttaagaaaaagtactaaagttgtatgtagcttcaaaatatacaatacaaaatttgatagcaagggagataaatggacagtttcactataatagtagtaggttatttcaacattttttaataggtgaagcagattaaaaatcagtaaaaatatataagattttaacaatacacttaagattaattttaaaggcaaatataatatccaacaatcagagaatgagatgattttgcattcaaaacagaagaggaaaatatgtcttttagttagaaaaggagttaaaagaactagttaaccattcagaaatgagtaactgatttttaaaaagtagatggaaagtaataagaatatacattaatgaactaggaaataatacaattatgggatcaagaatataaaagttgatattctgaaaaaacaaataaaattgacaaactatcatagaggttaggttccagatgagcacaccaggtataaacttccagactcttaaggcctgggctcagagatgggtacatcattactttcagtttattccgttgtattctgtttatcaaagagtcacagattcagattcatatacccacttctcaatggaaggagtgttgaagaatttggagaccatgttttaaaactagcacagcaaattctaccaaatattcaaatgtttgaagaaataataatttcagtctttaaaatatcttttagagaatagaaaaagaggaaatattacctaaattagtctatgaatctaatataatctgatgtcaaagcctgacaagaagagaaaaggaaaaattataggctgttctttgttgagaatatgtatgccaaagtcctaaataaaatattaacaaaagaaatccagcaggtatataaaaagtaaattatcatgacaaggtgagattatctaatgaataaaagaaagtatttgcaaattcaaagaatctctaaatataattcaccatgttaatatattattcaagaatatgcacaagaaacatttgaaaaaattcaaagcttttttatgattaaaaaactcataaagaaacaaaatgtttagcgaactattatgtaagggaattttgttaattgatgacagcacatcttagcagtaaaatgatagaaagcattgtttttaaaaatggaaaaagataaggtacccactgtcaacacttcaagtataatcctcaagttccagtcaatgcaataagataagtaaaggaaatactcatttaaaatatttaaaagaaacaaatttttatttaaaattccagacttgcctacagaggagactcaaaagaatccattgattgtgagatttgacacaggaggttagtaaagtaactggatatgagatcagtatactaatatcagttgcttttctctcttctaacaacaaatatttattaattattttcatcagttttattaaatgcctactacataccacaccctgttttaggtgcttggataaattaataacatatatagccaacaatccttatcctcatgagagtactttctgtaatgactcctacatttacaatgacaagagcaagcaaataaaagatacttaggaaacctgggggctggggggaaggtcagttttgtggagaaaatttggaattatagccatgaaagtttacctaaatgaatgaaaagctctaccatgtttatcaatagaaatatttcacttcataattatattgttttctgcaagtgatttctaaattcattgcatttccgaccaaagtggaattttggggatttttgtgaaatgtgatgttttattttaaaatttatatggaagaatgaagactcaaaatgggtgagactttgaaggataaagtgatgggacttgtcataccaggtaataagatgtataaagtttgtggtattggttcagggaaagacatatctatcaaaagaacgtgggggtcccaaaacttaagaatacagaagtgacattacagtaaatgggagtggacttacaacaactgtggttcaacagtggctataccaatgcaagtaaataagactttacaccttgtgtaaaaatcatttgagttagcttaaaaatgtaagtgtggaaaacaaaactttaaaacatttagaagttaggacctcaaggtaagggtttcctagataaaacttaaaaagctctaagtctgcaggaaaatactgataatttcagctaaattacaaatgaaaaccagtgcccattaaaatatgtcattaaaaaatagggaaaaatgttataagcaggagaagtatttacaatacatatggccaataaaatatttatattccatgagatgtaaacattttctacaattcaaaaagaaaaataccaatgacccaagaggagaaatgcataaaataacttttaaaatagaagatgcattaatggtaaataaaaatatactgaaattattggtggtaaatatttattaccattaatggtaactaaacaagataattatcttacaaatttgaaaaatgcaaataaagactacgaccacaagattattttataccctgtaatttggcaggaattaagaaagctgaaggtatcatttgttaatgagaatgtagagcaatggaatgcctttacatttacattgctaccctgcctgtaggaatctaaactggcagagccacactgaaaaacaatctgataataattcactatttgaagttaaatttccacatttcctacagacaacacacacacacacacacacacacacacacacacacacacacacaccccctcaccctaagagaagctcttgtacctgcaccttaggaggctattgttagcagaatcattcagaatagcaacaaactatgataaatatacacatatatacatatcagtagcaaaatagataagtagaatttggcatattagaatgaaatatcatatgcaagagcatagatgtattagaaacataatgaagtcatagaagactaacaccataccatatacttcttaaagctcagaagcaaacaaaactaagtatgggaatacgtattcgcataaaactctagaattcaaaaaggaaagggaatgataaatgcaaattcaaaacaatgcttgcatctcctgaagcacaaggaaatgggattgggagagaagttgtacttcatggcattggtgatgttccatttcttatgttacgtggtttattcataagaattgtttattttgttatttatgcctcataatgtgtatgttatgtgtattcctctttgcttaccaagttacaaaataatttttaaaatttaaaaatgtgtaagaggattgagttgatatgtctgagtaacttatgtgaggcattctgactaccttattttatgagtatctaatattttcaggtgactagttagtaaaatgactaatctgaatgacttttcctttatcttttgctttattcagagtctcatttttgtgatctccatttatgttttacaaaagatggaacttttcactttttttgagttatgatcacattatgttctactttgataggaggagaaaagttgcccctaaattgaaaaactcgtaaaatgaaactcttcagtctaattacatacctgtgctgctgcttaaaggaatagggtacaaagtttacagtgataaagggagagcaaagaatactaatttcttactgtgaggaatataacatggggatcattttagccacaatatgaagattatgtttggcaataatgacataagtaaattgggaccaaaagcaatattcttcagtgatatatcaaatgctgcttaatagtgtttgtacttactacttgttccttctgcttataagtttctttccccagaatgtcttaatgctagctgagtgttcatacttatgtctcagcttagtcgtctactcaagagatgccatctctcttggtgcaaaacctaaaacagcacctgggtcatagaggatctctaagtacttattaaagaaagaaatgagaaaagataaaaagaataacagcttacattctacaagtgtgtttagaatatttgagactggggaagagtagaggtgcagagaaagtttagtcaaaatacttactagtaaggcctggcatggtggctcatgcctgtagtctcaactatttgggaggccgaggcaggtagattgcttgagcccaggtgtttgagaccagcctgagcaacatggcaagaccctgtctttacaaaaaatacaaaaaaatttatccagatgtggtggcaagttcctgtaagccaagcccttcgggaggccgcaggaggtggattgcttgagcccaggaattcgataccagcctaagcaacatggcaagaccccatctttacaaaaaataccaaaaaatctagccaggtgtggtggcaagttcctgtagtcccagctacccagggggctaggtgggaggattgcttgagctgggaggttgaagctgcagtgagccatgatcacaccactgcattccagcctagtcaatggtaagaccctgtctcaaaaaaaaaaaaaaaaaagaaaaagaaaaaaattacagaaaagcaataaaaaatgaaagcatttctgaaatgtcatattagaatatattatacatacattaaaaaaggtaatcattattttattaagaataatggtgtctggtttcatcaaaatagagtaaaacataaatttgttatgatatttttgaaaactatagaatattttaaaaccatctttattaaaagatgatatatggttaaaattatttttatgtggtatgtgtgtatgtgtagttagtatattttgaacttacaaaataaaaatctatctgcatgctaaggaaaaaaaagaaaactaattgctataagaagaaaattaattataatatctaaattttcacagatgtaccaaaaagtgaagaaggatcaaaatatactcactgtggacaatgtgaagagtgttctccaaaatacatttcctcatgctaatatttgggatattttgggaattcattctaaatatgatgaagaaagaaaggtaagttgggacattatgttaagtggagtaggccaggcacagaaagacaaacaccacatgatctctactcatgtagaatctttaaaaaaagtcagactcacagaaacagagtaaaatgggggttaccagaggctggggatggcagaattggggagatattggtcaaaggatacaaaatttcagttagactagagaaataagttcaagagatctattgtacatggtggtgactgtagttaatgacatattttatacttgaaattactaagtacattttaaggattctcaccacaaaatatgagaagtatatgaggtaatgcatatgataattagctttattagctattccacaatgtatattaatatcaaaatgtcatatatcataaacatatatattttttacttgtcattttttaaaaggtgaacaattagagactcaacccagaagattcggaaagagccaaaaaaaaaaaaaaaaaggcaacaactcaaagaaattttcagagaaagagaaatagtacaaagaaattccaaaaattaatgtataggagccttcattagaagggactcaccaaatacgcaacacattgaatgaaagaggaatgctctggggtatggggataaggaatacttttctgaagaagtgatatttaagcagaatcctgaagcaggaggaaaagttagacaaaagaaaacaagggggttgtaagagattaacattccagtcagaaaaatattgtgttctgagatgtaaaggaattgagagaagctgatgttgctactgtgtagattgaaagcatatgttgttcctgtgttatagggtacagtcgaggagataaggctggagaggcaagcaaggggtctgaatatacagggtcttgtgaacaacatttaatgcactcatgtcagtagaagctcttggcaacagtgaaaaacctgaaaggcattaagtagtgaagtgacagtgacatgcatttttttttctaaagagcattctccattgttgagaatggattgttggtggggaggagtaggtgtggtgatatgtattaggaaacataaggtgagagatgtgagatggactagtaggcttttggaagaagtggaggcagagaaaatggacatatttgaattatttaggaagtaccatccaggtgctgctggattggataaggtagaggggagatgagaaattgtcaagggtaactcccagggttcagctgaacaactaactggtagtgttgatgccattgccaagaaggaaaggagtggaggagtttatccttgttaaactataagctttaggagagagtttgcatatcatttacatgcattcataaacctaagacatagtaggtgcccactaaacgtacagatagtatagtacagtggttaagagttcagactcttggtcagacagatctgggtgcaaattccatttccaaaacattgtagctgtgtaacataagaagtgatttaatctctctgtatctgttttatcatctgtaaaattgatgtaatagtagtacttggcttcctagagtatttgtgagaatgttggctataataatgataatacttagtattggatagcaaatgagttatttagtcactttttaactcataagctaaaattcaaatgttgaggaccttcatgatctggcctctgcctacacccctctctaactccgtatctgacagctgtcccccatatttcacaccctgtaaacactgctgtattagtccattttcacgctgctgataaagacatacctgagactgggcaatttagaaaagaaagtggtttaatggacttacagttccacgtggctggggaaacctcacaatcatggcagaaggtgaaaggcatgtctcacatgatggcagacaagagaagagaacttgtgcagggaaattcccccttataaaaccagcagatctcatgagacatattcactgtcacgagaatagcatgggaaagatctgccctcatgatttcattacctcccactgggtccccccacaacatgtgggaaatgtgggagctaaaatttaagataagaattgggtggggacacagccaaaccatatcaactgtgaatttaccattgcataagtataccacactcttactttccttgctatattctcctcacttggactgtctttctctattttatctctctggcaaatttttattaagcctttaagatttttagtatgactccctaaaagaagacctgtatgatcccttcctctccatactccagcttgattaggtgcttctcctgggccccatagagtcttctacatgcctgtgttttgtctgtctgtatgtgaaccccttgagaaaagactttcagctctataatcacagtatctagcctaatgcaggtggcaggattgaataagtgtttattgaacatataaatacagggataaataagtctctgatgccgataaatgtttggatttttattaagttaatgtcatactctataccaagaatcagcaagtccacccactgcttgtttttgtaaatattttggggacacagccatacttgtttattcatatgtcgtctatgactgcttttgtgctgtaacgagagtggagtcactatgtcagaaactgagtggctcacaaagcctaaaatatttactctctggccctttacataaaaagttttttgactccttgtaggtaaattactttcctttaggcaatgtttggaaaggacagataaagttagcaaaatggatgttttttcctatggcatataaaaatgtggcggtgttccattttcttatgtttattattcaaacaatcatattttgtttaacactctgatattttttaactgaataggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttggtaggtaagcatttataagaaaatacatgatgaatatttataaatgatgtttttattaaaaacttattttaatgacagaagttgatttggtaaaaaatttccattctgatcatttcatagtgatttttaaaatgatacttttagcagcttaagccacgccaccctgcctgtgcagagactgtggtgcagtggggccctttatactccatgcccaggcagatcttcaggaatctggaacacccactgtcctcgattaggagtttaggctaccccgctccctctgcagagaacttggagccaaggaggtttcccagctccatgcctaggcacacctctagacacctggtggttgcccactgtattctccctcagtgttggtgcttgtgcctgccgttggggtacctgtaggcaggcctgctcagcctggccctgcccatcttgcccaccatgtctgagcagggaggccagaccactgtgcacaccacagatcagcccattgcctgagacaacagagagattatcccagtaacaaggatcaagtatataccctgccatgttggcctcagctggcttttactcataagggctatctactagcttgtaggtcaaaccacacagcccaaagtaaaatcagctgatagaaatgcataggctatagaagcatcacttaaggaatttcaaaatataattgaaagctttatcaatagactggaccaagcaggagaaagaatttcagagcttgaaaaccagtcttttgacctaacccagtcagacaaaaataacaaaaaagaatttaggtcaggcatggtggtttatacctgtaatcccacctctttgggaggtcaattcaagaggatcacttgagctgatgagtttgagaccagcctgggcaacacagtgagacctctgctctacaaaaaaacttaaaacttagccaggtgtggtgatgagtgcctctagtcccagctgctcgaaaggctgaggcaagaggatcacttgagcctaggagatggaggctgcagtaagtcatgatcatgccactgcactctagcctggatgacagagcgagaccctgtctgaaaagaagaatttttaaaaatgaacaaagtgttcaagaaatacgggattatgttaaaggaaccaaacctacaaattattggcattcctgagagaaaaggagaaaaagtaaacaaccaggaaaacatatttgagggaataattcaagaaaatttccctcatcttgctagtgaagtagacgttcagttacaagaaattcagagaacactgtgagatactatacaaggtcagcatcaccaaggcttatagtcaccaaactgtccaaggtcagtgctgaagtaaaaatcttaaaggcaactagagaaaaaaggcagatcacatacgaagggaaccccatcaaactaacaacagtggtctattttcagcattcctaaagaaaagaaattccaaccaagaattttgtatcctgtcaaactaagcttcataagtgaatgagaagtaaaatctttcccagacaagcaagcactaaaggaattcattagcactaaacgggccttacaagagctctttaagggaatggaagaatggtacaaaaacacacttaagtacatagcccacagaccctataaagcatccacatcatagaaactgaaaagcagacagctaagaacttcacataggatcaaaacctcgtgtaccaatattaaccttgaatataaatggcctaagtgcctcacttaaaaggcacagagtggcaattggataaaaaacaagacccatctgtctgctgtctacaggagacgggctcaaagtaaagggtttgagaattatcatgcaaacaaaacaaaacaaaaccaggagttgctattcttagataaaacaaacttgaaaccaacaatagataattataaagtgttcaacaagaagacttaagtgtcccaaatatatatgcaccaacactggagcacccagattcgtaaaacaaatacttccacacctatgaaaaatcttaaggcagctgcgcaataatagtgggagacttcaactcacccactgttattgaactaacccagtcagacaaaaataaaaaagaatttaggccagaaatggtggttcatgcctgtaatcccaccactttggaaggtcaatccaagaggatcgcttgagctgaggagtttgagaccagcctgggcaacacagtgaaacctctccacaaaaaacttaaaacttagccaggcgtcatggtgggtgcctgtagtcccagctactcaaaaggctgaggaaggaggaagacagcagacagatgagtcttgttttttatccaacttgccactctgtgctttttaagtgaggcgtgtaggccatttatattcaaggttaatattggtacatgaggttttgagcctgtcatgaagttcttagctggctccttgccatttctatcgtgtgttagacactgacagtgttagacagattatcgaggcagaaaactaacaaattctggacttaaatggacactgatcagttagacctaatagacatctacagaacattccacccatcagccacagaatatttattcttttcagctgcacacagagcatactccaagatcaagcacatgcttggccataaagtaagtctcaataaattttttaaagtcagaatcataccagtcatactcatggaccacagtagaataaaaatagaaatcagaactcagaacatctctcaaaactacataattacatggaaattaaataacttgcttttgaaatcacttttgggtaaactgaaattaaggcagcaataataaaaattcaaataaatgaaaacaaacaacatacgaagatctctggcatgcagcaaaagcagttttcagagttatagtgctaaccacctatctcaaaaatttagaactatcaccaggcgcggtggctcacgcctgtaatcccagcactttgggaggccgaggtgggcagatcacgaggtcaggagatcgagaccatcctggctaacacagtgaaaccccatctctactaaaagtacaaaaaaaaattagctgggcctggtggctggtgcctgtagtcccagctactctgggggctgaggcaggagaatggcatgaacccgggaggcggagcttgcagtgagccgagatacagccactgcactccagcctaggtgacagagcaagacttcgtctcaaaacaaaaaacaaaaacaaaaaaatttagaactatctcaaaataatgacttaacatcacaccaagaggaattaggaaaaacaagaatgaactaacctcaaagctagcagaagaaaagaaataactaaaatcagagcagaattgtacaaaattgagacccaaaaatttatacaatgaatcagtgaaaccaaaagttagctcttggaaaggacaagatcgatagaccactagctagattaacagaaaaaggagaaacgatctaaataagcacaatcagaagcaacaaaggtgacattacaactgatcccatagaaatacagaagatcctcagaagacctctatgcatacaaactggaaaatctagaggatatggataaattcctggtctcccaagattgaatcaggaagaaattgacaccctgagcagactgatactgagttccataattgaatcagtaataaaaaacctaccaaccagtaaaagccctggaccagatggattcataactgaattctgccagatgtataaagaagaactgttaccaatcctactgaaactattccaaaaaaccaaggaggagtgattaatgcctccctaactcattctgcaaaacctgtgttatcctgataccaaaacctggcaaacatgcaatgaaaaaactacaggctagtaccattgatgaacatagatggaaaaatcctcaacaaaatactagcaaactgaatccagcagcatatcaaaaaattaattcaccgtaatcaaataggcttcactcctgagaaaggttggttcaacattaacaaatcagtaaatgtcattcaccacatacacagaatttaaaacaaaaaatgtgatcattttgatagatgctgaaaaattattcaataaaatcaaacatcccttcatgataaaaaccctcaacaaactgcattgaaggaacatacctcaaaataataaacgccatctatgacaaacccacaaccaacatcatactgaacagtgaaaagctggaaacattccccttgaggactggaacaggaaaaggatgcccagtctcactattcctattcatcatagtactggaagtcttagagcaatcaggcaagagcaataaataaaaggcatccaaatagtaaaagaagtccagtatctctcttcactgatgatatgattctacacctagaaaaccctaaagactccaccggacaactcctagaactgataaattacttaagtaaagtttcaggattcaaaattaatgcacagcaatcagtagcatttctatagaccaataacattcaagctgagagccaaatcaagaatgcagtcccatttacaatagccatacacacacacacacacacacacacacacacacacacacacaaataaaatacctaggaatacagctaactaaggagatgaaagatctctacaaggataattactaaacactgctgaaagtgatcatatattatgcaaacaaatgggtaaacattccatgctcacggattggaagactaaatattgttaacatggccatactgcccaacacaatctacagatttaatgctattcatatcaaactgccaatgtcattattcacagaattggaaaatactattctaaaattaatatggaaccagaaaagagcccaaatagccaaggcaattccaagaaaaagaacaaatctgaaggcatcatattgagaggtgacaatgtgctggtggcccttgctcactctcagcacctccttgccctcggcgtccgctctggccatgctcgaggagcccttcagcctgccactgcactgtgggggcccctctctgggctgtccgaggccggagccggctccctctgcttgcggggaggtgtggagggagaggcgcgggcgggaaccagggctccgcgccacgttcatgggccagcgcgagttccgggtgggcgtgggctcagcaggccctgcactcaggccggcgggcgctgccggcccgggcagtgaggggcgtagcacccgggccagcagctacagagggtgcgctgggccagcactgtgctcgaattctcgctgcctcatctgcctccccctgggtcagggcttgggacccgcagcccgccatgcctgagatgcagaaaactgaaactggaccccttccttacaccttatacaaaaattaactcaagatgaattagagacttaaatgtaaaacctaaaattataaaaaccctataagaaaatctaagcaatacaattcaggacatagacacaagcaatgatttcatgacaaaaatgccaagagcaattgcaacaaaagcaaaaattgacaaatgagatctatttaaactaaagagtttctgcacaacaaaaactatcaccagagtgaacacacaacctacagaatgggagataacttctgcaatgtatccatctgacaaaggtctaacatgcaaagtctataaggaacttctacaaattacaagaaaaaacaaacgaccccattaaaaagtgggcaaagcacatgaatagnnnnnnnnnnnnnnnnnnnnaaaagaacatctaaacatccgacaatcagttgctcccatcctacgacagacacattctcgtgccatgctcatcacacaccacttaactagcactatctctccatgcacaggacatcacccatcaatttacttgagcacctctttgattttagaccgcgacacctacctctcttctcggaatatgagaacaggccagacggaaccagctccgcccactcaatgagccaggcgataccggacggcgtggttcagaaatcctcaactcaagcgcgcgcatccggccctgcagtgatggcatacactgcgtccactagttacagagtgtggctgtgacaacattgtgtttaattctacgctgcctcatctgactccccttgggtcagggcttgagaccagcagcccgccatgctgagcctcctctccacccctaccacaccccaccatgccccggcaccgtggggtcttgcgcagcccgagcctccccgacgagtgctgccccctgctccgtggcgcccagtcccattgaccgctcaagggctgaggagtgccggtgcaaggtgcgggagtggcgggcagctccccctgcggcccaggtgtgggatccactaggtgaagcccctgggctccagagtctagtggggacttggagaacctttatgtgtagctgagggattgtgaatacaccaatcagcactctgtgtctagctcaagatttgtaaacacaccaatcagtaccctgtgtctagctggaggtttgtaaatgcaccaatcagtgctgtgtctagctcatctagtggggacttggagaacttttgtggctagctcagggattgtaaacacaccaatcagcaccctgtcaaaacggaccaatcagctctctgtaaaacagaccaatcagctctctgtagaatggaccaatcagcaagatgtgggtggggccagataagggaataaaagcaggctgcccaagccagccgtggcaacccgcttgggtccctttccatgctgtgggaggtttgttcttttgctctttgcagtaaatctttctgctgctcagtctttgggtccgtgctgcctttgagagctgtaacactcaccataaaagtctgcaccttcactcctgaagccagcgagaccaccaacccaccagaaggagaaaaccccgaacacatctgaacatcagaaggaacaaactctggacactccatctttaagaactgtaacactcaccgcgagggtccacagctttattcttgaagtcagtgtgatcaagaacccaccaattccggacacagtattacccaacttcacagtacactatgaggctacagtaaccagagcagcatggtactggtacaaaaatagacacatagactaatggaacagagtagagaacccagaaataaagccacacacctacaaacattttagctttgaaaagttgatgaaaattagtgggaaaagggtcctcgattcaataaatggtcctaggatagttggctagccatatgcaaacaaaactggacccctacttttcaccacgttcaaaacttaagatggattaaacagttaagtataagacttaaaactataagaattctagaagaaaacctaggaaacaccgttctggacatcagtcttgggaaagaatttatggctaagatctcaaaagcaattgcatcaaaaacaaaaatttgacgagtgggacctaattaattaaagagtacaacaaaagaaactcgcaacagagtaaacagacagcctacagaatatacagaaaatattcacaaactgtatatccgacaaaattctaatatccataagtagcaaataaatcaagcaaagaataaataaccccattaaaaagtaggcaaatgacattaacaggtacttctcaaaagaagacacgcaggcggccaacaagcatataaagaaatgttcaacactactaatccttagagaagtgcaaatcaaaaccaaaaggagacaccatctcgtaccatttagaatggctgttattaagtgaacaaacaacagatgctggtgaggctgaggaggaaggggaacgcatatacactgttagtggggatgtaaattagttcagcccctttggaaagcagtttgtagatgtttcaaagaacttaaaacagaactaccattcaacccagcaatcccattactgggtacatctccagaggaaaataaatcgttctaccaaaaagacacatgtatgttcactgcagcactattcataatagcaaagatgtagaatcagcctaggtgtccatcagtggtggattggttaaagaaaatgtggtgcatatatacaccatggaatactacgcacccattaaaaatgaaatcgtcccctttggagcaacatggactcagctggaggccaagcaaactaacacagaaacaggaaaccaaacactgcatgttctctcttatgagtgggagctaaacattcggtactcatagacataaagatggcagcaagagacactggggatttctagaggggagagggaaggaaaaagtcagggaagggttggaaaactatctggtactatgctaactacctgggtaatgggatcagtcataaccccaacttcagcattacatgatacacctgtgttgtaaccaatctgcatgtgtaccctcgaatctaaaataaaagctgaaattctttaaaaatatatttaattaaatttatcttaggcataattgcatctaaaattgcttaattggaaaaagttgtaatttttacaaggaaatgtattctccctccccctctccctcatctccctctgatgccaagccgaggctggactgtactgcctccatcttggctcactgcaacctccctgcctgattctcctgcctcagcctgcctagtgcctgggattgcaggcgcgcgccgccacgcctgactggttttcgtattttttggtggagacggggtttcgctgtgttggccgggctggtctccagctcctgacctcgagtgatctgccagccccggcctcccgaggtgccgggattgcagatggagtctcgctcacttagtgctcaatgttgcccaggctggagtgcagtggcatgatctcggctcactacaacctccacctcccagccgcctgccttgccctcccaaagtgccgagattgcagcctctgcccggccgccaccccgtctaggaagtgaggagcatctctgcctggccacacatcatctgggatgtgaggagcccctctgcccagccgcccagtctgggaagtgaggaacacctcttcccggccgtcatcccgtctaggaagtgaggagcgtctctgcccggctacccaccttctgggatgtggggagcgcctttgccccgctgccccgtctgggctgtgaagagcacctctgccccgccgcgaccccgtctgggaactgaggagtgtctctgccccgccaccaccccgtctgagaggtgaggagcgtctctgaccggctgccccgtctgagaagtgaggagcccctccgcccagcagccgccccatctgggaagtgaggagcccctccgcccggcagccgccccgtccgggaagtgaggagcgtctccgcccggcagccgtcctgtccgggaggtggggggcagccctcgccaggccagccgtcccgtcggggaggtggggggcagcccctgcccggccagccgccccgtccaggaggtagggggcagcccctgcccggccagctgccccgtccgggaggtggggggcgcctctgcccggccgccaccccgtctggcaggtgtacccaacagctcatttagcacgtgtccatcatctccatgtcggttttgtcgaatagaaaagggggaaatgtggggaaaagaaagagagatcagattgttactgtgtctgtgtagaaagaagtgggcataggagactccattttgttctgtactaagaaaaattcttctgccttgggatgctgttaatctataaccttacccccaaccccgtgctctctgaaacatgtgctgtgtccactaagggttaaatggattaagggcggtgcaagatgtgctttgttaaacagaccctgcaaggcagcatgttcgttaagagtcatcaccactcccgaatctcaagtacccagggacacaaacactgcggaaggcggcagggccctctgcctaggaaaaccagagacctttgttcacaagtttatctgctgaccttccctccactattgtcctgtgaccccgccaaatccccctctccgagaaacacccaagaatgatcaataaatactaaaaaaatttaaaaaaacaacaaaaaagcaaacaaacaaacaaacaaaaaaattcagtgagttaattaatgagaattgtcctgctcacaataggtgctcaagaaatggttactaccatgattctggttgtgaagtgaaattgccaacacctgagacagagctcattaaatgtttaccaaactgaagaataaaaaaaaaaaaaaaaaagaaagaaaatgtattgtaataattctaaattgcttatttatttttgattaagtaatctttgtgttatctgcatactttttgaaacatggatataaattgcctgtattatctaaataacatttttgtttttttagggcacattaaatgatcgcacgaatgcaattgattttctaatggataggaataatgttgtaccccgtataaatactttgattttgcgtactaaccagcagtacctcaatttaatatctacatcaggtaaaataatcctatactgttctacaaatgtttattgagttgtgaattctttatttatatttaacgtttaatttgaaatttttcagtaactgctgatgttgaagatttctctactttctttttcttggattcacaagataagagtgctgtaattgcaaagaacatgtattatttaacccaagacggtaataagcatattttatttacctgaattcttaaagtgatagaaacttgtaatgttcataaggcagttgtataataaattttaatatgttgctatttttgagtagaggcctagatttcaattttagagtttgtaaattttttagtatttaacgtgtgctgagaaaacaatgccttctattctaactttgtttatcttatttttgccttttttaaacaaactattttcacctttttaagaaaagaataaaatcttttcagtactatgtaaactatcttataatgtatacagaaaagtacaattaccagatcagagaagataataattcttctgcattctgattaaataacatgcagatattttgcttaaggtaggggttacaaccagaagagaggagaccaagatagtaacacacttgggaaaaaggatttagccaaactgagaagtctgcagtgggaccgtagatttgttagggtacaattaactattcagatagatgaatataattcgaatttggtggtttttgttttgctttgctttgttttgtttggcctgctttgctctagaaataaaaacaagagccaatgagtaaaagattaaagaaggctgattttggtctcagtagggaagtggtaattttctaacagtgagagttcattaaacagatggaatgaactatgttgtaaggggcaaacttttatataggagagagatttaaagcaaaggccacacaaccagttcttgtaaatgctgtagattaaatccgagtttctaccagatggctcctggattactgtctaacagattccatgattttatgttcataaaggagtctggctacatattgctgttttctatatctactaataagcttgattgttacggttttacatatatttgggacataaattttttttttttaaacaaatgtagctagaaggcagatttgcttaccaacactgggagttttatataagcttatataatgagttactcttctaaccggaagctttatataagcttgtataatgaattacccttgtagcatttttatatgtaattttatatgtatttatttttgtatgtatatatatgtacttgcatgtatacattcacacataacattttaaaaatctttgcttttcagaaatattattttaattttttttaatgtgttaactgcacatgttcccctgcttttgttttattttttaaaaaaaaagttaatttgagtaaactgtttgaaactttcagatgagagtataatttctgcagtcactctctggattattgcagattttgataagccttctgggagaaaacttctttttaatgcattaaagcacatggtgagtacctagatattcttactaacaattttaatttatttcaatttaaggaaagcaatatgaagaacatacattaaatattttcccctccatgttaatgtttcagttaagtagacgaaggaattcagatttagtcttcatgtaaaacaggtaactttgctcaggaaaagaaaaacctacctgttttctatgactcgtgacatatattctctggtagtccttgtgatcagacatacacataccacatattgattacaaatagggtattaaacaaagtaagtaactctagaccctaccaccacttcagtgacccgaaatccactatttaccaacaatagctagtaatagcaatttttggtcacataattaagcagcattttctttccctgattatttaagaaaaactaagtaaatttatctcactgaagaatattttaagccttaagtcaacattaaatttcttgttattgattataaaccagtatacttcaagaggatatatttctgtatataaaagtagtctttcataactgtctgtatttctaagttaatatataagtttatctagataaaaaatacttaagaaacataaaccaaaatattttatgaaattgtttttatattagctaagtataaatttattgctgtataacaaattaccacttggtggtaaacagtgaacatttatcttaacagtttctgaggttcaagaatttaggagcaatttacctgagtgattctatcttagattctcttataaggctatatttaagattttggttatagttgcagtgatccgaaggcttcactggagcaggaggacaagcttctaagatgactcacttacatgccactgcaggagtcctcagtgtttcactggcttttagcagagtgcttcattccattgccacatagacctgtttttggtgttacttaagtgccctcacaacgtggcagcttcctttttccagaacaagggtaaagagataaagactgagccacaatgtcatttataatctagcctcaaaagttacacacagtgttttctgtttgttgagcaaataacttctattcagtatgaaaggtgctttacagggcatgaataccagagatggggatcgttggggccatcttggagactagctaccacgttaagaataaataatacttcttaaattaagcatttttatttcatattacaccatgtcagaatgcatttaggctttactcagtagcctgcagaccggaaaatttcaaaaaaaaaaaaaaaaaaaaaaaaaaaaaaagctgtttgggatctattacatctattgggagaaattaacttttgcctgctgtttcttctcaagcggttctgggtgtgtatattctttcagaggctcacaaactccctttccccagttgtttcaatgtgtctagcagataactttctcttgatttagttgcttcttctataactttcagaagtgctatcttttaataattgtttattccttataggatggatgattattttcattgtcccaaagattttcaaaacccaagtatcattagaaccacaaactaaaaacactgtaatatatgaagtgcaataatcatgatgacaagaaataattttggatcccaaaatgctatctgttggaaatataaaaattgaaaaaagataatcattgtctaatcaaatcatcatttcattgtagtttttctttcacccaagtattttacattttttctggttatttatcacatgttccttatagaaaatcggaagtacataaaatcaaagactaacaaggaagaaaaagtaatcacccataaaacctattttaatgtttaggtgtatttcctttctgggttttttatatttatttttacatggttgaaattatcacttacagttttatcaaaattattttcttataatgttaaacaatgttgtgtcaacaagaattcaaatggatacataataaactgtctacatggaaatatttagtaacattgaaaattcaggtggttttgtttttttgctactgttggtattaatgcagtcataaataattttgaatgtgtagcttatcttatttttttattacctctgagaatagtttattaaaaatgactttgtctccactaaaaatacaaaatttgctggacgtgatggcacatgcctgtaatcccagctactggcgaggctgaggcaggagaatcccttgaacccgggaggcggaggttgcagtgagccaagatcacaccattgcacttcagcctggttgacagagtgagactccatctcaaaaaaaaaaaaaaaaaagaatatgctgagccaggcatggtggctcgtgcctgtaatcccagctaatcacgtggctgagatgggaagtttgcatgaggccaggagttcaagcccagtctgggcaacataacaagactctgtctctaaaaaaaatttttttaaaaacaattagccaggtgtggtgatgcacgcctgtagtcccagttatttgagaggctgaggtgggaggatcacttgagcccaggagtttgagactacagtgagctatgatcacaccattgcactctagcctgggtaatagagtgagaccccattaattagtcagtgaagaaaagaacgtactgaatataagggttgttaacatttttagactcccgataatttttaacaaatgactttccaaatggctgttaattttcatagtttttgagaggatctgtcacatcacagtgttgaaagtcttgatttttgttatacctaattctttctgccaatttaaaaacaaagagagtttctttttttaaatttttttgttttgttttgttttattttgttttgttttttgagacggggtctcgctctgtcattgaggctggagtacaatggtgtgatctcggctcaccacagcacccaactcctgggctcaagcaatcctcccacctcagcctcctgggcagcttgggactgcaggtgcatgccatcacacccagcaaatttttgtatttttttgtagagacgggttttgccatgtcatccaggctggtgtcacactcctgagttcaagtgatccactcgcctcagcttcccaaagtgctgagattacaggcgtgagccactgtgcctggccaaagatggcttcttatttgtatttatttgataagtagttatagggaaaatttttctttcaatatgactttatttatttttagctttgattccaggggtacatgtggagatttgttacatgggcatattgtgtgatgctgaggctggagcttctaatgattctgttctccaagtagcaaacatagtacctgataggtagtttttcaactctcgtggcccccctttctcccttcccatccccttttgtagtccccagtgtctactcccatatttgtgtccctgagtatccattgtttagctcccacataagtgagaacacgcagcatttgattttctggttttgtgttaattcacttaaaataatggcctccagccgagccaatgttgctgcgaaggacatgatctcattctatcaatcaatgtgtagattgatttcaatttgcacatattgtgtagtattccatggtgtatatgagtcacattttctttattcagtccaccattggtgggcacctaggttgattccatgtctttgccattgtgaatagtactgtgataaacatgagtgcaggtgtcttttttggtagaatgatttatttttctttggatatatacccagcaatggagttgttgggtcaaatggtagttctgtttttagttctctgagaaatgtccaaactgctttttacagtggctgaagtaattttcattcccactgtgtttaggcattccctttttctctgcaaccttgcgagcatctgttatttttttgactttttaataataccaattctgactggtatgagatggtatctcattgtggttttgatttgcatctctctgatgagtagtgatactgagcattttttcatgtttgttggctgcttgtatgtcttcttagaagtgcccattcctttgctcactctgtaatggggttgtttttgtcctcttgatttgtttatggaagatttttctgtgtttactagccagttaatgtttcttttttgaataaatatttttctgtaacttcgtgtagtgttcttgggggaaaaaaaattcacagtgtgaatctctacccactattctgtccttccaagtgggagaggcatgctaacactgcttcctatccactatctggaaaacagcaacaacaacaacaaaaatactgtcaccacctttttttttttttttcaactttaagagttatgtgtaggatatgcaggtttgttacacagataaacgtatgctatggtggtttgctacacagttcatcccattgcctagatactaagccctgcatcccttagctattcttcctgatgctctccctccccacaccccctacccccaacagaccacagtgtgtgttgtttatgccattttgtccatgtggtctcatcattcagctcccacttaaaagtgagaatatgtggtgtttggttttctgttcctgtgttagtttgctgaggataatggcttccaactccttctgtgtccctgcaaaggatgtgatttcattccattttatggctgcatagtattccatggtgtatatgtatcacattttctttatccagtctatcattgatgggcatttaggttgattccgtgtctttactattgtcaatggtgctgcaatgaacatacacgttcctgtatccttataatatttaacagaatgatttatattcctttgtgtatatgccaagtaatgggattgctgggtcaaatggtaattttgttttcagttctttgagaaatctccgaactgcttttcacagtggctgacctaatttttattcccactgtgtttaagcattctcttttttctgcaaccttgccagcatctgttcttttacgactttttagtaatggccattctgactggcgtgagatgttatctcattgtggttttgatttgcatttctttaatgatcagtgatgtggagcttttttccccatattttttggccacatgtatatcttcttttgagaagagtctgtttatgtactttgtccactttgtcgtttgtttttttcttgtaaatttaagttccttgtagactctggatattagaccttggtcagatggatagattggagaaatttttttcccatttcatagattatgtgttctctctgatgatagtttcttttgctgtgcagaagctctttagtttaattattaatatatcccatttgccaatttttgcttttattgcaattgcttttggcatttttgtcatgaaatccttgcccatgtctacatcctgaatagtattgcctagattttcttctagagttttaatagtttcgggttttacatttaagtttttagtttatcttaagttaatatttgtataaggaaggggtccagtttcagttttctgcatatggctagccagcacttccagcactatttattaaatagggaaccctttccccattgctggcttttgtcaggtttgtcgaagatcagatggttgtaggtgtgtgatcttatttctgagttctctgttctgttccattggtctatgtgtctcttcttgtaccagtacaatgccatcttggttactgtagccttgtatattttgaagttgggtagcatgatacctccagctttgttcttttttcttaggattggcttgactattcgggctcttttttggttccatatgaattttaaaatcactttttctaaatatgtgaagaatgtcaatgttagtttaatgggaatagctttgaatctataaattacttagggcagtatggccattttcatgatgttcgttcttcctgtccatgagcatggaatgtttttccatttgtttgtgtcctctccgatttcctttgagcagtggtttgtaattctccttgaagagattctatacttcccttgttagctatattcctaggtattttattcattttgtagcaattgtgaatgggatggctctctgcctacttgttgttggtgtataggaatgctagagatttttgcacattgattttgtatcctgagactttgctaaagttgcttatcagcttaagaagcttttgggctgagatgatggggttttctagatataagatcatgttatctgcaaacaaatgtaatttgacttctctcttcctatttgaataccctttatttctttcttgcgcctgattaccctggccagaactttcaatactgtgttgaataggagtggtgagagagggcatccttgtcttgcgccagttttcaaggggaaatgcttccagcttttgcccattcagtatgatattggctgtgagtttgtcatatatggcttttattattttgaggtatgttcctttaatacctggtttattgagattttaacatgaagggatgtctcattttatcaaaggcttttcttgattgattgagataatcatgtggttttgtccttagttctgtttatgtgatgaatcacatttattgatttgtgtctgttgaaccaacgtcgcatcctggggatgaagccaacttgatctgatggataagcttttttatgtgctgctgaatttggtttgctagtagtttattgaggatttttgcattgatgttcatcaatggtattgacatgaagttttccttttttgttgtatttctgccaggttttggcatcaggatgatgctggcctcatagaatgagtaagggaggaatccctcttcagttttgtggaatagtttcagtagaaatgataccagctcttcattgtacctctggtagaattcagctgtgaatccatctggtcctaggctttttttggttggtaggctacttattgctgcctcagtttcagaacttgttgttggttctgatgccccatatcattgctgattgtgtttattggattcttctctcttttcttctttatcagtgtagctagtggtctattttactactttttttctaaaaacaggtcctggattggttgattttttttgaagagtttttcgtttgtctaactccttcagttcagctctgatcgtggtttcttgtcttctgctagctttggggtttgtttgctcttggctctcatgttcttttaattgagatgttaggttgttaacttgagatctttctagcgttttgatgtgggcatttagtgctataaatttttttattaacactgctttagttgcatccagagattctggtacattgtctctttgttctcattagtttcaaagtaattcttgatttctgccttaatttcattatttactcaagagtcattcaggagcaggttgttcaattttcatgtagttgtgtggttttgagtgaatttcttaatcttcagttctaatttgtgttgtggtctgaaagactgttacgatttcacttattttgcatttgctgaggaacgttttacttccaattatgtgatcgattttagagtaagtgccatgtggcaatgagaagaatgtatattctgttgggttttggtggagatttctgtaaatatctatcaagtccacttgatccagagctgagttcaggtcgtgaatatttttgttaattttctgtctcgatgatctgtctaatactgttaatggcgtgttaaggtctctcactattattgtgtgggagtctaagtctctttgtaggtctcttaagaatttgctttatgaatctgggtgcttctgtattgggtgcctatatatttaggatagttatttcttcttgaaccctttacaattatgtaacattcttttttgacctttgttggtttaaagtcagaaactaggattgcaaccccagctttttttctgttatccatttgcttgtaaattttcctccatctctttattttgagcctatgtgtgtctttccatgtgagatggatctcttgaagacagcgtgttgatgggtctccactctttatccagcttgccattctttgtcttttaattggggcatttaacccatttgcatttaaggttagtattgttatgtgtgaatttgatactgtcatcatgatgctagctggttattttgcagacatgtttatgtggttgattcatagtgtcactggtctgtgtacttcagtgtgtatttgtcatggctgccgacggtttttcttttccatacttaatgcttccttcagaagctcttgcaaggcaggcctggtggtgatgaattccctcagcatttgtttctccttcacttatgaagcttagtttggccagatatgaaattctggaaattcttttttttgggaattctttaagaaatgaattggaaattattttctttaagaatgttgaatattggctccaatctcttctggcttggagggtttcagctgagaggtctgctgttagtctgatgggcttccctttgtggatgacctagcctttctgtctggctgccccctaacatttcttctttcatttcaaccttggagaatctgatgattatatgtcttgtggttgatcttttcatggagtatcttactggggttctccacatttcctgaatttaaatgttgtcttttcctgctagattggggaagttctcctggatgaatatcctcaagtatgtttttcaacttggttctgttctccctgtttctttcaggtaccccatcagtcacagctccttttacataatcctatagttctcggaggttttgtttgttccttttcattcttttttgtttaatgtgtctacctgccttatttcagcaagatagttttcaagttctgaaattttttcctctgcttggtctgttcggttattgatacttgtggttgcattgtgaagttcttatgttgtgtttttcagctccatcaggtcatttatattcctctctaaactgattgttctcgtttacagctcctgtaatgttttatcatagtgcttcgtttctttgcattgggttagaacatgctcctttagcttagcgaagttccttattacccaccttttgaagcctacttccatcacttcagccatcttggcctcggcccagttctgtctgcttaggggagaggtgttgcagtcatttggaggagaagagacactctggccttttgaattttcagcatttttgctttgattttttctcatctttgtgggcttatctacctgtgatttttgagattgctgacctttgaatggggtttttctggagtcctttttgttgacgatgattttgttgctttctgtttgtttttaacggtcaagctgctcttctgtagggctgctgcagtttgctgagggttcactccagaccctagttgcttctgtttttcctgtacccagaggtatcaccagtgaaggctgtgaaacaacaaagatggcagccagatccttctggaagctctgtcctaggggggtacagacctattgccagcccaaacacacctatagcaggtggctggagacccttgttgtgagatcttatgcagataggaagaatgggatcagggacctgcttaaagaggcagtctggctgcttgttggtggagcaggtgtgctgtgttggggtggatcatttctcacccagactgtttggactctccagagccggctgagtggaacagctgagtcaaccgaactgcagagatggtagccgcttctcccactgggaactctgtctcaggaagagatcaaagctctgtctttataatcctggctggtgtggctgaagcctctgcagggaggtcctccccagtgaggaggaatggattggggtcctgcttaaagaagcagtctggccatgatcggatagagcagctatgctctgttggtgggggaaccttccttgtctggactgtttggactctccaaagctggcaggctggaacagctgagtcgaccaatctgcagagatggtggccaccctcccccggaagccctgtcccagggagagatcggagctctgtccttataaccctgactggagtggctaaagcttccacagggataagtgtattttttgcatctaaataagtatgtccttttcatatataatctatttattattcatttactgtctaagtatttgagtgactatgttttcccttctggggatatattagtttacaatattaagatcttttctcttgtgcaggttaaattttagcaggggtagcgtgcatagggagacagacaataagtgatagacatatgtaaattgagttacatgtcaagaagctgagaaatgctatggaaaaagaaaaagaactgggtaagggaaaatcaggagcagagagtcaggttgcagacagattacaattttaaataaagttggcaggatacgcctcattgagaagatgacatttcagcaatgacctgaaggaattgagggaattaacaattcaaatactgagggaaaatatattcccaccagagtgtctagctgatgcagaggttctaatgcaagaacatactttatgtaagaagacagcaaagtgtatggctagaacacagcaaggagaagagatgagataacagaagaatgaggtgccagataatatcaggcttctaagtgttaggattttaatcattgacccatagaagcattttgtagatcaatattttgcatgtcactttacattttgacatcatttaaattagtgtgtgatgttcttgacagttaaaaaatgtctatatcagaactatcagtcttttaaaatttcttcataatttttatacttaagagttttgcagggggttttttgttcttttgtttttgtttttttgaaagagtctcactcagtcgcccaggctggagtgcggtgatgcagtctcggctcactgcatcctccacctcctagtaggttcaagtgattctcctgcctcagcctcgcatgtggttgggattacaggcgtgcatcaccacgcccagctaatttttttttttttttttttttttttttttttttttttagtagagatggagtttcaccataatggccagagtggtctcgaactcctcacctcaggtgatccacctgcctcagcctcccaaagtgctgggattataggcaggagccactgagcccacccacttagagttttaattctattaattatcctttctatatatcaaacatactgaagtcaaaacaaaatagtaacttttcacttgtccaaggaaattgacaaatctttaattctctccttttgtagcttgctttcttctgcctttgtaaatttaagtggatgccagtagttttaagaaactttacagtagttgtaaggaatattttaacactttgaatatatcatctcattgccttcttttttttttttattatactttaagttctagggtacatgtgcacaacatgcaggtttgatacataggtatatatgtgccatgatggtttgctgtacctatcaactcatcatttacattaggtatgtctcctaatgctatccctccctcaggcccccatccctcaacaggccctggtgggtgatgttcccttccctgtgtccaaggccctgtgtccaattgatctcattgttcaattcccacctatgagtgagaacatgtggtatttggttttccgtccttatagtttcctgaaaatgatggtttccagcttcatccatgtcccggcaaaggacatgaactcatccttttttatggctgcatagtattccatggtgtatacgtgccacattttcttaatccagtctatcattgatggacatttgggttggttccaagtctttgctattgtcaatagtgccacaataaacatacatgtgcatgtgtctttatagtagcatgatttataatcctttgggtatataagcagtaatgggattgctgggtcaaatattaattctagtttagatccttgaggaatcaccacactgtcttccacaaaggttgaactaatttacactcacaccaacagtgtaaaagcgttcctatttctccacatcctctccagcatctgttgtttcctgactttttaaatgattgctattctaactggtgtgagatggtatctcattgtggttttgatttgcacttctctgatgaccagtgatgagcatttttccatgtgtctgttggttgtgtagatgtcttcttttgagaagtgtctattcatatcctttgcccactttttgatggggttgtttgtttttttcttataagtttgtttgagttctttgtagaattctggaatattagccctttgtcagatgggtagattgcaaaaattttctcccattctgtaagttgcctgttcactctgatgatagtttcttttgctgtggagaagctctttagtttaattagatcccatttgtcaattttggcttttgttgccattgcttttggtgttttagtcatgaagtccttgaccatgcctatgtcctaaatggtattgcctaggttttcttctaggggttttgtggttttaggtctaacatttaggtctctaatccatcttgaattaatttttgtataaggtgtaaggaaaggatccaatttcagctttctacatatggctagccagttttcccagcaccatttattaaatagggaatcctttccccatttcttgtttttgtcagatttgtcaaagatcagatggttgtagatgtgtggtattatttctgagggctctgttctgttccattggtctatacctctgttttggtaccagtaccatgctgttttggttactgtagccttgtagtatagtttgaagtcaggtagcgtgatgcctccagctttgttcttttggcttaggattgtcttggcaatgcaggctgttttttggttccatatgaactttaaagtagttttttccaattctgtgaagaaagtcattggtagcttgatggggatggcactgaatctatgaattaccttgggcagtgcggccattttcatgatattgagtcttcctatccatgagcatggaatattcttccatttgtttgtgtcctcttttatttctttgagcagtggtttgtagttctctttgaagaggtccttcacatcccttgtaagttggattactaggtattttattctctttgtagcaattctgaatgggagttcactcatgatttggctctctctttgtctgttaatggtgtataggaatgcttgtgatttttgcacattgattttgtatccagagactttgctgaagttgcttatcagctaaaggatattttgggttcagacgatggggttttctaaatatacaatcatgtcatctgcaaacagggacaatttgactttctcattttctaattgaacaccctttatttctttctcttgcctgactgccctggccagaacttccaacactatgttgaataggagtggtgagagagagcatccctgtcttgtgcccgttttcaaagggaatgcttccagtttttgcccattcagtatgatattggctgtgggtttgtcataaatagctcttattattttgagatatgttccatcaatacctagtttattgagagtttttagcatgaagggctgttgaattttgttaaaggccttttctgcatctattgagataatcatgtggtttttgttgttgattctgtttatgtgatggattacatttattgatttgcatatgttgaaccagtcttgcatcccagggatgaagcccacttgatcatggtggataagctttttgatgtgctgctggatttggtttgccagtattttattgaggatttttgcattgatgttcatcagggatattggtctaaaattctcttttttttgttgtgtttctgccaggctttggtgtcaggatgatattggcctcataagttgagttagggaggattctctctttttctattgattggaatagtttcagagggaatggtaccagctcctctttgtacctcttgtagaattcggctgtgaatccatctggtcctggactttttttagttggtaggctattaattattgcctcaatttcagagcctgttatttgtctattcagagattcagcttcttcctggtttagtcttgggagggtgtatgtgtccaggaatttatccatttcttctagattttctagtttatttgcgtagaggtgtttatagtattctctgatggtagtttgtatttctgtgggatcagtggtgatatcccatttatcattttttattgtgtctatttgattcttctttcttttcttctttattagtcttgctagcagtctatcaattttgttcttttcaaaaaaccagctcctggattcattgattttttgaagggttttttatgtctctatctccttcagttctgctctgatcttagttatttcttgcgttctgctagcttttgaatgtgtttgctcttgcttctctagttctttcagttgtgatgttagggtgttgattttagatctttcctgctttctcttataggcatttagtagtataaatttccctctacacactgctttaaatgtgtcccaaagattctggtacgttgtgtctttgttttcgttggtttcaaagaacatctttatttctgccttcattcgttatttatccagtagtcattcaggatcaagttgttcagttttcatgtagttgagtggttttgagtgagtttcttaatcctgagttctaatttgattgcactgtgatctgagagacagtttgttgtgatttgtgttcttttatatttgctgaagagtggtttacttccagttatgtagtcgattttagaataggtgcaatgcggtgctccaaagaatgtatattctgttgatttggggtggagagttctgtagatgtctgttaggtctgcttggtgcagagctgagttcaggtcctggatatccttgttaacatttgtcttgttgatctgtctaatattgacagtggggtgttaaagtctcccattattattgtgtgggagtctaagtctctttgtaggtctctgaggacttgctttatgaatctgggtgctcctgtattgggtgcatatatatttgggatagttagctattcttgttcaattcatccgtttaccattatgtactggccttttttgtctcttttaatctttgttggtttaaagtctgttttatcagagactaggattgcaacccctgctcttttttctttccatttgcttggtagatcttcctccatccctttatttgagcctatgtgtgtctctgcacatgagatgggtctcctgaagacagcacactgatgggtcttgactctttatccaatttccagtctctgtcttttaattggggcttttagcccatttaaatttcaggttaatattgttatgtgtaaatttgatcccgttattatgatgtttgctggttattttgcctgttaattgatgcagtttcttcatagcaccaatggtctttacagtttggcatgtttttgcagtggctggtactggttgttcctttccatgtttagtgcttccttcaggagctcttgtaaggcaggcctcgtggtgacagaatctctcagcatttgcttgtctgtaaaggattttatttctccttcacttatgaagattagtttggctggatattaaattctgggctgaaaattctttcctttaagaatgttgaatattgtcccccactctcttctggcttgtagggtttctgctgagaggtccgttgttagtctgatgggcttccctttgtcgataactcgacctttctctctggttgcccttaacagtttttttttttttttttttttagtgggcaggaatcttttttattattattattattattattattattattatacttcaagttttagggtacatgtgcacattgtgccggttagttacatatgtatacatgtgccatgctggtgcgctgcacccactaactcgtcatctagcattaggtatatctcccgatgctatccctcccccctccccccaccccacaacagtccccagtatgtgatattccccttcctgtgtccacgtgatctcattgttcaattcccacctatgagtgagaatatgcggtgtttgtttttttgttcttgcgatagtttactgagaatgatgatttccagtttcatccatgtccctacaaaggacatgaactcatcattttttatggctgcatagtattccatggtgtatacgtgccacattttcttaatccagtctatcattgttggacatttgggttggttccaagtctttgctattgtgaataatgccgcaataaacatacgtgtgcgtgtgtctttatagcagcatgattcatagtcctttgggtatatacccagtaatgggatggctgggtcaaatgacaagcaatggggaaaggattccctatttaataaatggtgctgggaaaactggctagccatatgtagaaagctgaaactggatcccttccttacaccttatacaaaaatcaattcaaggtggattaaagacttaaacgttagacctaaaaccataaaaaccctacaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaactagttcaaccattgtggaagtcagtgtggcgattcctcagggatctagaactggaaatgcccttaacagtttttccttcatttcaactttggtgaatctcacgattatgtgtcttggggttgttcttcttgaggagtatttttgtgatgttctctgtatttcctgaatttgaacattggcctgccttgctaggttggggaagttctcctggatgatatcctgaatagtgttttccaacatggttccattctccccatcactttcaggtacaccagtcatacgtagatttggtcttttcacatagttccatatttcttggaggctttgtttgtttctttttagtcttttttctctaagcttgtcttctcactttatttcattaatttgatcttcaatcactgataccctttcttccacttgattgaatctgctattgaagcttgtgcatgtgtcacgaagttctcatgccatggttttcagctccatcacgtcatttaaggtcttctctacactgtttattatggttagccatttgtcttatcttttttctaggtttttagcttccttgagatgggttcgaatatccttctttagctcagagaagtttgttattaccaaccttctgaagcctacttctgtcaactcatcaaagtcattctctgtccagctttgttctgttgctggcgaggagctgcgatcctttggaggagaagaggccctttgatttttagaattttcagcttttctgttgtactttctccccatctttgtggtgttatctacctttggtctttgatgttggtgacctacagatgtggttttggtgtagatgacctttttgttgatgttgatgctattcctttctgtttgttagttttccttctaacaggtccctcagctgcaagtctgttggagtttcctggagttatgctgcaaatcctttttgcctgggtatcaccagcggaggctgcagaacagcaaatattgctgcctgatccttctctttgtcccagaggggcagctgcctatatgaggtgtctgtcggcccctgttgggaggtgtctcccagttaggctacatggggacccacttgaggaggcagtctgtccattctcagagctcaaacaccatgcttggagaagcattgctctcttcagagctgtcagacaaggacgtttaagtctgcagaagttgtctgctgccttttgttctgctaagccctgcccacacaggtggagtttagaggcagtaggcctcgctgagctgcggtgggctgcccctagttcgagcttcccagccgctttgtttacgtactcaagcctcagcaatggtggacgcccctcccccagccaggctgccagcttgcagttcaatctcagacagctgcgctagcagtgagcaaggctccgtgggtgtgggacctgccgtgtcgggcacgggagagaatcaccttgtctgctggttgctaagaccttgggaaaatcacagtatttgggcagaagtgtcccatttttccaggtagtctgtcacaccttcccttggctaggaaagggaaattcccccaccccttgtgctttccaggtgaggcgatgccctgcctgggctgcacccactttccaaccagtcccattgagatgaaccaggtacctgagctggaaatgcaggaatcacccatctgctgcatcggtcacactgggagctgcagactggagctgttcctattcggccatcttggaacgcccccatctgattgccttctggcttctgttgtttctgataagaagttagcctttattgttactgagattcttttgtatacagtgaaaaaagcatttctcttcttttcaagattttagcttttgcttttaacattttgactggtgtgtctggctgtggatatctttacatttatccttattggagtacattgagcttcttaaatttgtaaactatgttattaatcaaaattgggaatttttcagtagtttttaaaagtatcttctatgtttctttttccttgtcttcctgggtcttctataatgcatatgttggcatgcttaatggtgtcccacgtttctctgagaaactgttcatttttttcagtctttttacattctgttctccagattgtataatctttattgatttatcttccagttgccattccaagttgtttacacagaaaatacatacatagccacatataaattattagaattaattatatagtttaaggttgtttaataccagtcaatgtccaataattaattatatttctaagagctgcaacaaacgagaaatgcagtttaaataaatataccgtttacaatagtatgaaaaatatcaaacactggaaatttttgtggaaattgtcaagcagattcaaaaactcatccagaaattcaaagtaccaagagtagctaaaataatcttaaagcataaaaagtgataattgctttactggatatcaagatctttgataaaactacgtaattgaaaacagtttggtatcagcacaaggatagaaaaatagagcaatggaagaagaatagagaacccagaagtagagccatgcatatattaacacttgatttataacaaagttggctttatggaacagtaagggtaatctttgacacttcccccttttcacgtcatacacaaaaattgattccagatggattatagagctaaacataaaaggcaaaacaataaatcttcttaaagataatgtatactttaaagttcatatggaaccaaaaaagagcccgcatcaccaagtcaatcctaagccaaaagaacaaagctggaggcatcacactatctgacttcaaactatactacaaggctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattgaagatggattaaagacttaaacgttagacctaaaaccataaaaaggggatcctctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactctggggactgttgtggggtgggggggaggggggagggatagcattaggagatatacctaatgctagatgacgagttaatgggtgcagtgcaccagcatggcacatgtatacatatgtaactaacctgcacaatgtgcacatgtaccctaaaacttaaagtttaataataaaaaaaagataatatagattatcttttttactttagagtagagaaaggtttctaaaatgagacccaaaacacagtagccatcaggtataataccaataaatggaactactttaaaattaaggactgcttcccattataacacatcatcagtacactacaaaacaagccatagaatgggagaagcatatctctacacatataaccaaaaaaagcccttaagtcttagaaatccaactcctccaagtcaggggccaaaaaagataatccaaaaaatactggaagcagattgaacaggcaagtcataaaagaagccaaagaacatatcaaaggatgtttagtattgttaatgataagagaaaagaaaattaaaaccctgatgagatatctttacatatgtacgagaatgatttaaattaaaatctgacaatacaaagtgtttcttaggctgtgaggtaatggaactgtttgttatctgttgctagtatgtatattactttgaaaaactatttagcatcttctgaagtggaagatatgtatatcctatttttagagctctaaactggaagaaactcagatgtccagcaacagtagaatagataaaagactgtatattcatatgatggaattctgtacagtactaaaaattgactacagctacagaaaacagtattgataaatctcacattattgagtggggaaagaacacaaaataatactgcatgactccatttatatgaaatttaaaattgattaaatgtttagcagtgcaagtttaggggataaactataaagaagagcaaagttgttattaccataaatgacaagagagtggttgtctttagaaaagtgggagggtgtggtaattgacagagatctgcggaatctttttggagttgctggcagtgccagtgaccaggatagtaggtttatgggttaattcactgagctctacattttgttttgtgtattttttatttgtgttatttcacatacaaaaagcttaaatataatgttacattacaaatgaatcattatgcaaatatctgaaggaattagagttagtaaaatgattgttaggctttttcagtggtatatcacatttagtacagtaaacatgggagggctttgatagtgaaagatggtgcatgatacagtgaacaaactggatgggaaagaaaatatattcacctgtaaaatgatatgtatgatactggtctttttaatctataaatatgtttgcagaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggtcagtagctatttgaaatattaaatatgtatgtattgcatattttaaaagtgtgagtgtatttggagatattgttactgaaaaacaatggtagatttaaacaaatgaagataataaacattccttttcaaatgggaaaagataaacattaaatgatatgactctgcacagaggcatttaataaatcagatttcatatgtttcattaactacttcatgattcttaaagttgatggcattctagttaggatatgtacttaagtgaagaattgggggttaaagcgttacgtaaatctcaggtatttcactgaaggggtccattatggggggggtttcaacgatgatcctcttgaagaaacaatcattattcattcaaaaaatacatattgatcgtttatgagacaatggagataaacttgtgaacaagcagatagagtccctgtccctgttctttgtggagcttacattgtaggaggaaagacagacaaaatatttataagtggttttgattgatttgcttccaaaagtcaggtcattagctaaggattagagtggcagtatgtatttttaaagggtcgaggacaaaaagaggaaatgttgaatattttactattattctgagagtgagaaagtaaattaaatacattagtgaaggaagatttctggtcattgctgagggtccacttgagattaatgacaataaattcaaagtgagatcagccttggtcgtatatttttctccaactgtattttactgttttcatccagttgcagactcagcagagttgtgtttaaccaaggctggggtttggaccagtgaatatgactgagagggagcattcaagggagctaaacatggagaagttttggttatagtaaagtaccctgagatagaacttggttaaaaggaaattacgccatgggaaggatgatagacagtgaataaatggtagagtctgtggactgaaagtttgagtaatggttgatctagggatggtgatggtcatgtggttgtggtcagaaaggggatgattgaaatggggattttggaggtaaagatcagggcctacatggtccaacaccacagccactggctacatatggccattttatacttaaataagattttaaattcagttcctcagtcatagtagccacattttgaaagccgcataaccatatgaagccatggctgccatattggacaatgcaggaaaacattttcatcatcatgaaagcatctgggaacttgttagaaattcagaatttaaggcctggattctactgaagtatattctgcattttaataagataccaggtgattggtatgtacattaaagtttgagaagtactgagagagagaaatgtaccttagtatgaaggtgcaatgagcatgtatgtggtttattttctgtgaatgtccatatatttttttactttgaccaagcattacttttattatttccatatttaaatatattattactaaactggtcttctgggattagtataatggggagaaaggagtatttccattttaaacactttttaaattgatagtaccaaataagaggtactgagttcagaatttaataaatatttaatttcattttcttcatatcaaattttatttaaattgatgttccctagtaatttactagtctggtagtttccctgaaattctcaaagaatgaatagcaaactgtatcaacttgtaacaagatttaagcatgttataaatgacttgtcaaaacagaattctttttttaaaaatgttctttcaaagaaaattataccaaataatgattttgaaagtattatttaaaattttatactaatattagttttttaaacaaaatgatttaatatatttactgttctcatattagtttcatcagtcttaacttttgctttaggggatggataagaatgcttttgagaaaaaatataatactgttggagtgaatatttttcgaactcaccagttgttctgtcaagatgtacttaaattacgtcctggagaaatgggtattgtcagcaatgggagagtaagtagaaaaagctattgctctcttttctcagtgacactgcagtgcactggtctgccttttttctgtcacaattcccctgatgtgactgacacacacagaggacggtgttcatgagctgaagacaccagacacaactcagcataaataaaatggggtcatgacacacttcccattccttcattctttcccccatttaatgagaatgatgatgtgggtaaggaagaatgttctttatgtgtcttgcttttattttgttctaatgtaagtattagaaggaacaacttaatgcacatcttcaaaacattgtcattagaaccactgttgtagtaggtgtagcaagtaggttatgacatctttcttcttgttcctacagttgtgtatgttaaatggcattagatactattttcagttttgaagtatcaagtagtataaattgccatgtagtatttattaataaaatatttacaaggctgtaggaagaaaatctcttactctccaaccaccctaataaaacttaatagcttattgtttttcctttcagcccttttttctaccatacatagatagccatttttggttttttagaatacatccttataatcctactatatataattttacatcatgatttttctgttaatataaatgtttttctgattgcagtctttgtagacacatacaaaataagtggatgatatctatatactaatatttttaatatgatagtcttatttcatacaaattgtttaagtaaaaaactgaatctggtgcttaggtttattaagaaatcaacaaatgcagtgtttttcacgtatctgtggcttgaattttcaaattatatatccctcaatcatcttcaaagttctaatgcactcttaatgttttgtttttcacttacttttgaattctgttcacctgcatattagattcaggttcatctatgtacagtgctattttacacatgtcaaaagctgccatttattgtaaaaagtattggtgaattttggtagtgagatatgtagagctctgtaaatggcattgctttttcactttaaaagttactttgggaggaaatacagcttttaaaaacagttctaaagcttttggctgtctttgaccatgtcaagcattttaagggataaagagggaaacaatggcacctgttttatctagtgccttaccttttagttatatactagggaaaagctatcctatgtcttgtcattttgatataattcatatagtgttattgacattaatgataacaaatactagatacagttatgttcaacttatttctcataaacataaaactatgttttgtcctgactttccttaaaattgataaaaatattaagatattaatcttacacctactgtgaaccaaacattcttctagattctgaaggcacagcagtaaacaactacgttttcatggggctaatattttgatggatagagagagacaacaaacagcacccttactgataaggcatctatcttaagtatgtttatgctgctataaaaatatgccacagactggctaatttataaagaacataaatttatttcttatacttctggatgcttggaaatgtaaggctgacgtgctgccatggatgtctggtgagggctgctctctgcttccaggatggctccttgttgctctgtttttacatggtggaaagtagaagggcaacagagtgctcccttcagtcttgaactcttttattataaggatacaaattccattcatgagggcagagccctcgtggcttaatcatctcccaaaggccacacctctcagtgctatcgcactggccactaagtttcaacacatgggttttgagggacacgttttgtcttaatctgttttgtgctgctgtaacaaaatacctgagactatataatctcagaaatctattaaagaacagaaatttattctctcatacttctggaggctgggaagtccaagatcaaggcactggcatctgatgggagctttcttgctgcatcctcatacggcagaaggcagtggggcaaaaaggggatgagtgctatgttcctacatggcaggagagagcaaacccactcctgaaagcctttttatagtggcattagtccattttgaggcacagccctcatgacctaaacacctcccattaggccccagctcccaacactgttgcattggggattcagttttaacataaattttggagaggacaaagacattcaaaccatagcacattcatagcagtgtcatatgggcaaagaaccaaagaaggtgaaggaggaagccatgtcaaatatctggaagaggattgttctagacagagtacagtgaatgcaaaggacgtgaggtgagttcatgtctgtgaatcctgtgaatcatgtctgctattctaagaatagcaggtaggaagagagcaggcaggagagaagccagagaagtagctgggggccagatcatattgggttttataggaagtttaaggactcccactttactctgaatgagttgggaagtgcatagttctgggcaggagattggcatcatctagcttatgttttatttggatcactagaggctgttacattgggaatatacaatagggggtcagggagccagttgggagataatgcagtagtccagatgagagatgatggtggcttggaccagaatggttctagtggtggtagtaagaagtggatatgggatgtattttatgtgaagaatggacaggaattgtccagggactttggtgtgagatgtgagagaactaagttactggcagaatggagttactgtggatcaaggtgaggaaggctgcaggatgagtgaggttgtcaggagcagtataagaagaaggaaagagaattcagtttggacctccaaaaagacttgttaagaaggtgattgaatatgagtgtagtacagaggaaggattggggctggagatagatattaagtcaaattatgttgattttttctgttgactaatggaaaaatgtaatttcaattatccttttatttgtataactgtggttttaatagaaaagtatattggaaaataagtctgtggtttatgagcgataatgtaatacttagcttatcactctgaaagtaatgctgttaagcataataatcacagcaatgtggcagatgttataaaaatttggaatcagatagtttaatgcttgaaataagtatgatattttagtataaatcttcattctgagcctgttcaaatgtttccattagaattggaacatatgaaaagttaaaattgtttataaatgatcaacaactagggtacaatgatgatcacacagtttcttaaaaacactgaataatttaaaattgacatatttaatattaatgccacaaataatgccattgttataataatatttatttgtattacactacatattcacagtttgctgaaagacatggggtagcagggagtagggaacaaaagcagggtcttttttttgttttatagtcagatctggattcaaattccagttgcaccattaattacattacactgtgagacctgatttcttcatttggacaatgagaatgataataatctgtcttacaggattgttggggtgattaaatatgctcctatatttaaagcacatagaaggaacccaaacacagagtaaattttcagtaaatattaactgctattttctctcaatatttgaagggcatcatgaaaaataatgggcatttgtagacttaatttgtgttacactagctaaaagttagcataaaatcaaaactagttgatcaaacttctgtgagtagagagacatttttagctcagtatgtggatgaaaatctgacagagttttctgcaattttcatgacctgtcaaatgaagtaatgcatttctgttacagcaattattctatgtaactgaaaaatcacatttctcaaatgttatgaagaagatttaagcaacataattttcaagtttattgttcttttacccaacttggacattatgtgattttatgctatttaagttactttattccacaaattttcagctttaaatagaaccaagacacagaaacattaggtttctcctgtttgatgctgtgcttaatgtaagcaaaatacagccagttttctggtaaatttaatcagtaaagatagccaatgtagttaaccccttaagacaatacttttaagattttatttccttattctaatgttactaacaaaactgcccctgtcgctagaggtagtatagataagattcaactgttttccaagactgctgattcattgttcagaaatgtaacattgaatgtgctttcaaagttgctttaaaaattatatcacgtcttaagacaatgaaatgtttatatgagtacttttagtattatagtgcccatttttgtgtttttaagagcccgtgttttatatttaaggtgaaacatgatatttatttagttgagatgccaaaatcccagttagtcacctttgatatgagaaaatgggatagaaagattcaagaactatgcttcagtaatttttagaaaagatgaactgtaggagcaggtgaaggggaagtgagaaaatctggctacagccattacattctggtctttttaccaagaaaaaaataatctggttgacgtgttttctgattatcattaaatataattgttttgtacataggattatgtcagtctacagtagggttttgtgtacgtggtgttagaatgattgttatgtactaatttcctcagaaagtgctcatggtagtagagtcagtagtggttgtgatgggagagccattctgagaaattaggtatgtggcaatttggcagcttctaactttgtagttactggtttaaagttaatataggtgaccttgctaggctcctaaccatttatacagtatcagttaaaagaagactggttggtattattatagtaagtatgtgatttttatgtgatttttctcttgggttttgctattttatggctttcttataaagtaattcatgtctatatagtgtagagtacaatttatagatgaaggtgaaagaaaattgaaattaaaagatttttaaaaatatagaccattgctttcaaaattgaattcagattgaaatggtatttggaagcatcatgatttatgtttcaaatcacgatttatgatttatgtttcaaatcatgatttatgatttatgtttcaaagtaaaactttctaatggaaataatttgctaattttttatattgtcactttgattttggtgtttatacaaatgttatttgtaatatcaaagtgagaaagtatatcttgtttcctagcgtatttagtaaatggcaggattaatagctaccatatctttaatctctaattcatttttgcttaataaagaaatatctatttgatgaggaaatgtttttcctaaactgatatcttctagaagatatatgataatataactgtttttattttaagttcttaggacctttagatgaagatttttatgcagaagatttttacttgttggaaaagataacatttagtaatttaggagagaaaattaaaggcattgttgaaaatatgggaatcaacgcaaataagtgagtatataagttctaagagcaattcattttgggtttggtattttgagtctaatgtttttaagattagaaaatgtttcaaatatatagacaagtaaaggtataataaaagacatatataaagaatataagcaaataataaaaggcatccatttactcaccatcacaaaactgtagatgttaatgttttctttgccttggctctgtctttctccttgtttcttacccatccaccccagtctcctccctccccaagaggtaaccattttcctatagattgtatgcatggttcccatatttgtctttttgcttcatgtgtaaatatccattattggtgtttattgtgttgaaggctgtgactgttttagagaaatgctattatacgtaggtctccctttgcagtctactttggtagatttaaccatgttcagatatataaaacctttcttgaagcattaattgtaacatgaaatatggaactctttccaaaaaactcatacactgtttgtcttgtttatctagcatgagtgactttattatgaaagttgatgcccttatgtcctctgtgcctaagcgtgcatctcgatatgatgtcacatttcttagggagaatcacaggtaagaatgtattcgtatttgtttgtgatttttctgttaatgcatgcaattatttccatttgttttcataacatggtaaaatttaaggtagaattaaaagttatttattagggaataaatgtatttgacagtattaggaagataaattccagttagttatatattctagtaaataaagggtaatatatatggagagagagtgtacgaaatttcaagtaagttaaacatgttataatttgtcatatttttaatatctttcatacttaagatcatttgtaatttttgcagtatctcaagatagtcataaataatattatctttatattttcaatgtgtaaagtgactgaagagttctgattaatcaaatgtagggtggcctctgtcacaaagctaaacacacatgcatgcgcgagagttcaaaggagtgaagagagggtccaggcaaagctgaactgttgtaggcccggctgctgcctcaggccagcaaggtgaatcagcagatcagcagcaagtgtgtgagctgcaaaattgctgctgctgcctctctgttctctagatctcctgagaatctctgttgttgcccgcccaagcaagaaacattctggaaaatatgatttagcctggtcaagttgacacattataaagctgctgcgtggaccaagggtccaaggatttactctgtcaggctcctgtggtaggatggaaataaaaggctgtttaatcactatcatatgtgatttctatgcccatattctctatgagagtgcctcgttaattgtaaaagtagctaaactgctttttaaaaaaatactactgaagattccctgagctcactcaagtgtcttacagttatcacctttagtaattttctctagaaataccattttttgtctgtcaaagagcattctttcctatcaagggagataataatataaatacggttaaatttatatgtaaatttctacattaaagtcacactctgttattgaattttagaaaatgtcagtgaacctttggaaattgataattaggataatacagtatgccacagtgatgggcaaatacttcaggtcactttacatttgaatttatgaattatcagtattacttccatagttatatctgtatatttcatgagcatatgcatttacttctaaaatcacataaaaatatttattcacagctttttagagagatgtgtgtgtatacatgtatatatatatttaaacacagtattatatctttgccattctgcttctatgtctatagggagtcattttataattaaatatgttaaaacacttgttataaatccgttatttctgtattgatatgtttgatcttaattccaacttttaaaatttaaattggcttataagaaaatttaaatttgacagggtaacttaaattagaaggtttgcaaaaggagaaagagtaggagtatattgaaatctggaataaagtgaaaaatgagaaaaaacaattatattttttccccagccctgaaagatctctatattagcctattcccttccatttagactctgtggatttgacattcttctaacatcttagacaaaggcaaaaatagcaatcctaactactcaccccatcatcccaggaacttacaacattgaatgtaagttgtgtgagaaactatgaggtcttgaaggaagccttgcaggctgcggcaataatgaccctcctgtcatgagcataccatgaatttggctctaagttttccagtttatacagttcccaagttcatgagaggaaaacaaactagatgttcagatgaagtgtaattattcttagaagagggaagacagaggaatttctcccgggagcctttataaagaggatgctatataatgaacagtgttttcaatattcttaaaatagattacttgacctattttatagataggttaacagtatcataacaaaattcaactcagagttttctattgcaacggcctgtttgaaatgtgttcaatatatctgtaagagttgattaactgtgtatacctaagcagttcttcacccttttttttctgacatggactttaataattaattaactgtcactgtgcttgacagtattcttctggctaatgacatgaagtgtatcaatagttttttggcaattgagtacaaatctgttaccttaaataggtggtagttagcatcttgttgttaatattgcatgagaaataggatgttctgttctattcttgggttagtcagtgtactatctactagtgggctcaggattctactcagaactgtcttgtacatgtataatcagatggtggggactatggaattctgcttcatacaacttcatagaattagcagtctgggagaaaaaagcagcagtaaacaggtgcatgctgaaaccataattacatctcatacagcatacataaaatgaccagttttgagtggtgttacaaagtagggtagtaatttgtaaagtgttcaccaaggtaactacaggaagcaacaattgtcaagagtcactttaatagcagaacgtctgatttgtggctcttaggtctagcaataattatccattaaggtctgttgtctgactatgcccctcttattttaagataattaaatcgtcaactgcctagaaaataaaatgtcttgcagttttctatttagatgacccatatttgaagtaagtgtttatattagctttttaaaaattgctgagcaattaatcccctcactgcagaagccttttcctaccaaagaaactaatattcctgtaactacacatgtacctcttgatttggtaacctttttcctttgtaatatgtaaaatgtataattaattcatcctacatctgagaaaaatatttcctacatgattatagtgttaaaacagtaattcagtaacatattctctgcttttaatcaaatatacatgattaacttttaattatattaaatgtagaattgactgtctccctctggcctgttctgtacttttaatcattttctcatttccctttaaaaaactagtccatcttctaatttagaacttttatcggtgaaagataaaaacggataggacagagggaatgaggtgaggagaggaagactgggatcaaaataaagtatgattaatttggatatttttgttcctgaacttacctgttatagtatattgattttttgaaatactaaatttaataaagtatgaatagttaattttattctcaaatctaaagaaatatattccactaacacaaaagcatcttagctttattttttaaattgtacaatccatgagaatgttgagggcctaaaattatcagagtttttacactaatgggatcattctttgaaaggcttttaaaaaatcatttcattcataaaaccttacttcattttctctcattcttttcagttttgtaatttgttgaaaacagattttcagatttgcaagcattgtgtgaaataaccagtattttacaattttagtgagaaagaaaacaatttataagaattatatagctaagatcatgattagttgtttgtataaacttaacacgtcatctttcatcttattttctattttcttagtgttataaagacgaatcctcaagagaatgatatgttcttcaatgtcattgctattgttgatccattaacaagagaagcacagaaaatggcacagttgttggttgtaagataatataaattagactaaatgtttttgtttttaaattcataattttttcaagtctgttttcaaatataatcagctgtttatgctcttgatccttcaccattttaatagagtgtcatatttcaatgtagaaaatgaaatgatggagctgtgcacagggtgttgttatgactgtgctgaggttaggtgttgctgtgaactgcattgtattccccacaaaattcatatttcaacacatgaaataggtctcagtgaactttaagccctaactcccaatgtgactctctctggagatagggctttaaggggatcattaaggttaaatgaggttatatgggtgagaccctgatccaataggattggtggccttaaaagatgaacagagggagacttcacaaagaagaggttatttgagcacacagtgacatgttagccccgtgcaaactagaaagagagctctctccagaaaccaaatcagctggcatcttgatcttggaattcccagcctccagaactatgagaaaataaatttctattgtttaaaccactccatctgtggtgttttgttatattagcctgagaagactaatacaggtgtctttcatatgttgtgaagtgtggcttttggagaagctgaagcttaagcttaattggataaaacttaaagtgtaataaataataaataatgttagccaaacaagtgaagccgaggaaaggggaaacatggagtttgtattctataggtttggccgctataacaaaggccaaaataacactactttcaagactgaagtttctttctttcatctcctggtctaagtgtaggctgccttggggttgctaaggcagctacacagtgtgagggactcaggcactgcctgtgtcattgttgagctgtcacgaagcacctaagatcaccagtcaggccctaacatcatctctgcacttctgccaggaggaaggggagaataagagcacagccccaaagttagatgtatgctgtcctatcacttctcactgaccagaatgtccgcaggctggctacactgaatgacaagggaggctggaaactatgcccacaagtcctgcattaacctggaaattctttccctgtgaaagaggaaaatgaatgcgaagagacagatatcagtctccaaaaggacttatgtggcttaccattttacttagaatgtcaaacattcaaattagaatgcagccttcagtagttaaatttgaataagctagtcccattagaaggctgtatgtttttctactgatatcgaaaattttacaaactatttgtcctttggtagtcaacttcacttttgaaacaggcaaaagtaattagatattgagtctggtgaaaatgtaagtgatcaagccatatgattcgctgtatatcaaaatttcaaaatgcaattttttttagaatttagtgcgcactgccaaatctcattggaaaatgagattttattagtggagacaaataattttggaaagactttgtcattctagctgttcagtttatgaaacgagtaggacaaaccatagctgatttacctacttgttcttttagcattggttataccttcaaatttatatgtcttgagatacactattcagattattctttagaaagcaatcatatctgaaaggagtggagctagtatgatgctttttagtatgcaaaatccctattcctatgaagagtcattattcaaaaaacactacttaaatttgtaagttttttatataaaagtagaatttaggagtaagaaatacggaattagccaaagcaggaagatcacttgagaaattcaagaccagcctgggcaacatagcaagaccctgtctctaaaaaaataaaaaataaattagtcaaacatgatgctgcatacttctagtcatagttactactcaggaggctgaggtgggagaattggttgagcccaggaatttgaagttaacagtgacctatgatcacaccactgcagtctagccttggcaacagagcaggactatgtctcttaaaaaaaaaaaaggaattatacagagatataaaatatggaattgcattccagtttccatcattggtaataatagcatactttatttcttactttataaaaggataatttattggaagaaatggatagtttctcatctaacacttgagaaaaacagtggttcagtgacctccagagtagcagatatgatgagtgatagaataagaattgaaagtcaaatctcttaaatccttagtctttatgttctaatttctcatcaagcctgtatcctttctattacatatatctgttttgttacttctccctttacctatatcatttgttatctaacagctttagaatcttcactgacatgttgcctatgtggagatggggactatcaaaattagtaattcttcctctacttcttactatccagggaaatgaaaagaaagtatttattcgtaggtagccaagaacttccaaatcccaaaagaatcaggacaccaccaacgttgttgtaaggtcaccactttgtatttgcagatcaaggttctagtaattattttccttgttcttcaatactaaggaaatttagatactatgaaaaaaagtcactttaggcaaagggcaagcagcataaccctgggacattgaaatcaactgtttggattaaaatcttgcctgtgctgtgagtttctgtgtgaccttaatctctctgtacctaaactgcaaaagtactatttcagcagggcgttgtaaggatcaagtgagataatgaacataaagttttaatatagtacctggtacatagtaaatacataataaatattagctattaatattatttaatatcaaacatgggaatttctttccaataggtacttggcaagattatcaacatgaagataaagttgttcatgaactgtaggggcaggctttcagaagcccctttagaaaggtgagtctgagtgaacaaaatttcattttgaaaaatttgtaaatgctgagaagaaaaaaacaatcattgttactggacctggttttttcttttcttcacaagatgcttcaaagaaataagtcagaaagtcagactatttactaaccttaactgacttaaaattgatgtcaaaattaaaataacctaactcagcaaagtgatctgacctaattacagaatttacatggatttatatttattcataggtatttttggaaatgtgatttaggaatacctatttagatatacatcaatgggaaataaggtggaattaaaccatttttggtttagcagaattaccaaaatgatctttattatatcatcacatttactatttgggggcattaggataaaattagcttagaataacctgccagagatataaaaaagtgttgtttataattatatacaaatattcctcattaacactcttctgttgaaataacattctctctcaagaggggacaaaaatataccctttctcttctttgtggatcagaatcactgtcattcattatgagccattcttattgatgggaatattcagttctccttcatgtgtcattgggcagaaaacagggtatgtaccattgcactagtatagctttttaagactttttaatgtgctcatctctgtattatttaatgatgtaattctaaacaaaaaatgtatgcatacacacacaagacaggtagcattctgttcattccttgtttacttttcaaattgtatttgttacaactgacatactatagatgttgccttgagcagaacttttttttatttttatttttattttttttggagacaggttctcactcccattgtccaggctggggcaccatcacagttcactgtagcctcgacttctcaggctcaggtgattttcccacctcagcctcctgagtaactgggactacaggtacgtgccaccacgcacagtttttttgttttgttttgttttgtatttttgtagagacggggtcttgccatgttctccaggctggttttgaactcctggcctcaagagatacacctgccttgctctctcaaagtgctgggattataggcatgagccactgtgcccagccagagcaggcattttaaacctaagtatttttaatagttggaaagcaataaaatggaaaatgtgggaaatttaagtgaaagtttaggacttattcattgtccctcaagactcttgtccatatatctcattgagtttttatgcttctcatttatcttttgtattttaaattttatcacatgcctttttacatctgaacaaaaactttaaattttttagctactaattgaaaggtttgttagttccataagtacagaatttttattcacaggagtaggggtcctctctgtaaaacatcacattatgtaataaagaataggattactgaacatataagcaagcataatctactgggagggaaagaattgacttttctaaatgaaataatgtactagagtatacagttatttttttaactagtagttcaacagaatcttattaactcagtagcatatatcaagcaacctagcatacacatttattcccagccctttccttttagtaaatttattcttctcagagatgagacaggttaagggcaggaatcccctcagcttcttactcttaactgctatacttcctcagccttcctgtattgtagggaaggaatgaggcatctttcttcttttttagttaaacattcccactctgttttgatctcatgctttcctgtttgttctggatccttgctatatcacatattctctcttgtggatctttaatctctatactagcttttttcattcagtccttaaagttattcaatttttttaaaagttgctcccttaactttctctcctctagagtcttttttttccctcttcttcattccttcttaactaaatttcttcaaagaatggtcagactctgtcttcatatctcattcactgtaccttccactgcagtttctctttaactttctctttgccactgaaattgtatttaccaaatcacaaagaaattgctactcactacattcagagaatactttttctttgatatttccactgcagcaagaatttgttttgaacatttacttcatgactgtattctctcctgtttctcctctttttattttctttgtctatctgcataacatggctcccagtgatcaccactgcctgggactcacactctgaaagttctcctggagtgagagctagacctagtgatttggctctcataaaacaaaatatggctaaagtgatggaatttcccttctgcaattaggttatgaaagactgtgacttttgtcttgctgacattctctctctgtggctcttctgtgtgcttctcttttgaagcatattggagatgcctttttgggaagtaactgcaagcagtctgcagacaactaccagcaaggaactgcggtcctcattcagacagcccttggggaactagaagaacctggaagtagatcctacccttgttgagccttgagagaactacagcacagctgacaccttgactgcagtctcaaaatagtaaaagccactagccttgatagcataacataataattctgtgcacaatattgaaggatgaggttaaaatacagcaaaactgaagttaagtctaaaagtgctattaagcagttgctttcaacttaatcctatttgtttttagttgagcttttaaaagtggtactagaatttcagcttgaatttcatttgtttcctaccatttctcttcatattattagtggtggtaaaagttaataaaatagctgaaaaatagaccatggtcagatttgaaggaggatgcatacaaatcataatacaataacagatcataaactcctagaacctgcataagtcaggtatatcttaaagggattctaatcatgttcattaaggaatagttaacaatggtagataatatacatagacttagatagtagtgtcaacaaataatgattgtctatttctcataagcattaacttttctgcagtataatgcatcttagtctttttgattgtagacttctggtcagatcattaagcaattttcaattttgaaaatattttaaaagaaaaatctcagttttggtcacattatgtatttttatgttttattaacagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatgtaagttattgtgtatagtcatataaagagagagaaacaggataaattcttatcagctattacaattgtagcaagtgagcaatcatactatgaatgtttaccagaatattcttttttatgattctaggtcctgatccaatctttcctttgatttttaagtttttctaatttccaaactcagcttctctagtcttccaagttcctaggtgtctttacattttttctttctttctttttgcctgagactactagcttgcaaagacatttctctaagatgagcagtgtcaaaaatatagagaggaacacctggcaacttagtacaacaccattaagtacttattttgctcttcaagtttagtttttaactcagcaaatttcacccaaaattgttttgttggttgttggtttttttttttttttttttttggcctcacagctcatagccagagaaagtagtcctaactaaattagggtagaaagtaggaaacaaaatttgcggtatactacaggccaggtatacctgcttctcatcacccccggtatgacccttgtctagtgagtagtcagacttctcttcctcagctgttgtaattcacagcacagaaagaaagtattaaactgagtcttttaaacgttgaatctagaatgagaaaaggaattcagaaaccacaaaaaagggaagcgttttggaagaatttaagatacgtgtggtagtctgttttcacactgctataaagaactgtctgagactggctaatttaaatggaaaagaggcttaattaactcacagtttcgcatggctagggaggcctccagaagcaatcatggcatcacggtggaaggggaagccaggcacatctcacatgacagcaggagtgtgaggggagtgccacacactttaacaccatcagacctcatgagtattcactaccatgagaacagcaagggggaaatctgcccccatgatccaatcacctcccaccaggcccctcccctgacgtggggattacaattagacatgagatttgggtgggtacacagagccaaaccatatcacttggtatccagaaaatgaggaaaaaatacttccttctccttattgtccttacttccttctccttattgtcctccctctgacctatttccagctctttgtgtctgatacctcctgtagaatatagccattgccttgactgaagcataaacatttacctgtaataatttggttaagattgtttataatgtttatttctcatgcttcttatgcattatcttttgcctaaagattttccttctaggaaagtttattttgatcggctcgtatgtggattctgtgggatcctaaatcacttttctgtaacatactccccatcactcccaactggacccacctcaaaaaagaacctaaaactcagtcataaccatcttctaatatcagtccttcaaatttagagaaaaggcagcaaactaatagcattaatgagaaaaacttaacaaatgaatcttataagaagtgaaaaaaaaaatcgctgttttttccatgatcagtcagatctcttaatagagtctggaattcttcatgaagagagtgcggcaatatactcaataaggtaacttttaaacatgctatccaaaactgtgaagtgtttgtagtgggagaaattagtacagcttaagaaagattttaaattgaatctgctggtgaaaatttcagcagctattcaacagctgatggagattaactaaaacttttttttgtagtgagtgtcaaatctaatagcgtctttttagaagttgttcggatgaacactagctctaactctgaagttagaagactaggatgaaggaaaatttcctgtgtcttcatagtttaggtgaataaacaaaaggagattataaattctagcatctgtaaaagttaactacccctcaggctcatctttttcattgtgtgctatacaaacttaaaatattctgcaaccatcctggaaaaataacaaaggcatttggtatagtagaaaggatttttagataaaggggaaaagtacatacactctggcaaaaatgagataacaatgagagatttaccaccatatactaacttgtacaaatattcctggttacacctaattcccaaacactgtacaaacacctggaagaaacttgatctgggaaaattctcccttggcaggactttgttcacatgattgtcactacattgacattattgcacaaccagcattaatttcataattaaaggtgacaaaaatgattaagaaagctaggccggcattggtggctcacgcctgtaatcccagcactttggcaggccaacgtgggtggatcatgaggtcaggagtttgaggccagcctgaccaacatggtgaaacctccatctctactaaaaatagaaaaattagccgggcatggtgacacgtgcctgtaataccagctactcaggaggctgaggcaggagaattgcttgaatccgggaggtagaggttgcagtgagccaagactgtgccatggcactccatcctgggtgacggagcgagattctgtctaaaaaaaaaaaaaagctaaaagtgagacagttacttttacctggagttcagatgtgttgctcttctcagtgcttattgttagaactgcatcaaaagactctctaattatatttcatcacagcatatatatgaaagatgtcaaaatacctggaataacaatggtggttacaccattttcacactgttccaggtattgccataaaaggcaagagaagatgcaataaataaaagattgctaacaggaataggatgtggctctgttaaagtgaattcacagaaaaatgcattaatccctctgaaacataaataattttgatatcagttttatttattgatatattcattacaaatataattgtgaaagaatttctgtttgattgccagaggtatgctatagatcctaaataatactatattatgaattagatgaacactgttcatcttaggctcagtttattctctcagtgcataatatatgaaatttatgtctcaaaccatcaaacacttacaaaatttgggaaaaggtcacatttgcagcgaagagttctgtctcttctgcaaaacttagaaatttaaacaaaaccttaacaaacttgaaaatttatatatcagaagacttgtactttagaagtctcccttaatccacaagggatttgttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgccattctcctgtcccagccccccgagtagctaggactgcaggcgcccgctgccacgcccggctgattctttgtatttttagtagagacggggtttcaccgtcttagccaggatggtcttgatctcctgaccttgtgatccacccacctcggcctcccaaagtgctgggattacaggcgtgagccactgcactcggccatgttttgtttttttatatacatacctacctatgataagagttaattcataaattaattaagcacagtagagattaaccttagtaactaataataaatagaacaattataaaagtaggtcatcatcttctactcttgtgctttggggtcactaagtgacataagggttccttgaacacaagcactgtcatgcgagattttattacaatactcagaacagtgcacagtttaaaacttatgaattgtttatttctggaattttccacttatttttggaccatggttgactgaggataacaaactgtacaaagagaaaccacagataaaggaagactacactaccttatgtgcctcaaaccaccaaattatctaaaactaattcctttaactttttcttggatttttgcccagagtcctgaatagtttcttaaagttcagattgcactaaagtctttaagttcagccttcacctgccttgagataagatgcaagaaaaagatgtactatcatttatccatctccactatcagatagcttgtcagagtttagattacagatcaagatatgtgttatagctttgctattaataacttgggaaaatgtgtctgcagttacacaaaatcacattcaatagcaacaaaaatactagattaacatatttacagacaattgttaacaaacccaaatgttgatctttataattaaacttagccttttcttaaaggaagacacttagctattcagccacagaagaacagtacaattaatatcctattagaaaaattaatatgttccatggacacagggaaaggaacatcacacacccggggcctgtcacggggccagagggctaggggaagggatagcattaggagaaatacctaatgtagatggcaggttgatgggtacagcaaaccaccacggcatgtgtgtacctatgtaacaaacctgctcattctgcacatgtaccccagaatttaaagtataataaaaaaaaattaatacattctcaaggttatatttgaaaggtattaaatttatgtctggtatcaacaattaatatttaaaacagaaaataaaaatataaagggaagatggaaacataagcatcaaaaaagatcactaactttcatatttttgctaaaaatgagctttgtggccaggcacagtggctcacacctataatctaagcactttgggaggccaagatgggcggatcacttgaagtcaggagtttgaggccagcctggcccacatggtgaaaccccgtctctactaaaagtacaaaaaattagctcagagtggtggcctatgcctgtaatcctagctactcgggagactgaggtgggagaatcgcttaagcccgggaggcggatgttgcagtgagccgagatcgtgccactgtactccagcctgggcaacagagtgagaccctgtctcaaacaaacaaacaaataaataaataaatgagctttgaaaataggaactaatttaacttaaatcacctctatgaaaacttaaaatattcactagaaagaactctttggaaaaggaattggctatgtttgtatgttgtggtttgaataagtcaacagaattgaagtctgttatataaatatataggaacaagagaaattttcacattaatataaattaagaagatactgttattcacaaactgggtaagtgtatttagactcttccctagtatctaattcataataaaataattaagctttactttacagtcactttggtgtattgcttccttgtctgtaaagtgagggtgttgaactacatgatctctacaatctttttctaatttttaacattctcatattattctgagactatcccatgaaaatctttccagtcaagtaaattgctataaagactctggatataggttaataaattatataaagtttatcgctagaatagtaattcaacaactaattcagaattcaactaaagttttttaaataaatactgtcttcaaagaagttacttattttttgttcttaaaaccagtaaaataacaagaatcaagaaagaaatgctgtaaacaaatgttgtaattatttctgagataattgcagtcaaggaaaacaactatacaatacagaatgtatccaaatagtctatatcctaaacacactaaacaatagtgttgaaaacctaatatggtgaaataagattagatataggtaacattgctgtctttaatctcaacagaattctgtctgtgaaaatcactgtttgatttattttcatgtttagttatgctgttcatatgaagtagagaaaaagctttatcttgaaaatatttattataacatttgcaatagagaaaaatccagaaacaactggaatgtccagccatttaaaatgatatttatagagacagagacatgttcttagaaaaccatgtttaatgaaaaggcaggttactttcttacaaaaaaaatttatgaagacaagaaatagaaatcagtgtgttgatgtttatatcagtgtttattctgttgaggtgcgttctgttttttcttctttccactttggaagtggaaaacgaatttttattttttaaaattaactttaaaaatatattgatcaatttataattagttgattatagacattaatttttttaattacaagaaagccaatagatagtaagttagctttcttgccaagtctgaagtgggagcttcaggacaacagcaaactgaagcagattctttaaggaatttcccatctaaatctcatgttcacgtctttcctgcttggttatattggtgcatataccatgaggttcaggtaaagctgatgtcatgaaaaagaaaaagtttatcataagctttttgtcttgaagaaatcagttcaactcatgaattcactcatgtgtaaaataaagacttaaagttagccaccaaaatacattggccaatattaaaataatcacatttatttatttcaaaattttgtattatgagttttacataacaccaaaaacaatgacatacttcctccacagactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgtaagtattatttaattgatggtgtttaatttgatgttttggtgaattctctgttttcctaagagtaaaatgaaataatctttattctgctgttgctgaacagtttgcagaaaacaaaattgaatctttgaataagataaataaaaaatggggaaaatcatactttaataatttttgacaggttattgtaaaatctctttacttggaattgatttatagaatttattcattctacagttaataaatactttcttagatcattcgtgtattcatgagcaattcgatggtttttagtcatattactcaatgattatttttttctcatcttaaaaggggtattttcaattaaaagcaaacccaggtgcttggatactgaggttacaccaaggaaaatctgaagatatttatcaaatagttgggtgagttatgcaggctgcttttaaatttttacacataaatacgtttttagtgtaatacaaccaagagaatcaaaacaacaattaaaatgttaagattggcctggcgcagtggctcaagcctgtaatcccaacactttggtaggccgaggcaggcagatcacaaggccaggagttcaagacctgcctggccaacatggcaaaaccccatctgtactaaaaatacaaaaatttgccagacatggtggcgcacacctgtaacttcagctattcaggagactgaggcccaagaattgcttgaatcttcgggaggcggaggttgcagtgagcagactgcaccactgcactccagcccaggacagagagcaagactctgtctcaaaaaaaaaaaaaaaaaaaaaaaaaaagatgactgagttaggtctgaacatcagcaagagggcaaaacaggacattccggtgctcatacccatgcagaaacatcaatttgaacaactatccactccacacatgaaactaccttaataaaaactaaggaacgaggtaagctgttacagcactgcagtgtagcacagaaataagaaagacacattgaagagtgtaggataatttacattacatgcattactccttcctcaacctgatacagcacagctggagagatacccccttgggggaagtagagggaagtgagcagcagactttgccttggaccccaaaaccatgctcaccccagtaaaacccaaagccaggtaggcctcacagccccaacttaatgctggtaccagaagactgagctgccagatcctgtagccccaagctccaaatctgcctggtagattcagtttccaagcctgtccaaccaccaggcctaccccaccaccaggcctaccccagaagccccaggctattgcccagcctcaatgccaggccagcccccacaaattcaggctcttagacttttccctgtaccagcataattgatattttgatcatttaatgacaatatggtatacattatatcttatataacaacaccgttatccctgggttatattcaatttggaattgtttttttgcacaaaaattttacctgttcttcagtgagccatagtagaaagcaggagttatcacacttttttggtaaggagccaaagtaagtatttaatgttcatttgagagcacatgtggtctttgtcaaaattattttttttaacaattattttaaagtgtaaaaatcatttttagcttagggctattaaaaaaatagaccataaacctgatttggtttactggccatagtttgccaactcttgataaagtcttttttatacccttaataaatatctctagatttcattgctttcaataaatacttactgagcaccttttattataccacacgttgtgctcaacaaagataatataggagtaggggttactgtatctttttttcaccactctttcccctttatactgtgcctagctcatagtgtcagttaatagatgtgcttgatggcttatgcacacagagccagggatgcttagttctgtggtagaggtgggtaggaggaagtcagcattgacattagagatgatatagtacctcaagaaaattgaagaattaataggaagttattagtcataccacagacggaacattccaggaagagggtagacatgcacatctcccatctaaaactcttagggccatatgtgttttagaatttagaagtttttcgtttggaaagttaatacagtacacatatcatatattatgacgtatatcccagcaggatctgagaaagccctttattaaacatcatttgtattgcagaatgcgttaatattcacactaaaagggtttatgtaaatgactgaaaaagagaatgaaaagacaatccacagactgggagaaaatctttgcaaagcatatatctgacaaagaatttatatacagaatatataaagactatcagaactcaatattagaacaaataaccagattaagaaaatgtgcaaaagacttgaacagacactctaccaaagaagatatatggataagtacagaatgtatttaacattgttagtcattaagaaaatctacattaaaaccacgagatatgccacatatctattaaaatgactaactttataaaaagaatgacgatatcaagtgttggtgaggatatggagtaacaggagctgtttttcacttccattgggtatctagaatggtacaaccacttttgaacaattggacagttcctagaaacgttaaatttacacttaggctaggcatggtagttcacacatgtaatcctagcactttgggaggccaaggtgggaggactgcttgagcccaggagtttgagaccagcctgggcaatatagcaagacctacctctatgtaaaatcaaaaaagtaggcaggcacagtagctcacacctgtagtcctagttacttgggaggctgaggtgggaggatcagttgaccccacgaggtggcaactgcagtgagccatggtcatgccactgcactccaggctgggcaacagagtgagaccctgtctcaaaataagaaggaggaggagaaggaaggggatggggaggaaggggagaaaaggggagaagaagaatttgctttctgtggtttcagtcgcccatggttaaccacagtccaaaaatattaagtgggaaattccagaaataaacaaatcctacattttaaattatgcactgctgagtagtgtgatgacctctcacaccatcctgctctgttccacctggaaaatcattcctttgtcaggtgtctgcccatgagtcacttagtagcattctcagttatgagatcaactgtcatgggatcacagtgcttatattcaggtaaccctcgttttacttaataatgaccacaaaaggcaagagtattgtgcctaactttaaattaaaccttatcatagacatgtatgtataggaaaaacatacatttagggttcggtactatccatggtttcatacatccactggatgtcttcgaacctataccctgtggataagtgggggttgctgtactactgcatgtctccttttataagttacaaaacactagataatacaagctatagtgacagaaatcacttggtgaggtggaataagcagacaaaaataaggacaagtattggagataagcggttgaacaatgctgttttgagaacccccagccaaattgagttccagtactggagtggctagtgaccttgccctaatgaagaatgaaaggcagctggatgtgaatgtttactgtgtgcctttcatgggatacttcgtttacctggtggatggtctaattcatagttgtctgaccccagacccagtttccctcacacaggaaacttgtttatgctgacagatgtccgtgtggctcttgtctgacccatgtccagtttatgtttgcctgatcatcgcggtgacactgggaacccaacattgtgttctccccagcatcctcgagaaaacctggtctgggatagtccctggctcttccaatggggggtgcaaatttaatacaccaccacaaaaagaaataagttcaaagatttatcacttacagatcctggacaggaagggctccatctctaggtcacatcaggcaagaatgaagaggagtcaggcagagagaaagagagagcatgcatgcaactagcagtatatataagggaatagagcatgggtcacttttggtctgtttgaagggaaggcaggacaacagaagcccagtttgctaggcaggaagggtacctctaagttcttatctttggctaccagctggacccatttgggtatgttctaatgcctatgcagcaacctatgctaccttgctgtgtcattcccattacaaatagacagttcctaccctcccaaaactcattccagtagaaaagatagtcaagaaaatgagtgactattatatgttctaagtgctataaaagagtgctatggtagtgtagaaaatgagcaaaataggctgtaacatttatattgacccttataaaagccatggtttcaagatataattttaagaagcattcatgctttgtttcagctttttaaattttgtgcaaactgctttgccaggaattcagcatttctatatctgccactaccgtttcatcattatgttttgcaaagggaaagccctgtatatgaattgtgaggcaaatcccttctgtaccaccaactatccgtatgatcttgtataagtttctttgctatttgtagtctttatttcctcattacaaaagggaataatcctacctcccttgtggggttttgctaaggactaaatgggaaaatcattgtagaatattgagtaaatgcccatttcctctccacttatcccttcttttacaaatacagttatacaatagcacatgtattatgtaaaactaaaactatacatgatttagattctattttatcttctttactattattttctatcatacacagttcataaagatgttcttgatgttatatttgaagtaccactaacatattagtgaaaattgttttttctcattcacagacaacttttggcagtagaaataacttacaaacttgtttgtattacttataaacaataaaaccatatacttagtcataatttaattctacatatgattaatgtcactagctatccaaaatgcaaaaaagatacatgttactgtgtaataaaaagtctaacgaggtcaatataaaatataacaaaaactgatattgtttatcctaatttatgttttaattgtaattgatattacctttataattaggaaaaatattcctgaaacctgctaaaaatctaagctaaaataatattgatatgagtttctaagttcagattttaaagccatggctaaattatttgattttttaaaatttggctttccacttctgaggcataatgcccacaatgtgtactttctgtgtctgtcaatctttttgtagtcattaactgcagattatttgtgtgtactcagtattggctgttacttaccttgaatacaaaaagtctcaaaattattctcctttatttctttgtagttctaccaaaattagacaaatgctgctcagattttcctaattaattgtagagaatattagatactttatttatgcacctttaatgccaaattattgtgctagacttctcatttgaaatctttagaaaaatcttttctgccaaagtaacacttgtaatcaattttagtttggtacctttgagactgaactgtttctcccatgttttttataggaggaaggacagagatgtcaaacaaggctttccattctttctccgcaggtactcgagttggtccaccgtaactttgctggctctgcagtagttaaaactcactctctgcggactcttaaaagttctctattgctgtacttcactctcctttagttccctggttatgttggtgtggtctcctcatacctcctggttgccatattggcaggacacatgactacccagtggtaacaacaaaaccaaatcgctctccttcttggctgcatctgatctgtggaaatacctagacatcagttgcccaacaaactctagttcagagcagttgcagaggcagtaagcactctcctgactcctcgattagagcaacaaaacagtcctcaaatacccaatcctgctccatgtacacttctaactttcccagacatgagtcctctgtgcatcccaacttcagaatatgtgttgcaaagtgtcttctccttaaagtgtctaccttactgagtttagaatgagaaggcaatactcttccccttccgtcctcacagggtgtagtggtggagactcacaatctgacaacagctctctgtaaggaaactcttctgccttcatctcacacaatcccttttctgaacatttttatatgctttatctctctgaggggcaatctgcatattgtgagggtattgagaatggatgactatgcatactcacttcggtgtctggtagctatctcattggtgtttcagtggaagcattctagcatccttttacccctacccccaatattctgtttagttctttactttcatattaccattagttaaatataaattttaatgaattcactattgatcacagtttttatatgtcttttaattttcacattcattttttgtttagatggtgtcttaggccattttttgctgctgtaacagaatacctgtgactgagcaaatttattggttcatagttctggaaggttggaaagattgagggacagcatctggcagaagccttcttgctgcattgccctatggcagaaggcagaaggacaagagagagcaagagagggccaaacttgcccttttgtggtagcaccacttccactcaatgagggtggagcctcatcacctataatcacctattaagggtcccacctcttaatactgccacaatggcaatacaatttcaacatgagttttggaggggagggacattcaaatcgtagcagatggctgacttcccatattatcatagaagtatttaacacaagcaattggatgcttttacatcgtattgggaaggactggcggagcaagctctccaggagggctggatcctaggaatgcttgagaacaaagccaaggaactgaccaaccagaaagagctgctactttcccgtcatcagaagtgagagaaagctagaagctgctgccagcaacacatcaactggcctttggtacccagaaagctaagcagttacacactggaacactgaagtagaaaacctcaatgtctccatgacggtgcttgacaaaagaagctaggcaggcatcagcacattgccccgctcacttctaagttccaaataacatgcaaatgtatctatctgtttagcagaatctaattatcaaccaaaaccttagctgcaaaagagttgagtaacaacaacaacaaaaatgggtgtatctttctaactactgcagtgtatgctaaaggtgggatgttgcctgccatatcataatatacaccaccttaccacaaataagttttttcagagacattagtggtgtaccctcaaatgtttaaaactttgaggtggtcctcaaaggtttaaaaatttcttttgcagttccgtatgaattataactttcctaagtattgaataacagcattataattttattcagaatgcttgaaacaaggcttcatcattgtttcttaccagttagtgttttggatgaaaaatatgaagccaatctgatttacatttcttctctgaaaatataaattgttttttagaatttcaggagacacatgtataagtgctttttttaattaatcatgctttctgacacacagtgaattctttcattttgaagtaaatggcatttactgagattcagtattctcttgaatctcattgagaatatgaattatttgaatgcttcccttttttctgcattaatgccttatcaatgaagtccatttcctctgactgcttagcttgttcccttcatttaagctgcacattttcctcatgtatccagaggtttcaggtgcttagcattgttggtaaaggtctgatagtacagtggtgaagagccagactatctagactcaatttggatctaggataataattgtactttcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactcataggtggaaattgaacaatgagtaacacatggacacaggaaggggaacatcacacactggggcctgttgtggggtgaggggaggggggagggatagcattaggagatatacctaatgttaaatgaagagttaatgggtgcagcacaccaacatggcacatgtatacatatgtaacaaacctgcacattgtgcacatgtaccctaaaacttaaagtataataaataaaaaaaaaacagtgcctgaagtaaaatgagagctcgtcaccattactacctctgctacctgatggaagtggaaagagatttgctttagaatttgtctaggtctagctgtagtgctctgctagctggcttttatactctgggtctcagtggacagggaattaaatggctaaagttgtcaatgcccttaagtagtgttttgtgactataagcagctgaaagtttttaagaaatttgacaatgtttctaccatacaggttagatcctttttgttttgttttgttttgttttgttttgtgacagggtctctcttgcccagacggaagtgcaatagcacaatcacggctcacaggtcactggagcctcaatctgccagtttcaagcaatcgtcctacttcagcctcctgactagctgggaccacagcgctggccaccacatccagctaatttaaaaaaaaattttttgcagagacgaggtctcactgttgcccaggctggtctcaaactcctagactcaagcgattctcccaccccagcctcccaaagtgctggggtcacaggtgtaagccatcacacctggcttctttctgttttctagtggtgattgttggacagagttctgcctgctacattggtttaaccacctcagctcaggaattgggagtaagagaaagtcaaagacgtgtcagtcatgatagtgctagactccccaggtgttcattttggaaaaatgttaaaagtatgtattatatataacaactcaaaagtaactatactaatttgacatctgattgcttccccttcaacaaaattcaactttattgtaaatatgatagaactttttagtccatagtgagaatagtttgaaaaaataattacggagcacagttgccatatttgtttaagcaattttgaaaatgggagaaaaaaactgcattatacataatacaaaatggaaacattcaggtgatgcagatggacatcatagacacattttcagtctcattattttaacaatgtacttcaaattttggcatttgaaaatggctggtggatattaaaaagttggtatagtgtagaactcctttgaaatataaacaactttgaagtgtaaaaaattgtaattatcactacaatatatcagggatgtgaaagattttagttgtgtgatagccttggtatataacagcaaagataagccataatttgaactttcagagtgattgggtagtattgaatttaatgagttacttttgtacaattttaatgtgtactgagttaaaatttattggataattttgaaaattacagcatattatagtatatcttaattgactatagaaacagaaaaacatgatatatgcactagtgttattggacttacgtttattgcaaaatgagtttattctgttatgccatcataattgtatgtctattcttaaattaattatggacacatttttctacttttaggcatgaaggaactgactctcaagcagacctagaagatatcattgttgtattaaacagcttcaaaagcaagatactcaaagtaaaagtatgtgggggcagaactttttataggctttgttcttaatattaagaattatcttctttgttttttaattaattgatttattttacaattaactttacaattttacaacctaaaatgttatatttgaactccagcagtaaaaaaagaagaggattaagttcacaaaggaaaacagaacttgaagatagaagagaaggatttttttttacattatgataactgtaaatatatctactaaatctatctgtagccaaataacattacaaattggactctagagatgagatcaagaacatgcactgaaaaattagctctaaaaagagaaggtgctgttttttaaattgggagagaaagggagtttttaatgatagcagattctttttggaccaaccctcctgcttaaaactagtgaaaatattagataaaaatttaaaaaaattttaaaagcaatgaggaacggagaataataagataataaggataataaggaaacccaaaaccaaaattaaagggaaaatgcgagcctagtgaaataagcaagcacagaaacttctcttgacccaaggaagctactattgtcctgggaacatttttctgtcctgtcacacttttaactgccatttttatttaatttgatgggttaggggacaaaaattagaacccaggacccacataaaataatctattagaagaccctctacaataaactagctctattttcaggctaaggatgaaacataaaaaattattcctcatagtcttttagcccaaatttgtgtcagccaagtaggccagggaatcctgaaccttgaattggtactaatattcttccagatggataggatatagcggtatctggaagagacatccataaatctctggaataagattacaatagcctaagctgcaaatcaaatttttctagtatgaaggccaactcatagtcaaagttaaccaaatacacaaaaccagcagaaacagaaaactgatacacaaagacccaagatattaaaattattagaatagcctctgaaatagctgtactttttttaaagaaattaaagatgagtttaaaaataattgctgggaacatgaaactgtaaaacatgcatatcagatttttttaaagtagaactttggaaactgagtaatacaataccaaaattaatagtagatagctttaacatgccttcagagaaaattagcaagttgggggagataggccagaaaaagtataccaaatgcaatagagacaggaaaaaaagaaaatatagaagagagcattaacacacacacacacacacacgctagtgtgaaagtctaagattaccagcagtggatttaaaactggctttgccactcactagctgtgtgaccttggacggattacttaatctctttctgtctcatttcctcatctgtaaaatggggttaacaatagaatataccttacaggactgttatgaagataagataaagcactttatgagtatttgttggataaataaaagtaaactaaatggaatttcaaagataattaaagaatggggtacaagtaacatttgaagcaataatggctaagaatttttatgaattatgaaagaaaccaattagaaatattctacagcctacccataccctaggtatttcagtagtttgtttttgtttttgttttgagacgtagtctcgctctgttgctcactctggagttcagtggcccgatcttggctcactgcagcctccgtctcctaaggtcaagtgatctctctgcctcagccccctgagtaactgggaccacaggcatgtgctaccatgcctggctaatttttatgtttgtgtgtattttttgtatttttagtagaggtggggtttcactgtgttggtcaggctggtcttaaattcttgacctcaagtgatccacccgccttggcctcgcagagtgctgggattacaggcatgagccaccatgctcggccgccttcagtttgttttctaataacacagttttatctcctaaccacctctttctcagaattacaggaaaaagatagaaaaacagggaggagaaaagataagcaacatagaggatcagcccatgaaatccaatagcctattaagaggaattccagaaacaacagagaagatggaggagggaaagtgttgtaaagctgagagagaaaaatgttcatgtcaaaagagtccacaaattacgaagtaggatgaatgaaaatggcccatataagattataatagctactaagaaggaaaagtgggtcactgcaatagaatgacaacactaacatcagaatttcattttcaaaatacttagatgttaaaagacagcaaaacaaagctttcagtattttgaggaaaattattttgaacccaagattctgtatctagccaaattcttaatcaaatgtgaaggtaaaatgttagtttctgaagtgtgaagatttagaaaaattatttttcataccctttcttggagatgtttgccagtacaatgaagatcaagatcaagaaagaagataggtagttcaagaaatggtgaaactaatctgtaaaccaatgtaaagaaaatctagaaagaaacagttaattgttgaactttaagaaaaatgtcttcaggtagacaagaatcctagacaattagataacatgagtaataaactggaaaagattatgtctgtgataaagaagacatatttgtatatctccccacaagaaaaaagaaggacaatggaattccaggaaaaaatagttctctgctggtggaatgtaagaaaggagaattcatctaacccagcaagagtctcctaggagtggcacagtggccataggaggaaactataactatgctgtactatgctaaaactataactgtacagaggaaatagagttttagtagcttttccgactcttcagtggttaatctttacattgtcataatgaaaactttttactgattttcaagttttagaatcaccatagcaaaatgcaacaattatgtctactgaactaaatgtaaatgttatcaatatttacaaatgctaaagtcaaggtttaatataagttgggaggtagaaggaaatcatagaaatagtagtgtccttataaacagattatacaagagaaactgttgggattgtgggaataaaaaaataagagatttaaatattatttaaagtgacaaaaaatactcaatagaagaaccgaagataaacacattactaccaaaatttccagacaaatagggaaagggaagggataacgataagtgagctattcatctgtcatcacaaagagtgtataatgtctaaactctgaattcagaaatactagtagataatgcctaaagctgataaattagtaaacacaagggtaagcacattatttagcaatatggaggtaaccactgaagaaactgaacaaagaggttgaattgatagttaaagaccagattgtttacaacattgtgctaagatattgcctgtctttggttactgcaactgtcaatcttagatttctatgggtaatctcgcccaatatgtttcactttctaaccatacagcacaatatttaaagcagccaaattctaatcttttttgccatgctatctaggtgaaaaaagaaacagacaaaattaaggaagatatccttaccgatgaagatgaaaaaacaaaaggactgtgggattccattaaaaggtaattactaatgaatattttaatacatcactagattgatccagaagtctagtatgtggaagttccacaggtagtgaaaatttaagtaaggcaaaggtcctctaatctaggagggataagataaatacataaatgttactactgtgtacaagataggaaactagagctataagacagatgaaaataaaatactatacaaaccaatggagaaaaattatatatccacttacaaggaaccttgggaaatactccttgaagaagtgtgtggcaaagatctgttttaaaggacagacaggatttcaaaagttaaagattgagtgaaggcaattacatgaagacaaaatgattgggtatgttcctcaaagaaaagaaagtagcctagctagctgcaacttgaaaataaaagggactgtttatgttagattgatacctatactgttttattgttagtttaaaaaggaacacaggccaggcatggtggctcacacctgtaatcctagcactttgagaggtgatggcaggaggattgcttgagcccaggagttcaaaactagcctgggcaacatagtgagaccctgtatctacaaaaaatttaaaaattagcctgttgtgatggcatgtatctgtagttccagttactcagaagactgaggtgggaggattgcttgagtctgggaggtcaaagctgcagtaagtcaagattgcaacgctgcactccagcctgggtgacagagtgagaccctgtctcgaaaaagaaacatacataaggaatatattgtctcagatatctaaagaatccaggagtacacctggtgttggccactgggtgatgtggtgtggaaacaatctttctccatctcttaggtctactgttttctgtgtctcctccattttaagatagacttttgtaagtaaaagtttactgtttccagtggaaggaagttgcctctttccaaacagtaccaataaaagttccaaggctgactcatgggtccaactatagctgtgtgtcccaaactgaactgatttctgtgactctgataacccagcatgagtcatatacctacttctagaactggtgggaagccctgtcccacctaaacctcatagaatgagatgggaggaggaatgattccccccaaaataccaggttgttactagaaggggaacagatgttaggtgagcaaaaacaaaagctgtctcctgtagatgcacattgtaaagaactttgaatgtccattttagagatttgaacccaatgtgagctatgatggaaaaccattaatcattttgatcaaagataagaaatagaaatgttagcccaaatagattcaacaacttaaatatatttggttatagtagtcaaaagcacttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaggatcaagtccactcattgagatgatttggagggtaggtatgtttgacaggggataatgaaatagaatctgagcaattttaagagtatcttactaaaagcttccattaaagttagaaggtatagataagaatgattaaggataactgttcaattatggtatagccacttgctatattaaaaggataccaaaaacaaaatgctttgttagaaacggagatggtaagtttttgggacgttaactgctccagatacgtagtgttgtgtgtcttatgatgctttgacttttttcatcttagttttagtcctaacttagaatgattattttttcttgccactgaatcaacttcttttcttatttgggagattacaagatttgaaaaatacttctgtcataacaatttatattttgcaaaataactttgatggtgatttaagttgtttacccaattttattcattctaaatatctgtttatataaaagtattttgaaataaatgtttaggaagaaaaagatgaatttatacattatgaatactgtaaatagaagattcagtcatttttatatatgaaatgggcctatacaaaaatgaaatggagttggtctagctccaaaaatgtaatgaaaatgacagctgggcccagatgacgctaccatgatgtaaaccagtaagtagacatggttccctagtgctttctttgtcatggaagtcatccagagtaccaagagcatactccataccctgcgtggtggagaaaatctgcttggtcagaggagctccaaattgtagatggtttaaaaatattttagcctggatgagccccatcagcagcactcacacacctaccctgttaccacataaattcttgctgtgccgtagttccacacttaagcattctgttccttccctcattgacctgtttaaactttcagtacactagatatggccatgtcaagctgtaattcattctttgttctgaaaacaacctttggcaactcacaaaaattcaaaaataccagcccattcacctaaagacaatatagttatattccacattacaaatttaaaaaaaaactcataaagcttcaaatgatattgtcaaatattttaatattagtttgtaaatattatagagtgtttatagcttaactattttgaaatacatttctatattgattgcttatatttactatttaggcatacaatgtttccatatgtatgtttaagaaatgtcaattacttttttattccaagtttcacagtaagcttgcataaagaaaacaaaaaggaaaaagatgtcctaaacattttttcagttgcttctggtcatttatatgaacgttttttaaggtaggtatattttttaaccttatattttgaaaaagaaatatttacatggttcaaatttcaaaaaaaaataaaggaatatacactgggaaaaaaaaaactcccacctctgtttccttgatactcagttccttttctcacaggaaacccataatattatttttatatcctgctaaggagatacatacacacacacacacgtaaatatatatgtgtatatttatttatttatttcagttgtttaagtccttttacccaaatagtaaagaacatactactttacaccttgctttttttttttacttaaaattatgaggtaagtatatataaatatgaaatttcatgagtttggcttgatttggaatattggttttcttcaaggctagcaaatagacattttggataggtaagaatatatatatatagatatactcacaatatatatatttacagtactttatatatacaatatttatatatatataatttactatagtaaattatccttttccagtgaagaaaaccttgttttataaaaaggaagggaatgaggggagaaatgcatattgcaaagtacaaaaggctatttttaaacagtttatatagaaaggtcacagagaataactcaaaaatatttgaattgtagcactgatacgttaaaatggaacttcagattcatttgtatcctttccatttggaggtttaggttagcaaaccaaatgacccatccagtgaatttgtcaatatagatagatcattcagctcttcagggtttgtagacttaatattaatcacacagtcatggacagctgggcccaggtgaagctaccatgatgtatatgtattcatccttacacattacatacttgataaaccatattttagtttatttcttcacatttcattgtgaaaaccttctaattcataccttcaattatttaaaagcctttaaaagacctatgtaacaaacctgtatgttctgcacatgtatcccagaacttaaagtaaaatttaagaaattaaaattaaattttaaaaaacacttcaaggttaaaaaatatatatgagctcctgttactgttaatgtatattgggtttaatattcttttatacagaattatgatgctttctgttttgcgtaacaccaaaacaccagtgaaattctggttgctaaaaaattatctctcaccgacatttaaagtaagtacatagctttttttgtagaatggttaatgtttgaatagtaaattatttgtatcattgtaagtttatatgatatttctcttttcagaataagctttttgaaaaaatggtatttagtatttttatgtagcttaagaaaaattctgtacaatttttatttagagatgttcaaaggagaggacagaagactgtatatttttaagtaaaatcaaaatcagaatggctagtagtttttcatgataatgagtaattaaatacaatttggcaatggaaaatatatacagattttcaattaaaagaaatggattctgtcatttttgcaaagataggcagaaacagtagtagtatcaagaaaatacaaagactatacctataccgtagaaaatagttttacagtactgaaacaaaaaagctctttcgtctgtgtagtgtattgattgctgggcaccatgatctgaggcattttatatttagaagatttcaggtgatcaacagctattaccctttactcagccctatactcctgctacaaagtatactctgtttcttcctattctccctacagcataatcaaattccgtgaaatttagtgtctccgcagcaatttggtgtctcattcaacagcatttcaaatgagtttgttttttctagaccaaaagcagtgggaaaacagaagtaaaactagccaagcatgcttttattccttaatatttctaggcatgatgccaagtgtttaactgacgttattcaattgtttttcataacaatcccacatgataagaaaaccaagattcaaaagttacgtaactagcttgcacagttgagaggtacctgagaccacttttagattcaataacttactataaggatttatataactccaaaaaacagctgtgctcacagttacagtttttatagcaaaaggacacaaataaaatcagcaaaaggaagagatgcttagggtagggtccggggagaccagacacaaagttaacagttgtcctctcccagtagaatcccgttacagtggatagcacttatttcttccagcaacagtgtgtgagggtactcgtggagtattgccaaccagggaagctcattcaaactttgtggtacagagtttttattgagggtcagctgtgtggacttggctaacggcctgcatgactaaccttaacctctaaccccttcagatgttgaactgatgctttgtggcccaaggtcctcactacaaataacatcattagcatacaatatctagtgtggtccgagatctgcaggtaaacgtagacattcttattagtcaggaaattccaagggtagaggatatttcctgggagatagggtgaagggccagggtaggggatatttcctgggagatagggtgaagggccatacttttctttgagcaagaatcatcctttatagcataggcctgatatgaaacagctaattagaaacacagctgagatttgaacccaggcattcagacctcaggtgcttaaccttatgtaacagcccatttgccctccaccaccaacagtgtctcctcctatgctcatttgacagtaggaaaaaaaaaaaaaacagaaaaagaacctataaatatagataagaagttatactatttttctactaattttttaacatgctttcctagtagtcagacactgaataagggagtatttaacccaaataaactgagatagaaaaatctaaagattctcttagcaggaaaagatattattcaccagaacaatagtgctatgtctggattagaaagtcttgttccactgcatggccaaaagaaatactgtatctgaagtagtattttccttctttttgtgatgtgtttctttcattcaaaatttttcttttgaaaacttcttagtgaaatataacatatactcagaaaagtgcacaaatcatgaaatttagctttggatttttacaaactcaaacatctgtgtaaatcagcagccagatacagaagccgctagctactttagatttgttcctaccagtttagaaaagtcaaacctcctctcttcattcaaatatttgctaaaattatacatacttacacataattattttctgacagcactatacaaactataattccctctcccttttaatttttcttcatagcacttttttctgtagataatagtttatttctacctacttcctctaaaatacaagcctcatgaaggtcataatttgtatttcttttgttcactaatgtacccttagatcctagaacagtgcccgtttcagtgaatatttggacacatatttaatgaagaaaaaatattctttttattttatctgaatgttttattttattttattttgaaaccaaaacaatgactcctggcagctgttgtacccctaatttcaagatttcacagataaaattggtgcttcttgcatttaaaaaaaagtattttaaatctacattgttcttacaaagtcagagaaaaaaattaaacatataaccagaaactagtttcaagtaagaatcaagtggtaaaacgcaaattctatatttattaattcatcttttccaattcctttttcattttctctctcagtatttgagctcttgaactaaatttagcccacagtatatttcattaactgcttctgctttaaacagggaataagctacttctaagcctataagatactcaaatatgaaatattcagaccataatcactactttgtatttttaatccttgaattaaataatgatatatctcaaacatgaagctcctgtatagaatctaatttatcagcttagaacttattttgtgttttttgtatcctctcttcatctttacatctctgaccaaccaacctgttgacatatacatgaactatttgatatgtaggtgttccaagatccagaggcttttttttaagtcagttttctcaagtcagatgttaacaataaaagtatgggaacatttatcttccattaataagtttgttaaataatatagtgcacttatttttaatgacgttaaattatatagttttatttatacttgtgatttcatatttgttagcattttaatatttctcattaataagtatgttatagaagtagtatttagacatcttgcctattagtttataacaatttataggaagctttacctttttaatgttatttttttctctaaaacaaaactactttctcttgaacatattgtttgattttgtgtgtgtgtttttaggaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccaggtaataaggttaactactatttttagtaatacgcaaacattttttacacttctatcttaatatagagattaattcatgttgctcatgtttattatcttcattacggtgcttaagatacgattgtgatatataagcaaagtatctttaaaaacaaaaagtcagaattccaggggaaaattgaaggtattgtaagaagtaccatttattatttaggacatggaagttttctctctaaagtagtagttttttacatttgagaactaaaacaaatacttatattagtcataataagagtagttaatgaattcctgtaaattatgtgctgatatttgtttaaaactaggaatttcttcttgctagaaaagctagcagttacatacaactctcattcttccaccttcaacagcattctttcgcattcaaccaataaccaaattctcatcactctatctcttaaggaaaagagcattttaaatttggccagcttatgcctgtagtctcagcacttttggaggctgaggtggggaggaaagtttgagcccaggagttagaagtcacagtgagatataatcatgccactgcactccagcctgagtgaaagagtgagaccctatctctaaaaataaaagcaaataaatttggccaaaaaaaaaaaaaaaacacccaaggccctctgctttcaaaatttatatgtccaaaaattatgacttttcctttttccctccttgcattgcttttgcatcattagtgggaaaaaaaaattgaaaatacacagaatttctaagaaaaaagtaatatgtaaatgaaaatataaattaaatggataagttagaatttatgtggaacaaaaagtatatttcaatttcttttaagagacagggtctcactctgtcatccaggctggagtgcagtggcacagtcatagcttactgtagcctcagactcctgcattcgagccatcctcccacctcagcatcctaggagctggaactccaggtgcacaccaccacgcctggctaatttttttttttttttttttttttttttttttacagacagggtctcactgtgttgcccaggctggtctcaaacttctggcctcaagcaatcctcccatctgagccccacacataatatctaatatgattctttctcctacctttctttcaatgggtgcactaatatttttctagaaggcttgagcatattaaaaaataacatttatattattttattcaagctatttagaataattgggagatttttctttatgattcaaacttaacatttgccaatatacaataatggagatttggcatggaatgattttgttattcatacattgagaaactaagagctctgcacttacgtaatatttaaccccttccccaaatgtctgattcgtaaaatgacttgtttataaatgacataacaaaatattcttgttggtgagtaagaccactgtcttaaagactaggaatataaattttagtttacctttaacctgtaaggacaagaggaataaatgttaaattcagtaaattcatattacatgaaagcactgtgaggacaatacagctctttggatttctgtagtagagtaataatgatttgagattcccataaaaaagggcttatgttattttacagtctttatcagacagtctattttaattatttagattgtgagacatgatctaaaagaacttcgagatttcgatctggatggagctccttatgggtataccccattttgtgatagccgcagggaaatggatggatatcgtttctggaaaacaggatactgggcatcacatcttttaagacggaaataccatatcaggtaagaaaagtcagacccttaccatttagtaaataagtaatgtattgaattgcaactttcagttttcttaaaaattacacagttttcttaaaaattacacaataaaagcaaccaattacatagtgttcatttcatgccagtcactcttgtaagcctttacgtatattaagtcataaaatctttatgacaatcttttgagatactgttattacctccattttgtagatgtggaaactgaggcatacagcattcatgtaatttgcccaggcttaccctgctagtatataacagagctaagagttaaacccaagtaatatggctcctaactactccagaagatttaaacttggtttgtgaaataaaattaagattatgtcttcaaagcctcatggccttttgtaaggccatgagtttcatgacaacttggaaaatcttggggtgaccctaaaagattatgggttctaccaaaattaaaacaaacttaaaactcttgggaaacagtattagatattaggagcaaatttatgaaaggattaattgttattagatcctaggatatctgtagttaataccgtcactgtagacactcactggaggaaagtaaaactaaaactacataaacaacataggctatcaagaagtaattcatttttgcagtgctttatatgtagtggatctcaagaagttcaggagaattggagcaggtgacaggctcaggagccagtatcaagctctcagtcaagatccaaacagtctttcaaacctagatcaggtaagtaaaatgttaacagaataattttgagtgtgtgtacatagactgttccaactccgtgctcataaactttaaagtcttatattttgagttttttctcaatttactgctgtttatgtaattatctattggatatttctacttatacataattttttcacctcaagctcaacattttcaaaactaatagtattttatcctcacttttccattctcaaacctctactttctactttatgccctgttttagttaccctttgtattagtccattctcactgctaataaagatatacccaagactgggtaatttataaaggaaagaggtttaattgactcacagttctgcatggctggggaggcctcaggaaacttacaatcatggcggaaggggaagcaaacacgtccatcttcacatggtggcaggagagagaatgagtgcccagtgaagggggaagcccctcttaaaaccatcagatctcatgagaacccactcactgtcaagagaacaggatgggggaaaccacccccatgagtcaattacctctacctggtccctcccacaacaggtggggattatgggaattaccatttatgatgagatttaggtggggacacagccaaaccatatcaccctcttttttcttactcttttccatcattgtgtaaacatgctcaagtctctctctctcatctttaagacaaactcccttcatccagtgcacccccaccctgatattgccttaatattttctttcacctcacaagcactattttcctaatatcctatcaatttcctcattattgcatctgaaacattttagataatttaagcagaaacaaaagactctgtattcttttagcagaagcaaaagactcttttttcttatttttatcacaaccatgcatgttcattcattcatctgttgaatacctgctatgtgccagatattctcctaagacttcagacatcagaaaacaaaaacaagatttctttagctcatattttcattctagtagaaaaattttaaaaataatatttaaagataaatgttttggagagaaaaaccatgaaagcatgatagagagttcagaatagtgaataggggctggggcttgcaggtataaattgggtggccatatgtccctatgaagatgacttttgagtaaattttagatggaggcctaaaagctgacacagatgcaggccaaagagagtatctgatgcaaatgtcccaaggtgggcatgggccttccatgtttgaggaatagcaagaaagtcagtatggttgggataaagatggggggaataaagtaaaaatgaaggaaaagagttaacagaggctccagataatgtagaaagcttagtccctttgtttaaaaatctagtaagtgggaaattatatgtcaaaatatgaatgagttattcaagaccacactggtaaggagttgatttttttaatcattcttgaaaattgggagatcttcaaatatatatgtgtttacagactaaatagggtctcttcactattgccagttagtagaaaactgacttagggtcctcagtaaccctcaataacatgccagatttcgattatgaatacatttttggtaattcttaataattttaccaatgtatttttaaggaattcttagtcttaaatatgaatgaaagtctatgaagttgcctgttatctgcctatggacaactgaagaaaggattcatttttcaagcagttcggaaactgtccgaggtgttctcccagtactacattaccacattttggggatgattgtccttactcaaatgtagtttggctcccactccctccaatccacttaacacttctcagtaaaatcaaaatatcttttttcttaggtaaaaatgtgtagtgagcacttcttgtttgtttttatgtgcctctttgcagcacggatgttttcaacctctcctttcttgacactctcttgactctctattggcttccatgtcagaccttgctggttcttctttgacatccctggctttcccaccacaattttgttggtgaactactttttctctacttttcctttaaatgttgctattctctacatctctgccttgacccacttctcactccataccatctctagcggcagtcttgcagccaatcatggttttaatttatatctttctgttaatagttcccaaatcttatctctgtctcttagctttcccttgaattcccaactcctatattaactctactggcattgccacattaatgaccaaaacttacctcaaattaaaaagtcaagaactcaagttctgttcctcttccaccattccctccatcagcaaataccacttagctgcctgttacaggttggattactcaggaagccacctaattctaacatggaaattaggaagtttattaggaagtactctcaggaccaacaactgtggaggaaggaaggaaatggaattggggaaactttacaaattcaattaagacctcagttgactgaccccacagggagctctgaagctgagatggtccttcatagttttcacaggtttgggcaagtctttattccttcatatcaaccagtcattggatatgggctgccccaggtaagggggtgaccttgggtgagacaactcttttcctggtctaatacaatgttatatagaatcctttgtcagtagataactataaatccttggataatggtgctaagtttctgtgagcaagaaaggcaaacccatacatagaatatgtgtataggtcagtccagaagaatctatataaaggacatctactgtagccaaattaccatcaaacagctgattggtctttgcaaagtataagtgctatattagaagctcagtgtttacctctgctgttggcagctctaagagctagatgagcctgggtaagtaggagctcatgctgttgggcccgtacacagtctccatctctgccagcatgtctactccattcatgtgcccattgtgtcattggagtagcctatgatcaaggctagcagacttccacaaaccacataattttgactgcctagttatttagtgctgattctgtgttgaatgctttctggtggctgtttaacatgaagtatccaaaggtcctaacagtttatgccactcccataggctcatccagaagcctctaccccagaatttcttgcccttaatcctcctatttttctatttcttggcctctgaccaattggtcaagccattcaccacttcttatgaatatactccaactatagactacttttctttctacattcatgtacttcattattcagtttgtacagaaagaaaggtagcctatggttggaatatattcataagcaactaaaatagttcttagaaataaatttatagcactaagaacttccattagaaaagaaaaaagatctcaacctcatcttctacctagaaactaggggaaaaaaacagttaaaaccaaagtaaggtcttggctaatgcaataagacaagaaaaggaaataaaaggtatacaaattgggaaggaagaaataaaactgcctttgtttgcaaatgcctacttagacaatccaaaaaaatgaccaaaaaaaaaacaaaaaacagtgtaccaataagggattatagcaaggtcaaaggttaatatataattaatatataaaagtataaattaatatataaaaaattaatatataaaagttagtcatttttactacctatcaggtactatgcttactacctgggtgacaaaataatttgcacactaaacccccatgacattcaatttacctatgtagcaaacttgtacatgtacccctgaaccaaaaataaaaatttaattaacctggagcaaaagactgaatccaaagtctgtgggcttagatcaggtgtctgaaataaagaataaatataataaaagaaagttatttataaaaaattaaatgctattttgcataagatacttttttttttttttttttgagacagagtctcactctgttgcccaggccggagtgcaatggcactatcttggctcactgcaagctccgcctcctgggttcacgccattctcctgcctcagcctcctgagtagctgggactacaggcgcttgccaccacgcccagctaattttttgtatttttgtattttagtagagactcggtttcaccatgttagccaggatggtcttgatctcctgaactcgtgatctgcctgccttggcctcccaaagtgctgggattacaggcgtgaaccactgtgcctggccataagataaattttttttaagtatattaaaattattcccttatgtttataatatacatttttagggttgtattttctttttaataatatcatttgtgtagggatctttgcacattgcctgatgtagatttaagaatataatctatatgacaaagaaaaagtcatttttctgtattccaacaataaacaagtggaatttaaaattaaaaacacagtatcatttaaattagcaccaaaataatatttaagtataaatctagtaaatgtttctctacatgaggaaaactgtaaaattctaatgaaagaaattcaagaacactgaaatacatgaagaggtattccctgtttatggataggaagactaaattgctcaagactaaattgatgaattcttcccagatcaatttatagattccacacaattccaatcaaagtcctagcaagttgttttatgattgtcaacctactgattttaaagtttatatagaaaaggaaaagacctagaataaccaacaccatattgaaaaagaagaaagtcagaagactagcaataccagacttatttcactgtaaagctatagtaatcaagacagtatgttggcaaaagaatagaaaaatagatcaatggaacaatagagagcccagaaataaatccacataaatatagtcacccaatctttgacagaggaacaaagatagagcagagatagtattttcaacaaatgtcactggaacaactgaacatctcataagaaaaaaatgaatctagacacagatcttacacccttcagaaaaattagaatggtttatagacttgaatgtaaaacacaaaatgcaaaactcctggaagacaatataggagaaaacctagatggccttgggtatgtcaatgactttttagatataacaccaaagtcatgatccgtgaagtaataattgataagctggacttcactgaaattaaaaacttctgctctgcaaaagacaataacaagagaaagaaaagtttttttggcaaaaatatatttgtaaaagatgcatctgataaaggagtgttatccaaaaaaatgcaaagaactctaaagactcaacaatcagaaaacaaaccaaatttagaaatggatcaaagaccttaacagacacctcaccaaagaacatatacagatgacatataagcatatgagcagatgctccacatcatatatcatcagggatacacaaattaaacaacagtaagataacaccacacacctattaggaaggccaaaatccagaatactgacaacaccaaaggctagtgaagatgtggagcaagaggaacttgcgttcattgctgagaagagtacaaaatggtatagtcactttggaagacaatttgacagtttcttacaaaactaaacaaactcttaccatacaatttagccattgtaatttttggaatttactcaaaggagttgaaaacttatggctacataaaaacctgcacatagatatttataacacctttatttataattgccagaatatgcagccaaccaagatgtcttttagtaggtgaatcagtaaagaaacgggtacatccagaccatggaatattattaagagttaaaaagaaatgagctattaagccatgaaaagacaaggaagaactttaaatgtataataactaagtgaaagaagccaatctgaaaagattacatactgtattattctaactatatgacattctggaaaaaagcaaaactatggagacagtataaagataagtggttgtcagagtttggtggcagggagggggcaagtgatgaatatggtggagcacagagaatttttaggcagggaaaatatgtagtggtagatacatgtcattatacagttgtccaaacccgtagaatgtacaacaccaagaaagaagtctaatgtaaactgtagactttgaatgagtataatgcatgaatgtaggttcatgtattgcaacaaacatatcactttggtggggggtgttgataataggggagtaggtaatgcatgtgtaggaacagtgagtatatgggaaatctctgtgccttcctcttaatttggctgtgaacctaaaaactgctctaaaaaaataaaatttttaatttagaaaaaattaaatagaaaaaaggaataattaaggttagaatggcaatcagtaaaataaaaaaaaaaagaaaagaaaagaaaagaaagatgcatttttgtagatttttaaaaatgaaaccaaagctggttctttgagaaaatcaacaaaaccgatgaacctctatctagactgatcagaaaaaaaaaggtaaaagacacaaattaccaatatagaaatgtgagacatgacagcacacagattctacagatactgaaagaataatcaagggactattagaatcaactttctggtaataccttcaacaactttgatgaaatggccaaattacttaaaagacacaaaccaccaaaagtcagaacgtgaaataggtaacctgaataacactgtatcagttgaagaaatggaatttgtagtttaaatccccaggcccagatagcttcagtagtgaattctatcaaactttaaagaaagaaataataccagttttacacaaactcttccagaaaattgaagagaagggaatatttttcaactcattctatgaggcagcattcccttgacatgaagaccaaagatattataagaaaggaaaattatagacaagcatttcttaagaaaagttgtaaaaattgttaacaaagttttaagtaatcaaatttagtaatatataaaaaggacctctccctcctccccccctcccctcctcccctctgcacggtctccctctgatgcccagccgaggctggactgtactgccgccatcttggctcactgcaacttccctgcgtgattctcctgcctcagcctgccgagtgcctgggattgcaggcgcgcgctgccacgcctgactggttttcatatttttttggtggagacggggtttcgccgtgtcggccaggctggtctccagctcctaaccgtgagtgatctgccagccttggcctcccgaggtgccgggattgcacacggagtctcgttcactcagtgctcaatgttgcccaggctggagtgcagtggcgtgatctcggctccctacaacctccacctcccagccgcctgccttgccctcccaaagtgccgagattgcagcctctgcctggccgccaccccgtctaggaagtgaggagcgtctctgcctggccgcccatcatctgggatgtgaggagcccctctgcccggctgcccagtctgggaagtgaggagtccctctccccggccctcatcccgtctaggaagtgaggagcgtctctgcccggccgcccatcatctgggatgtggggagcgcctctgccccgccaccccgccaccccgtctgagatgtgaagagcgcctctgcccggccgcgaccccgtctgggaactgaggagtgtctctgccccgccgccaccctgtctgggaagtgaggagcgtctctgaccagccgccaccctgtctgggaggtgtacccaacagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctttgtccactaagggttaaatggattaagggcggtgcaagatgtgctttgttaaacagatgcttgaaggcagcatactcattaagagtcatcaccactccctaatctcaagtacccagggacacaaacactgcggaaggcggcagggccctctgcctaggaaaaccagagacctttgttcacaagtttatctgctgaccttccctccactattgtcctatgaccccgccaaatcccgctctccgagaaacacccaagaatgatcaataaatactaaaaaaatttaaaagaaaggatcttatatcatgaatcgtgaccacatgaactttatcccaggaatgcaagactgattcagtattagaaaatcaatgtaactcactatattaaggactaaaatacatatccatatatatacatgatcagctaattatatgcaaaagagcatttgatatactccagtatcctttcctgatttaaaactctcagcacactagaaccggaagggaacttcctcatcctgataaagggcatctatgaaaaacctacagctaacatcatacttaataatcaaagactgaatgctttctccctaagatcagaaacacagcaaggatatccactcttacctttcctattcagtattgtactagacagatacctagtacagcaaggcaagaaaaaaaataaaaggcatccagattggcaaggaataagtaaaactggctgtcttggacgggtaagggggacagtcaatgtgatcatctaggtagaaaacctcatgtaatctaccaaaaagctagaactaataactgcatttcacaaagttgcaagatacaaaatcactatgaaaatccaattctatatactagcaataacaattgaaaattgaaattatccatttctgtagcattttaaaaatgaaaaacttagtggtcagacttaagacttacagattgaaaactacaaaactgctgagagattaaaaatcagctgaatatttagagagatataccttgttcatggttggaagactggatattgttaagatgtggtttctccccaaattaatcactagatttaatgcaattccaataaaaacattactctctattttttctatatttattagactttcttgtacaaattaatgaagttgattctaaaattcaaatggaatgccgtagacctaaaatcgccaaaacaggccaggcgtggtggctcacgcctgtaatcccagcactttgggaggccgaggcaggtggatcacttgaggtcaggagttgaagaccagcctggccaacatggtgaaactctgtttctactaaaagtataaaaaattagctgggcatggtggcgggcacctgtaattccagccacttgggaggctgaggcaggagaatcacttgaacccaggaggtggaggttgcagtgagccgagatcatgccattgcactccagcctgggcgacaagaacaaaactctgtctcaaaaaaataaataattaaaaataaataaaaaataaaatcaccaaaacaactttgaaaaataagaaagttaaaggacttataccaccttgttttaagacataatatatagctactgtagtcaaaatagtttggtgttggtgtaaagatagacaatttgatccatgaattagaataaagaacccagaaatagaccccatatatggccggttgacttttgacaaaggtgcaaagataatgcagtggagaaaggatagtcttttcaacaaacagtgctggaacaattagatatccttatgccaaaaaaaaaccccaaaaacctctaaaccctaatatgccgtaagtaaaaattaattccaaacacatcatagacaaaggtacaatataaaatgtttagaagataggagaaaatctctgtgatcttgagttaagcagagattttttaggtatgatactaaaagcatgattcataaaagaaaaaattgataaatatacaaagagctcccaaaacttattaataataaaataagtaatctgatttgttaaagaatcagattgacccatcaccaaagatgatcaagtgtcaataattccatgaaaagatgctaaacatcattagtgattagggaaatgcaaattaaaactatggtgaatacacaccaattagaatggttaacattaaaaagactgaccataccaagtgttgaaaggatatatacctgctagaattcgcatacattgcttgtgaaaatgagtgtaaaatggctaagcccttttgaaaatcagtttggcgatttcttttacagtttaacttaaacctgccatatgattagtcattatacttcagggtgtttacccaagagaaataaaagtacctggccacacaaatgcttgtacataaatactcatagtagcattattcataaaagccaaaatctagaaacaacccccctgtatttgttacctgttgctgcataacagcttatccaaaacatagcagcttaaaacaacaaacagtttgtgtggatcagttcctgtagtctgacctagctcagtgttctgcttcattgtatctctcaagactgcaatcattgtgtcagcccggggactgccgtctaatcaaaagacttgactgctaggcaaagtcactcacatggttgtggacagggtttattcttcaagagctattatacggaaagtctaatttccttgctggatgtggctataggcagtcatcagtttctggcagatggccttatccataagggcaaacatgagagagaagaatcagagaaagagaggatgccaacaaaatgaaagtcacagtctgttatagtctagtctcagaattgacatcccattagttttgccatattctgtttgttagaaggtagtcactagatccagccagaccaggagaaggaattgcacgagagaatggataccagaagtcaggaattattggaagccatatcagaaactgcctactgcaaatatctgtcaagaggagaatagataaaaagatatggtatattcatagaatgtaatactactcaatagtaaaaaggaatgaattatttatacacagacaacatggatgactctaaaaataacaatgctgatccataccaaaagtatatagatttatatataatttatatgaaaagtcagacctaaagtatttgtattatataatcctatttatataaaattgtagaaaatgcaaactaatccaaggtgaaaaaagcagttcatgcttacctggggactggattgggtgcatagaggaaggataggagggaacaattgcaaaaggacacagggagtcttaagggtgatagctatattcaattatgttaattatgtgatggtttcacagaaatatacatatgtaaaattctttatgcccagtagtggtactggcataaggttacacatattggtcactagaatagaattgagagttcagaaataagcctatgcctctactctcatttgatttttgtcaagcattccaagacaacttaatggggaaagaatagtctttttaacaactatgctagacaacaggaaattcacttgtaaagaatgaagttggacccctacctcacatcatatataaaaattaactcaaaatggatcaaagatttaaatgtaagaactaaaaccgtaaaactcttagaaatgaacataggtgtaaatctttgtgactttggattaggcaatgtttttaagttataaaaccaaaagcacaagcaataaaagaaaaagataaattagcatcaaaatttaaagacttgtatgctttaaaggacacaagaaagggaaaagacaacttttagaatgggacaaaatatttgcaaatcatgtgtctgacaagatactaaaatccagaacatataaagaactcctgtaggatgtgagggcaatctggctgctacatctgtcaccccattgatcaccagggttgattcagctgatctggctggctacgcaactgacctcttcctccctcactgctccatgtgtgttcctcccgaaactgcatgctgggttgaagaagatgaccatccccaatagaggaggaccaatcttcagtcaagggtacactagtagctgcgcttccctgccagaacctccaaacaagctctcaagaactcccataactcaatagcaaaggaaaataaccaatttacaaagtggtcaagggatgtaaatagacatttaagcatgtttatttttatttttattttccgtgttttttattttactctaagtcctgggatacacgtggtgaacgtgcaggtttgttacgtaggtatacatgtgccatggtggtttgctgcacctatcaacctgtcatctaggttttaagccccacatgcattaggtatttgtcctaatgctctccctccccttcccccagccctccaataggccccagtgggtgatgttcccctccctgtgtccatgtgttctcattgttcaactcccacttatgagtgagaacatgtggtatttggttttctgtacctgtgttaatttgttgaggatgatggtttccagcttcatccatatcctgcaaaggacatgaactcattcttttttatagctgcatagtattccatggtatatgtctgccacattttctttatccagtctgtcactgatgggcatttgggttggttccaagtctttgctattgtaaatagtgctgcggtaaacatacatgtgcgtgtgtctttatagtagaatgatttatcatcctttgggtatatacccagtagtgggattgctgggtcaaatggtgtttctggtcgtagatccttgaggaattgccacactgtctttcacaacagctgaactaatgtacactcccaccagcagtgtaaaagtgttcctattactccacatccttgccagcatctgttatttccagatgttttcatgatcaccattctaactggcatgagatggtatcaaaaccactcattgtggttttgatttgcatttctctaataatcagtgatgatgaactttatttcgtatgtttgttggtcgcataagtgtcttcttttgagaagcgtctgttcatattcttcgcccactttttgatggggttgttttttttcttgtaaatttgtttaagttccttgtagattctggatattagccctttgtcagatggatagattgcaaaaattttctcccattctgtaggttgcctgttcactctgatgatagtttattttgttgtgcagaagctctttagtttaaatagatcccatttgtcaattttggcttttgtttctgttgcttttggtattttagtcatgaagtctttgcccatgcctgtgtcctgaatggtattgcctaggttttcttctagggtttttatggttttacattgtacatttaagtctttaagcagagatttaaatgtgtttatttggagattttaatatgtttatttaaatagacatttaaatacgaaatatgtctatgtaaatagacattgtatgtgtttactagccattgatatatcttctgtgatacacaaatgtccaataaacacatgaaaagatgctcaatgccattgtcattaggaatagcaaatcaaaaccacaatgagataccacttcatactcgctatgatagctacaataaaaaagattgacaataacaagagtggacaaggatatggagaaaatggaaccatgatacgctcctatttggaatgtagaatagtgtaccaagttcaaaaacagtttgacaggtcatgaaaatgtttaacagagttaacatatgacccagcagttccactcctagatatatacccaagagagttgaaaacatgtgtccaaacaaaaatttgtacaaatgtttatagaagcattgtttataacagctggaaaatggaaacaacccaaatgcccatcagttgacaaatgaataagccaaatgttgtaaattcatatagtggaatattatttggctgtaaaaaggattgaagtactgaaatatgtcacagcatagatggaccttgacaacattgtgctgacagaagccagacacaaaaacctgataatgtataattttacttatgtgatatgtccagactaaacaaattcgtagagacagaaagtagattattaggtacatggaggttagggaaggatatgaggacagtgtgtgaaataatcagctaaagatcagctaagtgacaacagagtagacccatatatataattgacagaattaaagttcccctaagatttatattcaggaggttaaaatgaaaaaacagtcggcatggggggtagtgtgtgtgtgtgtcctgtactcatggaactcagccatgttgagttccatgagaacagttacagagattgagatttaatcaggactatgactttgtcaagaaagtacaactaagtgagagaagaataagacagttgagagtatattcagaagaataactatataggggtgaatacatcaaggaatgagggacagtgaaatagtggtaaaatcagttgattggaggttccaaggggtcaaaggatattgatatctgagtactcagtggagtgagccaaaaatcaagaggtggtcagagagtggcaccatgaaattgaaagtatagaagacttggtctagtatataaccatttgagttagtagcttagataatatggtaggccaggttatttaaggaagggattccaaggaactaagggtgtcagaagggacagttaaggtttttctttctttgattaacggactttatttttttagagcagtcttaggtttacaaaaaaaatgagcagaaagtatgggtaattttctatttctgggctctttattgtgttccattgatgtatttgtctcttatttttccaataccacactgttttgattactgtaactttatagtaagacttcaagtgtggtagtgtcagccctctgactttattcttcaatattgtgttggatattctggatcttttcctttttccctaaactttagaatcagttggccaatctccacaaaataacttgctaagcctttgattgggattgtgttaagtctatagataaatctgggaagaactgttatcttgactatggagtcttcctatgtgtgaacatagaatatctcttcatgtatttcagtgttctttgatttctttcctcagaattttgtagttttcattttgttgaggaacatattttattagatttatgtttaagtatttctctttttcggtgctaatgtaaatggtgtgttttcttaaatttcaaattatgtttgttcattgctggtatatagaaaagcagttgacttttgtatattaactttttatcttgtaacattgctaaaattgcttatcagttccagaagttttttcccttgattcttgggattttctgcataaacaatcctgttatcacaaacagtgacaggtttttttcccttcccaatctatatacattttccttttcttgtcttattgcatttgctaggactttcagtgtgatgtttaatagggatgttgagagaagaaccttaaaattgtgaatcttggagcttatgtaggacaaccagcacaagtacccttcatactcttggagagagaggaacatgcctttgctcttgaatataagcagatcttctatagggaaaggaagggaaggactccacccctggaatataaacaaatatctctggggaagatttgtctgattctctccaaaggtctctaacttactaggctagtttgccagtcaaacatccattaacccagatgccagcaatctttacttagagagctctgagcatgcagaaatgggaaaatattcatggatcattgtttccaatggggagatgaaaattcacctcagaatccagagagcattgtggtgaccaatatgaacagtaattgcaggcataatgtgagcaatagaggcagatagaggtagtgaggctgtccattgtggggactattgaatggtaggtttctatgcctccttcttcatccttgttcccaggggtagagtctaggagagatgtaggtatattccagtgcatggattcattcatgacacaagatgattggatcaccttaggtattttaagctttaaagtgtagagaaatctcagatttgcatatgttttatgatctgtttacagtctaactgatgtcttacttcattcagcttctttccttctgactctaaatttcatacgtctatgattaaatcacaattttctgtaggatctccccaataatatgatttaccaagtcgccattaagtctcttcctcaagactggctgtggtgtgaaacctggtgtgatgatgaatccaaacaaagagccaaaacaattgatctggtgagtgtctttgttttcatttgtatgtaagcagatacagaaatgtttaaatagaaatattttctttctgttttacaaagggagtggcatacgtattacttcgcttcttctgctgttcagtctattacacatttacttaggttggcaagtatagggttattttgggggcccccaagaccaccctgaggtttgatgattcactaaggagattcatgagatgcaaaatataatcatattcatggctatgatttatcacagtgaaaggatataaagcaaagtcagcaaagggaaaaggcacatggggcaaagagaaaatcaggtgcaagattccaagagtcctttctctgtgatatcacacgggacaagcttcattcctcaagcaataagagattccacaaccagtgtgaagtattacctactaaggacatttattagaaaccccagtgtccaggggttttactgggggctggtgaccatatagcactgtctgcctgagacacacctaaatttccagcactcaggaggaaagcaagtgtttagcataaacacctttgcacagataatttagacacagtgagttactcttataaaggaatggtgagaaccatcctgaaccctgtgttcccagatgccagcgaggagccaaacttacaagcaggtctttctaagaatagcaatttcaggctttctgtattaactcttttctgcaaaaggacttttgaaaaaaaggcttagagggctgggcacggtggcttacgcctgtaatccctgcactttaagaggccgaggcaggtggatcacctcaggtcaggacttcgagaccagcgttgctaacatgatgaaaccccatctctactaaaattacaaaaaattagctgggcgtggtggcacatgcctgtagtcccagctactcaggaggctgaggcaggagaattgcttgaacctgggaggcagaggttgcagagagcggagatggcgccactacactccagcctggagacaagagcaaaactccatttcaaaaaaacaaacaaacaaaaaaaaagggctgagagctagctgaaaatgtttgtggattagctatcatcttgacatgtcttcagtttagttatcctgccaatattttcccccaaataaaggcaaacaagacaattttgtctacttaaaatatatcatacatgcttttttcttacttatttttaagagattatttttcctagattttcatttaaagcagtttatgctgtgcagtttaactctcctaaacataaaatatttcaaagtaatttatttgttgtccatttagattttatattccactactaccttgtctttagtaggtataataagtttttttcctagtatattgtttttaatgtgctaagtgtagaaaattgtttacaagatcttcactgacgaataagctattaaaatgttagaattcacacaattttgaacaaaaaagagcaggaaaacaaaatataggaactttttcagacatgtatagaaatacatattttaaaaatagcatgccagcatgttagaatgtaatcatagttggtagaatatagcagaaacaaataaaaaggcatttttaagaggtaagcaagggaatttcataaagagaggccaagaacattattgaacacaactactaatatgttgttagggttctgttgtggctcatacagtagtggtgtaggtcattttgggatctttagtacttagactaacatgagctaccataacaaacccccaaaattcagtggcttcatactcattccagcagcagacctaagtggatatctccgtcattgagtagccctcctgtgtgccatgtctcagggagtactttttgtccacctgtaactgcttcttccagtgcagtagccacttgccttatgtggctgttgagcccttaacatgttgctattctgaattgagatgtgctgtaaggtataaagtacacaccagattttgaatactcaatacaatgaaaataacatatatctcattactaatttttgtattgattacatgttgacttagtattttggatatattgggttgaataaaatatagtattaaaatttatttcacctattcctcttacatttttatacatggctactagaaaaatttagtatttttctagtgaaaaaacccacaaattatgtgtatggttttcattgcatttgtattggatagtaccaatctggagggaaggggaaaaaaagtgtggagaacatatatcttgaatcctaaaggcatggccccttggtgggagttggtcacgtggccatatctagatgtaacaggagctgagaaatggcattcctggatggacagctacttcctagcaatagcaataccaatacccaggaaaaggagaagtggcacaaattttggtgttcagcccgtctccctcatagaaacactaagagtagaatgagagaacatgctattcttcatggaggagaaaagagaatgcagaaaattcccaaggaaatggcctaacagaagaaaagagcatgactaataatattgaaggtgggaatgaaaatgtttatgaatgtcattatactctctcaactttccatctcagagtttttcagcctcagtactattggcattgaggagtggagaattctttgttacaggggttttcctgtgcattgttgggtattcagcagcatttctggcctctgtccactagatggcagtagcaccccaccactccccggccatcacacattttctccagactttgccaaagctccccgaggggcatgattacccagttaagaaacactaataaagcttatagagtgtatgcatgagcacacacatacacacacacacacacaaacccaatgtagtacaaatagctaaacaaaacataatatttttatttttttaatagtatgacagaattaaaaaaagaattagtcccattatcttcactatatagaagacattgcctataaagttaatttctgcaaggaaaattgtgttgtccacttacctcaggaatatgtcactatggaaaagaaatccataatgaatcaactgaaaatatttggtgaggaaagggttaagacaacaggctcacggctcatgactaatagctttcccctaagaaataagaggaaagcaagtggagaaaatgtcaccagaagtgagcttcaagttgcttcctgccttaattctttgtaaatagtgaatgggcttcctttattacttgatgaagtttatactgctcccattgtcttctgtctcagtaaatggcaaatccattttttatattgctcaagccaaaggtactggtggctttgtctttctttgatgcctctctttacttacagctcacgtccaatatatcagcagatcctttcagctgtaccttcagatacatagtgtgtcagactcttatcaaccttctataatttttgcttttaactttaatttcccaagaaactctatagtagtactcaatagtttaaactgattgtgtattgatggaaccttagagattttcctattttaatttcttttgcagttgaataaattaagctacacaccctacacacacacataattatgtgatacatacacatcctactactagtaaatatggagttggaaccctgagaaccgagatgccatttccatgtttttctactgtgcctacaaagcacactagtctgctatgttcttctacatagtggtaatgtaattagatcttttgtcaaaaagttttacataatttttttttgacagacttatgagtcatcagaatgtctttcaacaatttttatttaaatttctgattgaggtatttgtattaagcaattattacatacataagttgtgatatatcatttcacctgatcctgtgtgtattaaacttccagtacttagcaggactctgctttttataaaatgtattttgtttgccctagtgacacagcattgtccttatgtttccaggagcatggtctttcattaacaaaatttacttaaacttttagtgcaataatcccaaaacaaaagaatccaaactaaaagctgctgccagaattgtcccagaatgggtggagtatgatgctgagataagacaactattagatcatcttgaaaacaagaagcaagatacaagtaagtcatcaacgtgttgtgatgtctgaaacatgcgttgcattaatgagattagaatagactacagactcatttcttagtgaatttataaaatgattaagaatttctttaagaaagtctgtggcataatttaaaggtgtatttttgtgtagactaagcttacaagtttaaaacatagataatctgtttccccatggatacagcttcagctcataactctatatggatagatagtgtaacattagtctcctgacacaacatagaggtgaaaaataaaagtaaaaggagtgtttgtctttaagattgcactgaatttcctaaatgtgaaaatttgagcaagtcctaaaaattaataaaagctttacatagctaactaaaaatatcatttcctatctccaaaattaatctcatatataacagaggtttccctacatgtttgtggttctagtatgtttaatcatgggctggagaatgacttggattagatttgcttcaattccttttatgaaaaaaactgtggctaccttggcatttcattgccctacataagtgttcaacaaatgtgctgaatttattttttaaagctgatacaaacttcttgattgtcctgtaattctctttccctgtcagtgctgcctgtgtctccctattcttcactctttcttaaaaaaccccctgaactcctattgtgttcgggtcagtgtgttagagactttcactagattatattggctaatactctcaataattcttcccagtggttcagaatacagttctcattttcctcagctttactgtttagggaagccgaaatgattatgtataaactgtctcatataaacgtgaaattgtttcatcttgactttaaaaaaaaaaaaaagttttcctttaaaaaaaaaagttttcttggtgtgttcaaaaagttcattatacacacccatgtatgtataataatttagtatagataaagatactatttcaattcataagaaaatattctgtaagtggtatgatatgactttttttaaagggagagaagtaggatgacaaagggaggagggagagaaggaaagaaagcaggaagaaggaagaaaggaaaattacctcaacaaaaaacatctttttcttatatataagtatttcttttatcaaattgggaaagaggtaacagttaataataatgagcattggtgagaatgttggaaagttagcatttttatacaagtaaacgtatagtagctgtataagttaaggaaattttatatgtataaaaacttaaaatttgtataccctttcacccagcaattcacttcaacaaacttaaaaaaagaaaaatgatgtctatattggtgtttattatagcattatttttaacaatgaaatagaaataatctgtccatcaatagacaattggttacataaacattgatacaaacaatgaaatacagtgtagcctttcaagacaaacaaggtaaatgtatttgtgctggcagcatattttaagttaaaaaataggttatagagcaatatttataattgatctcgtttccattaaagaaaaatcataggtctgtatgtatgtgtttgtgtatagatatgtatataagtaagggagagaagttttacaaaagagatttttttttattattattatactttaagttctagggtatatgtgcacaatgtgcaggtttgttacatatgtatacatgtgccatgttggtgtgctgcacccactaactcgtcatttacattggatatgtcacctaatgctatcccaccccctacccccaccccacaacaagccccagtgtatggtgttccccaccctgtgtccaggtgttctcattgttcatttcccacctatgagtgaggacaggcggtgtttggttttctgtccttgtgatagtttgatgagaatgatggtttccagcttcatccatgtccctacaaaggacatgaactcatccttttttaaggctgcatagtattccgtggtgtatatgtgccacattttcttaatccagtctatcatttttggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttttagatccttgaggaatcgccacactgacttccacaatggttgaactagtttacagccttaccatactgtaaaagtgttcctatttctccacatcctctccagcatctgttgtttcctgactttttaatgattgccattctaactggtgtgagacagtatctcattgtggttttgatttgcatttctctaatgaccagtgatgatgagcatcttttcatgtgtctgttggctgcataaatatctttttttgtgaagtgtcttcatatccttcacccactttttgatggggttgtttgattttttcttgtaaatttgtttaagttcattgtagattctggatattagccctttgtcagatgggtagattgcaaaaattttctcccattctgtaggttgcctgctcactctgacgatagtttcttttgctgtgcagaagcgctttagtttagttagttcccatttctcaattcttgcttttgttgccattgcttttggtgttttagtcatgaagtccttgcccatgcctgtgtcctcaatggtattgcctaggttttcttctacagtttttatggttttaggtctaacatttaagtctttaatccatcttgaattaatttttctataagatgtaaggaagggatccagtttcagctttctacatatgactagccagttttcccagcaccatttattaaataaggaatcctttccccatttcttgtttttgtcaggtttgtcaaagatcagatggttgtagatgtgtggtattatttctgagggctctgttctgttccattggtctatacctctgttttggtaccagtaccatgctgttttggttactgtagccttgtagtgtagtttaaagtcaggtagcatgatgcctccagctttgttcatttggcttaggattgtcttggcaatgcaggctgttttttggttccatatgaactttaaagtagttttttccactgaatctatgaattaccttgggcagtgtggccattttcacaatactgattcttcctgtccatgagcatggaatgttcttccatttgtttgtgtcctcttttattcctttgagcagtggtttgtagttctctttgaagaggtccttcacatcctttgtaagttggattcctaggtactttattctctttgtagcaattctgaatgggagttcactcatgatttggctctctctttgtctgttaatggtgtataggaatgcttgtgatttctgcacattgattttgtatccagagactttgctgaagttgcttatcagcttaaggagatttggggttgagacgatggggttttctaaatatacaatcatgtcatctgcaaacagggacaatttgacttcctcttttcctaattgaataccctttatttctttctcctgcctgattgccctggccagaacttccaacactatgttgaataggagtggcgagagagggcatccctgtcttgtgccagttttcaaagggaatgcttccagtttttgcccattcagtatgatactggctgtgggtttgtcataaatcgctcttattattttgagatacgtcccatcaatacctaatttattgagagtttttagcatgaagggctgttgaattttgtcaaagaccttttcggcatctgttgacataatcatgtggtttttgtctttggttctgtttatatgctggattacgtttattgatttgtgtatgttgaaccagccttgcattccagggatgaaacccacttgatcatggtggataagctttttgatgtgcttctgggtttggtttgccagtattttattgaagatttttgcattgatgttcatcagggatattggtctaaaattatcttttgttgttgtgactctcccagtctttggtatcaggatgatgctgtcctcataaattgagttagggaggattccctctttttctattaattggaatagtttcagaaggaatggaaccagcttctctttgtacctctggtagaattcgactgtgaatccgtctggtcctggagttttttttggttggtaggctcttaattattgcctcaatttcagagtctgttcttggtctattgagggattcaacttcttcctggtttagtcttgggagggtgcatgtatccaggaatttatccatttcttctagattttctagtttatttgcgtagagttgtctataatactctctgatggtagtttgtatttctgtgggatcagtggtgatatcccctttatcattttttattgcatctatttgattcttctctcctttcttcattagccttgctagcggtctgtcaattttgttgatcttttcaaaaaaccagctcctgaattcattgattttttgaagggttttttgtgtctctgtctccttcagttgtgctctgatcttagttatttcttgtcttttgctagcttttgggtgcgtttgctcttgcttagcttgttcttttcattgtgatgttagggtatcaattttagatctttcctgctttctcttgtgggcatttagtgctataaatttccctctacacactgctttaagtgtgtcccagagattctgatatgtccaggttgcagcagagagagaggtttaatcatagggctgccaaatgaggaaacagaatgaaaactcaagtctgtgtccctgagcagtttgtgactagtgatttttaagggttttggagggagccagagtatggagagcattgattggtcgaagagtgcaaggtgaagtcgtggtatagggagatgaagaaactatattctcatgctgaattggttactttgtggggatcttcaaactggttggtgtcagctgttctgctggaactcacgatctgcttaggcaattcttaaaagccttatgattctgatgtcagaaatcccatccacaagaacaatggggatgcaaatggtcagtatctagtgctaagtaactttcagttacaaggaagtgggtcaaagtgctgcctgactaatagttaaccatacttctgtccagaattcttgtttaactctataaggatggcttgagatatagtatatcttttataatttacatttctctttttcattatattagtttgctagggctgctataacacagttccacaaactggctggcttaaactggacatttattgtctcacagttctggaagctgaaagtccaagatgaaggtgtccacagggttgataccttctgagggctgcgaggaaagaatttaacacagacgtctctccttggtttgtaaatggctttcttttccttatgtgtcttcacattgtcttcacattctctgtccttgttcagttaggacacctgtcatattggattagggtctacgcttatgaccttattttaacttgatttcctctgtaaagatcctgcctccaaataaggatacatttggagataccagaagttagaattcttgtaaattttgtggggaccaaaattcatgtatttttgaaatatgaattaaacccataacatgggtggagttaagaatcttgtcatatatttaaaggccattagtatttcttccgctgttcttgtcatttgcctgtttttttctagaggattgttgcctgacactggaagaaattaatttctgttccacacatttgtattgccatctttatcatatattaaattccaatattaggatgtcttgtttggccctttttattccgttccattggtctctgtctatacatgtgccaagtacataccactttaattattaaggacttatattatgttttaatatcaagtaaggctagcctttccttattactcttcttttttgttgtttttctgtgtattcttgttttttttccatacaagccttagaatcaacttagtttcagaaaattttctgtgtttttcttggggggctgtgtgggatggtcagagaaaggattacattaattagttggcttgagagaattgacatcttcatggaaactactgtctcagaatacattgtctttctatatattcaagtccagttttcctcaagaatcataacattttaatcatatagcttatatatatatatagtttaagcttttctttgctactgttataaatggaatttttctcttgaagaatatcttcttactggtggttgcttgtacataaagactactttctatacatggatctttatttcccatgatcatactgaatttttatattggttgtagtaatgtttcagcttattctcttgggtttttccaggaatacccacatcttatctccaaataaagatggttttcccttttcctttctgatcattgtacatcacactgtttttgtttgtttgtttgtttattttacttgctttgacttatacatctaatacggtgttaaataataaagtggtggtagtaggcctttttccttactgtggttgaccaacttctatgtttccccgttaagataatagtgttggactgaagaagaatatttttatcatcttgaggaaataaccattgattcctattttaatatttttatcaaagatgggttgaattggttgcattttatcaacttattcaacagaaatagaggtgacacataatttttcaacttatagattataaactacaacattatttgtagtttattataaattataatctataactatattaatatatttcctaatatcgaatcattttttctaatattgaagcatccttgtattcctagaataaactccacttggccccacaggttggctggacacagaagagcagtagcaatcactgtagtctggttctcagagactcctactcctaggagaaggggaagagcaccacatcaagggagcaacctgtgggacaaaagaattcagacaacaggccttgagtcccagatctttctgctggtgggagtttctttcagcagagacataattgcagtgctaggctcagcaggaaaaagtctggagctgtaccccaacattcaggcagacttggtgctcttggagggtcttggagaagacctttcccaccttgtccaccactgcagacacagctggggcttctcccacaggagctcagtgtggctgaacctatagacagccttcctggaacacttcagggtgactgcattgccgcaggagaggtatcctccaggttcaggcttgcacaagaggcagtcacaattcctctctccttagaacatcaacatgcctacagataaaaatacctgaatagctggaccactgggataagagtgagtctgggagttggatagctttcttgcttggcctggcaaggaagctgaggtggctctcactcttccccttgttaagacatcagtgcatctaattgagagctccctcagccaccttcatcaaggctggtacctctgtccaccattggatattacatttaccacctgctttagctacaacaggttcctacccagggataccactcctatcctgaagcctgaaccatcaactcagtaaataaaatactggggagaaattaaattaaaaagtgcacaccacaggggaatgaggtaagcttcaagagacctctgccattacaattccataggagatagcaaacttgccaacacactgagtacatgactattacaaccacatctgaggaagccatcatagaaagactctccacaaccaaggaattcatagagtcttcactcccaaaagcacaaataaccaaattaagctataataaacattaaactcacattcttaagggggaaagaagaaattaaaaatgctgtcaaataaaaaataaagaacaattagaagaaatagtatacccaaatgagaaggaaccagaaaagtaattctggtaatatgacaaaacagtgttctttaacacccccaaaaaagatcacacggtctctccagcagtggatccaaaccaagatgtaatctttgaaataccagataaagaatttagaagattattacactactcaaggagataccacagaaaggtgaaaaccaacataatttttttaaaattcaggatatgaatgaaaaattttctagagagatataaagaaaaatcaatcagaactctggaaatgaaagacatgcttagggaactataaaatgccatggaaaggttcaacaatagactacaacatgtagacaaaagaattttagagctcaaagataggcttttgattaatccaataagacaaagataaaaaggaatcaaaagaaatgaagaaagtctttaagaaatatgggattatgtaaaacatccaaacctaagaataattggtgttcctgaggaagaagagaaggctagaagtttgcaaaacttatttgagggaataattgaggaaaacatccctggccttgctagagatttagatatccaaatacaagaagctcaaagaactcctcggaaatttcattatgaaaagatcatcaccgaagcacacagttgtcaggtatctaaaatcaactagaaggaaagaattctaagagctgtgagacaaaagcatcaaataatctgtaagagaaaacctatccgactaacagcagacttctcagcagaaaccttataagctagaagggaaatggggtcctatctttagcctccttaaacagaataactgttagtcaagaattttgtatccagcaaaatgaataaatccagtaaaactaaaacctttcataaacgaaagagaaatgaagtcattttcagagaaacacatgctcagggaatttgctactaccaaaccagcactataggaaatgctaaaagaagttctaaatcctgaaacaaaagttcaacatgcactaaaatagaacttcttaaaagcaaaaaataaaaaataaaaaactcacagagcctgtaaaactaacacaacaacaacagtttatctaggtaacaactaatattgatgaatagaacattaccccatatctctattaacattgaatgtaaatggcctaaatgctccaattaaaagatatagaatggcagaatgaatttaaaaatcacaatccaaatatctgctttcttcaggagacttaactaacatataagaattcacataaattcaaggtaaagggatggaaaagataagctacacaaatgaaaaccaaagcaagcaggcgtagctattcttatatcagacaaaacagactttaaggcatcagcagtgaaaaaagacaaggtcattatataatgataaaaggatcaatccaacaagaagatactataatactaaatttatatgcacctaacactggagctctcatatttataaaacagttactactagacccaacaaataaaatagcaacacaataatagtggtggacttaagtactccactgacagcactaaatagattgagacagaaagccaacaaacagtggacttaagctataccctaaaacaaatggacttagcagaagtttacagaacattctgcccaacaactgcagaatatacattcttcttagcacatggaacattctccaacataggccacaaaacaagtctcaataaatttaagaaagtcgagatcatatcaagtatcttctcagacaacagtggaataaaattagaaatcagctcccaaaggaactgtaaacactatacaaatacatggaaattaaataatctgctcctgaatgatttggggattaataatgaaatcaagatggaaattcaaagattctttgaaatgaatggtaatagtgacacaagttatcaaaacctctggaatacaacaaaagcagtgctaagaggaaaagtcatagcatcaaatgcctacatcagaaagtctgaaagagcacaaatagacaacctcaaggaactagagaaacaggaacaaactaaacccaaagccattgaaagaaaagaaatcacaaagatcagagcagaactaaatgaaattgaaacaaacaaaaaagaacaatgaaacaagaagctggttctttgaaaagataaacaaaattgatagatcattagtgagactaaccaaaaagagagaaaatccaaataagctcaattcgaaatgaaaccggagacatcacaaacaatactgcagaaatacaaaagatcattcgagaccactatgaacacctttacatgtacgaactattagcatagtactggaagtcctagccagagcaattaggcaagcaaaagaaataaaggacataacaaagtggaaaagaggaagtcaaactagtgctgttcaccagtgatatgaccatctacctagaaaaccctaaagacttatccaaaaaaatcctagttctgataaactaattcaataaagtctcaggctacaaagtcactgcacacaaatcagtagcactgctatacacgaaggatgaccaagctaagacacaaatcaagaagtcaatcccttttataacagctgcaaagaaaagaaaatacctgggcatatacctaaccaaggaggtaaaagatccctacaaggaaaactgctgaaagaaatcatcatagatgacacaaatgaaaacacatgctgtggaaataatcaatattgtgaaaatgaccatactgcccaatgcaacctacagattcaatgcaattcccatccaaataccctatcatttttcacagaactaggaaaaacaatcctaaaattcatatggaaccaaaaaaagagcctgaatagctaaagcaatcctaaacaaaaagaacaaatctggaagcatcacatcactagatttcaaattctactacaaggctatagttagcaaaacagtgtgatgcttgtataaaaataggcatgtagaccaatggaacagcagggagaacacagaaatgaagccaaatacttacagccaactgttgtttgacaaagcattaaaaaacataaactggggaaaggtcaccctattcaataaatgatgctgggaaaacttgcaagccacatatagaagaatgaaaccacatccccatttctcaccttatacaaaaattaactcaagatggctcaaagacttaaatctgtaaccataaacattttagacaataacactggaaaaactcttctggacattggcgtaggcaaagaattcatgaccaagactccaaaagcaaatggaacaaaaataagtaaatgggacctaattaaaaagcttctgcatggcaaaagaaataatcatcagactaaacctacaacccacagaatgggagaaaatatttgtgaactatgcatctaacaaaggactagtatccagaatctacaaaaaactcaaattagcaagaaaaaaataatcccatcaaacgtgggcaaaggacatgaatagaaatttgtcaaaagaagacgcacaaatggccaacaaacatgaaaaaatgcccaacattactattcagcagggaaatacaagttaaaaccacaatgagataccaccttactcctgcaagaatggccatgaagaaaaagtcagaaatgagtagatgttggcatggatgtggtgaaaagggaacacttttaccctactgttgggactgtatattagtgcagcctctatggaaaacagtatggagactctttaaagaactaaaagtagatctaccattcaatacagaaatcccgctgctaggtatctccccaccggaaaagaagttattgtatgagaaagacacatgcacacacgtttgtagcagcacatttcacaattgcaaagaaccaacttaaatgccttaaccaatgagtagataaagaaaacatggtatatatatcccctggactaaaaggaatgaaaatactagtaaggaacaaaataatgtattttatagcaactgggtggccattattctaagtgaagtaattccggaatggaaagtcaaataccgtatgttctcatttataagtgagagctaaactgtgaggacacaaagatgtacagtgatataatggactttggggacttgaggcagaaggagggaaaagggagtgagggataaaagactgcatattagatacaatgtacactactcaggtgacgggtacactaaaatctgagaattcaccgctatggaattcatccaagtaaccgaaaaccacttgcaccccaaaagctattgaaataaaaattttaaaaaagaataaacttcacttggtcatgacctattattcttatatgtgctggtagtcttgtctctaatgtctaaatatttttgcctcaatattcatagatgaaaactgtagagctcttttgtgcaattttttcaggttttaatatttatttttctattgttaccaaagttaccaccacttcataaaaagaattaggagctttgtattccttttttgtgctctggaacagtttacatagcagtgggacatggggctttttaggggagtagactgctttgtctgcttcttctgtggaaattaatctgttcaggctttatatagcttctggagtcagttttggcaaattatgttttccaagaaaaagatttatattggatatattctatagtgtcataaaaagtatcccctttaaaaaaaagtctttgtttcttgtttattttatttatttattttttgagacagtttcactctgtcacacaggctggaatacagtggtgcagtctcagctcaaactctgcctccgaggttcaagtgattcttgtgcctcagccttccgactaggtgagattataagtgtgtgccaccatgcctggctaatttttgtatttttagtagagatgaggttttgccatgtaggtcaagctggtcttaaactcctggcctcaagtgatctgcccaccttggcctcccaaagtgctgggattacaggcatgggccaccacatccggcctatttcgttccttattttgtacattcatgctttctcttatttttctcctgtttttctacattgtgttagctcagttttagttgattctacccctttgacctaagagttgtataatgaagactgatgttttcctatgtgaaagagcctttatgttttctgattttgttatttctattgttattgtattgagatcaaataatattgtctgtattatttcttccttttacaatctattgttgttttctttgtggcctaataccagtttttatgaatgtttcatgagttcttaaagagaagatgcattctctttaccgaagtatagatacatacatacatatatacatatatactattacatacatacatatgtatacatgtatatgtgtgtgtgtgtatatataaggtctattttattcattatgcttttagggcttccataagcttatttattttggtggtgagcagtgactaaatcaaagatagatgtaaggataacaatggtatataaataaatgttagacagtctaataaggcaggaataatacaacaacaaaaaatagaaagggagaaaaagtagaagaataaacttgcttactactctatttgtaataactggcagtcaagtgatgttgaaagttgacaaatgtaatagaagcttaaacatattcaagagtataataaagggaaacaccaagaaaggtaatatattatcaatatttaaaaactttttagctcatcttggaatcttaagttataattgtcatctactttgtgtgattttggggtaagttttcattaactgtatgaatgttagcctattttttatttctcatagtattttgaatgaatttttgaatgaaagagtttcctagacttggagcacaggaggatcctagggaaggtaatatataatgggtcatggttgtttcagctttgtagtttagtgttttctctactgctgctgtgggaaaggcctagaggtaactcttccatgtgtccgcagctctggctctcaagtcctagcctggttgagaaaggcttcttcctgcaggtctctgtttcataaatccctcctcttgccatcccaggtgacgccactatagctggtattttgtgagatcttccccctctgtacccacagcctgagccttgattagctttctctctctgcctccccagtaatcagtcctgccctgttcaagctacatcacactcacaggcacttcctctcagtaacaggctcttgctcttctggaagatgctagagacttctcagcacctgtcagaccacctttcccttaacatgtttctcttccatagtacctttgcaacttcccatccagttctgctgtacaactctgttttcagcagtacttaaccacaattttgagtttgcaggttttctgtttcttagttttgctgaaatgttgtttgtggattttgttttgttttcttcttgttgttatatattattaacaacaagaaagagggacaattcacaaataagctgccgccatgttgttctggaaacagatgtcaatgcaaagattttcttttcttttttgagacagggtctcacactgcctcccaggcttgcatgtagtgcatagtcatggctcattgcatcctcgatctcctgggctcaagcaattttccagcctcagcctcctgagtagctgggactacaggcgtgcaccattgctcccagctaatttattattgttgttttcagtagagacgagggctcactgcattgcccggggctgttctggaactccctggctcaagccatcctcccgccttggcctcccaaaacgttgggataataggcatgagtgcctggccagggtatttttggtgctatgcatttttctcccaggttctgattctgataaatactagacttttattataatttttataatatagtttggatttaattttttatttggttcaaagagaagttgttgttttcattttaatttcctatagtagtgggttttctcctaattttggtatcaatttctagtttaatttcatgatgggcaatgaatgtcatctgtaatattgctccctcttagaatttaagtttttcatcatggcttttttctttaatgaagcttctaatgttataatctttgctattttttagaatttgcttttagaatttttagaatttttttgaatttgcttttgcatgtcttcagccttttattttcaacattcgtaagttttaggtatatattttttatacttacattgtggtttttttccttccaatgtttttgtgttttagagacaggctgccactctgttgcccaagctggaatgcagtggcaatcatagctcactgcagcctcaaactcctgggctcaagcaatcctgccactcagcctcccaagtatctgggaccacaggcatgtgccaccatgcccagctaattttgtttctcctgtagggacagggtcttgctatgttgtccaggctggtctccaactcctggcctgaagcaatctgcctaccttagccccgcaaagtgctgggattacaggcctgaggcactgcacgtgatctttccttttaatctgagtataaatttttctaacttttgagttgttacccttatacttactgattataccagaatgtttatgatcttatgttacactttgattttttgtttttattaatctttactgaggtataagattcaccaattttaagcttacagtttagtgacttttttttgagacaaagtcttgctttgctatccaggctggaatgcaatggtgtgatctcagctcactgcaacctccacctcccgggttcaagcgattcttgtgtctcagcttctcaaagtagctaggattacaagcatgtgccaacatgcctggataatttttgtatttttagtagagagggggtttcgccatgttggccaggctggtcttgaactcctgacctcaagtgatccacctgcctcggcctcccaaagtgctgggattacaggcatgagccactgtgcccagcccagtttagtgactttttactaatatatacagtcatgtaaccaccatcacaatcaagatgtagaacattttccttacctcatgcagctctgcaattcacctttgtggcagaaccttcctttccacacccaactcttacaatcactaagctgctttctgttgtaacagttgtgcctttcctccagtgccatacattgaataagtatatattcttttgtttgaattcacaaaattgaaaccaaagacttatcatgttgttgaatatatcagtagattattcctttttattcttgaatgctattccattgtatagatatactattctatgcttatcctttctatttgatgaacctttgggttatttccagtttggggctattattagtcttagtctggaccatatgttttcatttctcttctgtaaatacctagtagtatgggggtgttgggtcatatggaaagcttgtatttaacctaagaggctgagaagctgttttccaaagtggttgtaacattctaactaacaacatatgagagttccaattgctgtacttcctcactaacatttgatatcactctcttaatttaatggatgcatagtgatatattgttgtagtttcagtttacatttccctacagactaattataatattagttcgttcttacactgccattaagaaatacctgagactgggtaatttataaagaaaagaggtttaattggctcatgtggttccacaggctctacaagaagcatggcagcatctgcttctggggaagcctcaaggagcttttattcatggtggaaggcaaagcaggagcaggtgtcttacattggaggaacaggaccacgagagagaaggggaaggtgccacacacttttaaacaaccagatctcacactaactcactcactatcacaagaagagcaccgagggaatgctgctaacccattcatgaggactctgcccccgtggtccagttacctcctaccagggaattataccctcccacctccaacactggggatgagatttggtgaggacacagatccaaaccatatcgttgtgcttattggccatctgtatattataagtttttttgcaaagtgcctattcaagatttttgctcttttttaagttttggattttgaatttctttggaaaacaaaaaagcccactgagattttgattgcaactcttgttttaaatcagtttggtgaagattaatgtgttgattatgttgagcttccaattcataaatacgatatgtttcttgatttattttggtctttaattactcctagcagagttttagtttgcagtgtacatattttactaagaattttataactgaatgctaatataaatggtatttttaaatttcttgttggttgctaatacatagaaatacaattaatttttgtatattggacttatgtcctgtggctttgctatactcacttattagttctagtagagttcttaggaattttttcataatgggtcctgttatagttgtagagttcacaggattgtcttcacagtggatcatatcttcagcaaataaaaatagttttactttttcctttccagtcttcatagtaatgtgttttatttatttttcttgttgtgctggactggcaagggcctctgggttgagaacagatacccttccatgcctgtttttcatcttagtgagaaggcatttagttttagaccattatggatgatgttagctttgggtcttcatagatgtcctttatcaggctgtaaaagtttccttttattcctagtttactgggagttttaatcataaattgatacttgagtatgtcaaatgctttttcaatatctgttgagatgatcatatggcttttctcttgtagttaatatataaattatactgattgacattacagtgtttaatcaaccttgtatttctgagataaagtctacttggctatgatggaggatcctttttatatattgctggttttaatttcctgaaattttcttaaagatttttgcatctgtgttcatggagaatattgttctataattttcttaatgcctttatctggtgttaatgtcaaagtaatgcttgtctaatagaatgagttgaagtcaaaggagattgcctcagatgagactttggactttggagttttgagttaatgctggaatgagttaagactttaggagactattgggaaggcatgattgtattttataatgtgagaaggacatgagatctgaggcaaatcccttcgcctatgagcctgtaaaataaaaaacaagttagttatttccaagatacaaaggagatgtaagcattggataaacattcctcttccaaaaggaaaaaattggccaaaagaaaggggctacaggcccacacaggtccaaaacccagcagggcagtcattaaatcataaagctccgaaataatctcctttgactccatgtcccacatccaagtacactgatatgaagggtgggctcccaaagccttgagcagttccacccctgtggccttgccgtgttcaacccccgaggctactctcacaggctagagttgagtgcctacagcttttccacactgaaggtgcaagctgccagtggatctactgttttgggctctggaggacagtggccctcttctcatagctctgctaggcagtaccccagtggggactctctgtggggggtacaatcccactttttcactccatacttccctagtagaggttctctctaagactctacccttgcagcaggcttctgcctagatacccagactttttttaatacattctctgaaatctagacgatggctgccaagcctcattcactcttgcactctgcatgcctacaggcttaacaccacatgccagccactgaggctaatggcttgcaccctctgaagtagcagtctgagctatatctggggctcctttagccgatgctggagccagagtggtcagaatgaggaaaacagtgtcttgaggctgtgcagggcagcaggaccctgggcctggaccatgaaaccattcttcccttctaggtctctgggcctgtaatgggaagggctgctgcaaaggtctctgaaatgcttttgaggactttttctcattgtcttggatgttagctcttggctcacttttggttatgcgaatatctctagcaagtggttgctccacagcttgcttggattcttcctttgaaaacaagcttttattttctacatggccaggctgcaaattttccacttttacaccctgcttcccttttaaaagttccaactttaaatcatttctttactcccacatctgagcatagcttgctagaaacagccaggacacatattaaatactttactgcttagaaatttcttctaccagataccctaaatcatcgctttgaagtcaaacttccacagatccctagggcacaaacagaatgcagccaagttctttgttaaagcataacatgtatgactttgctccagttcccagccagttcctcatttccatctgagagctcacttcactgtccatatcactatcagcattttggtcacgaccattaaccaatctctgagatgttccaaactttcctttatcttcctgttttcttttgagccctccaaactcttccagcctctgctattacccaattccaaagttgtgtccacgttttcaggtatctttatagcagtgtcccactccttggtaccaattttctgtattaggccattcttgcactgccataaaaaaatacctgagactgggtgatttataaagagatttatggttcatggttctcaggctgtacaagcatggtgccaacatcacttgggttctggggagatataattcacatactatacaattcaccgatcaaaatgtatagttcaatcacttttagggtattcacggagttgtgcatccatcacggcaatcagctttagaacattttcactacctcataaatgggggaggcctcagggagcttttactggtagcgaaggtgaagtgggagcaggcatatcacatggtgaaagcaggagcaagatgagagagagtaaggtgggtacagtataccacacacttttaaacaaccagatcttatgagaactcactatcacaaagacagcaccaagccatgaaggactgccaccaagagccaaaccacctcccaccaagcccccacctccagcattgggaactacaactcaattcaatatgagatatagatggggacaaaaattcaaactatacatttagcctgtaatctctcattctggagactgcattatctgatgtttatatagaccctcaagcttttgtgtttttaatgtttgcatagtgtattttttatccttttacttaaaatctgttagtatataagggtgggtttcttgcagagagcatatagttgggtctttttatccaatcttaaagactgcttgtcactgtagtatttatacaagggtgggccaatttatacaagggtgttctgtgggtaaatctgcttttatacagctcctaagaattgtttttacatttttaaatggttggaaaaaatcaaaagagtaataacttgtggtacatgaaaattatatccaaatttctagtttttctaaaatttcattggaacatagatttgctcattcattcatgtattatctgtggctattttgtgcttgcagtggcagttgcatagttttggtggagattacacagtccacaactaaaaatatttattatctgtctttttacagtaaaagtttgctaacctttcatttaaagcattacatttattgtaattatggatatgattggatttaaagaagccatttcctatttttctgtttgatttgtgctccctatgccttttttccttctttttctgccttgttttgggtttttttcttcaaattccgttttatctccagtattattttattagccatactccctttattttttaatgaagtttctctacagtttagaatatatgtctctaacacactatagtcagccttaaattatattactttgtttcatatatagtgtaggaaccttgcaaccttatacttctgttttttcctcttttctcttatgctattgttataatgcattttactattatatattattaatcccatattacattgtttctatttgcattttaaacaattatctaccgctttgttatataattcacatactttacaattcactaattcaaagtgtatagttcaatggcttttagtatattcatagagttgtgcatccatcacagcaatcaaaattagaacatattcactacctcataaagaaatcctgtcctctttagctcacgccctaatttccctatctccctgaccctgaacaactgatctataaagtactacgaatctacttctgtctccacagatttgcctagagatttcacatggataggattgtccagtgtcataattagtaactggcttatttcacttagcattatgctgttaaaatatattcctatgaatatttatatacaggttttaagtggatattatgttttcattttccttgggtttatacttagtgaaatcactgggtcatatggtaactctatgtttaaccacttgaggaactgtcagactgttttccaaaaccactggctgtattttacatttccaccagaggtatatgaggattctaatctccctacatccttgtcaatacttattatgtctttttgattaaaaatatcatagtggctgagaagtagtatctcactgtggttttgatttgcatttccctgatggcaaatgatgttcaccatcttattgtgtgcttattggcagtctgtatatcttttttagagaaatatctattgagatcctttgcccatttttgaattgtgttttctttttgttgtgtatttgtaagagttctttgtatattttacatacaagtaccttaccaggtgtaatttataaaattttttcccatctttggttgtcttttcattttcttgatgatgtcctctgtggtacaaatgtttatatttttgatactcaggtttttttgtctttccttgcttgtgtttttggtactatagctaagaaactacatttgaccctttaacaacacaggtttgaaccgcacaggtccacctatctgtagatttttttcaacaaacatattggaaaaatttttggatatttgcaacaatttgaaaaaacttgcagaagaaccatgtagcctagaaatattgaaaagactaaaaagctaggtatgtcatgaatgcataaaacatatgtagatactagtgtgttttattatttactgtataaaatatccacaagtctattattaaaagttaaaattgataaatgtatgcacacaaacacagaccatacatggcatcataggcagttgagaaatataaacaaacataaaattaactgtagtatatactatgctactgtaataatatcgtagccacctcctgttgctgttggagtgagctcaagtggtgtatctgcttaaaacactaatcatctccacatgagcagttcataccgtgtttagtgcaataccataaaacttgaataataccatgggacccaaatgaagtcatggattatcactggtgatgccggaagtgctcccaagaagcagagaagaaagccatgatattacaaaaaaaagtcgaattgcttgatatgtacaacagattgaggtcgtcacatgtggttatccatttcaagataaatgtatccagcgtaaggaccattgaaaaaagaaatgaaaattttgtgaagttgtcactgcagctgtgtcagcagcaccaaaactttataattcttgcaaaatacctatttatctcatattaaaaatgcagcttttatgtgggtgcaggattactataagaaaggcttacctgtagactaatataattcaagaaaaagaaaagtcattatgtgacaacttaaagcaaaagtaaggtgcaggatctaaaactggagaatttaatgccagcaaaggatggtttgataattttagaatgaggtttggtttttaaaagtcaagataataggagaagcagctcctgccaaccaagaggcagcagccaggcagcccagctttgctaagggtctctctcagtgtgctgaggctgcggaaaggctgcagcctgcaggcacttggcacacaccctccctgctgctaggatgccaagaggaaggtcagctccaccgaagggacagcgaaggagtagctcatgagaggagatctgcacacttgtcagctaaacctgcccctgcgaaagtggaaactaagccagaaaaggcagcagaaaagggtaaatctccagacagaacgtgcaaacaaaagggaaaggaggagcaaagggaaaatgggctgaagtggctaatcaagaaagtaaagaagatttgcctgcagaaaatggagaaacaaaaaccgtggagagttcagcctccaatgaagctagagagaaagaagccaagtctgattaatatcctataccatgtcttatcagtggttcctgtctcccttcttgtacaattcagaggaatatttttatcaactattttgtaaatgcaagttttttagtagctctagaaacattttgaagaaggaaggaatcccacctcatcccattttttaagtgtaaatgctttttttaaaaagagctaaatcattcaccagtttatttttgggtacaaccagaaaatagtgtgagatattgaattataggaggctttgactatcttaggtgtcaggttaacattccatagatggggggttagtttttatatcctataatacaaagcatactaaacagcaatatggagtcacggtcctgtactgaatgtcttaaacatcttaaattacttctgttcccttgttgttttttagtagaattgtttcctaaagaaaaccactccatattcgtggatttccctgtctgaattgtgtgcactctgtaacatatttagttgtgatagtcctgttttccaataactttgtgaatgtgctgtgaatgaaaatttgagtatgtagtgtacatgctattcagttatgaattggtaggacgtatttaacagcttatcaacatgtgaagatattggtacgtgatagcctcttaaggaaattttgcctccggatattaagctggaaagtcactagagtaacttcacaaagaatttgcaatacatggctttttagatttttggtacatatgtgaagaattgtgtacaaattgaaatgtctgtgtgctgatcctcgacccaaccaataaaatctcaattatgaaagaaaaaaaaaagaaaatcactgaggagaaaggattatttgcctcaacaggtttttaatgaagatgaaatttccctgtttgtagaaaaaaaaatgccacaaaggacatttatttgtaaggaagagaaatgaaaaccaggatttgcaggaagagataggctatctctattattttatacaaatgcagttggtcttaagatcagtaatattcttatctataaagctgctaacccccaagccttgaagataaagataaataccagctgccagtcttttggttgtacaacagaatgtctgggcaacaagaaccctttctctgcattggttccatcaatgcttttgtccctgagatcaggaagtatgttgcctgtaagggactgccttttaaagttcttttgatattgggcaatgctctctggccacccagaactccatgagttcaacactggaggtgtctatcggcccccaaactcaacatctgtaattcagcctctagatcagggtgtcataaggacctttaagccttgttacacaaagtactctttggaaaagattgtcagtgccgtggaagagaaccctgatagaacatgaaagtctggaaggatgataatattgaaaataccatcattgttatagaaaaagccatgaaagttatcaagccccaagcaatacattcctgctggagaaaactgcccagatgttgtgcatgacttcacaggatttacgacaaagctaaccaaggaaatcatgaaagagattgtgaatacggcaaaaaaaaaaaaaaaaaaaggtgagggctgagggtttcaagatacggatttctagaagaaattaaagagctagaagacaccacaccagaagaattaacagaagatgacttgatggagatgagtgcttctgaaccagtgccagacaatgaggaagaagacatagaagcagtgccggaaaacaaattgacattagacaattggcagaagagttccaattattaaagactgcttttgctttttatgacatggatccctctatgatatggagactgaaactaaagcaaacagcagaagaaggattttagagaaataacaaaaaaattagacagaaattacaaggtatttctgtgaagttacactgagtgtgcctgcctctgctgcctccccttctacctcctccacctcttccacttctgccacctgagacagcaagaccaaactaacaactcctcttccttagcctacggaatgtgaagacaatgaggatgaagacctttctgatgacccacttgcacttaatgaatagtaaggtatattttctcttatgattttcttaacattttctctagcttcctttattgtaagaatacagtatataatacatatacaaaatatattaactgtttatgttatctctaaggcttccagtcaacagtaggctattagtaaagtttttaaagagtcaaaagttatatgtggattttcaactgtgcaggggtttagtgtccctaacccccatgttattcaggggtcaactgtattgcccaatccaattcacaaagatttccatgtatgttttcttctaagagcgctatagttttaggtcttatacttagatttttaaatctatctttaatttttaaatatgatatgaagtaggagtccaacttcattctttggcatatggctatctagttgtcccagaacaatttgttagagagactgtcatttccccattgaatggtctgaacacccttgtcagaatcatttgatcatatatgcaaggatttatttctgggctctctattcctttagtctatatgtctcttcttattccagtaccatactgttttaattactgtagctttgtagtaagttttgaaatcagtgagtccaattttttttctttttaaaattgttttggctattaaggtccctcaagatttcatatgaattttaggtttttctgtttctgcaaaaagtgtcattggggttttgatagggattgcatcagatatgtagatcactttgagtagtactgccgtctgatgttctttcttcctgacaacaaatatgtaatgtttttctaacaccaattctccaattcactggacaccaactggatctccagtaattcatttcaactctgacattaactcctggagttaaccttcagaccccacagattaagggcccagcctgcaggactgccccacttcagatatcaaccataaatctgatgcccaggctacccatattcctgcctgaccagctacatacagctccctaagctacaaagttgggttgctgaattgacatcttttttcttttttgatgttagtgtttacagctataagtttccctgatcacttttttttattgcatcccataaatttgtctgcttgtgtgtttaatgactcctgtctttgtttagccttggactttttttttttccactgtgtgttttttttttttttttaataatctctttcccccttatctctgttctctctgtccaagattctaactagttggatttttatacctcttggttcaatcctataccatttttatgtattttttcattgtggttaaaaaaatcacgtaacaagatttactgttttaaccatttttaagttcagtaatgttaagtatattcacattgttttgaaatagaactccagaactttttcatgttgcaaatctgaaactctatactcattaacagttccccttccccctctctccctgcccctggcaaacatcattctactctgtgaatttgactactctagatactttatataagtgggataatatagtatttatttttttgtgactggctgatttcactcagcataatattgtcaagatttattcatgttgtaacatgtgacagaatttccttcccttttaaaagactggataaaatcccattgtatatatatattgccacattttgtttacccattcatccatcgatggacatttggtttgctttcaccttttggctactgtgagtaatgcagctatggacatgtgtgtgtatatctctttgagaccccgctttccattattttggatatgtatgtccagaaataggattgccaaatcatatgaatatttaaggaacctctatttttcatagcagttgcattattttacactcccatcaacagtgcaaaagagttccagtttctccatatcctcaccaacacttcttattttctgggttttttttttttatagcagtcatactaatgggtctgaggtaataatttcattgtggttttgttatgcatttctctaatgattagtgatattgagcatattttcttatgtttgctgactatttgtatatcatctttgaagaaatgtatattcaagttctttgtccattttttaatcaggttatttgattttttgtttttgagttgcagggtttctttatatattgtaaatattaatggcttatcagatacatgatttgcagatattttctcttatttgctaggttacctttccattctgttgatggtgtcatttgatacacaaaggtttttaggtttaatataatcccatctatctatttttacttttgttatatttttggtgtcatatgtaagaagtcattgccatgtcagtgtcatgaagatttttccctatgtgttcctcaggagttttataatttcaggtcttatatttaggtttttaatccatttttagttaattttcatatgtcatgtaagataggagttcagctttattcttttgtgtgtagatatccagtttgcccaactccatttatgaaagagactgttattttcccactgagtattcttggcatccttatcaaagatgaattgatcatatacacaagagtttatttctgggctctctattccattgggctatttgtctttatgccgggaccatactgttttcattactgaagctttgtaatatgttataaaatcaggaaatgtgaatctgccaacttcattctttttcacaatattttcggcatcccttgtgattctgtatgaatttcaggatgagttttcctgtttctataaaaagcatcattggggtttttatagggattttgttgaatctgaatctgtagattgctttgggtagtatagacatcttaatattaaatttccagctcatgaatgtggaatgtctttccatttatttgtgtcttctttcatttctctcagcaattttttgttattttcagtatacacatgtatcacctcctagattaggtttattcctaattattttgatccttttgatgctactgtaaatagaattgtcttcttagtcctatagatcttttgtacttatattttctcttgtttatcttttcctttcatttgtgttctgaaaaaattctttgacattatcttcaatctttctattcatttattttagaggggtaatcacttcttaatttctaacagatctttcttttccctgcttgcttctttttaatttcattttgttcttgttttatggtttcgtggattttttctaatatcccctgaaataccagttagaactgttttgaatattgctttagttcttttcagttcctttttgtttaagctgtcttatgtattcatcttggcccttttttcttttgttactggtcttcctcaaaaacctggagatctttggctgtttgtatatatttaacaatgaaatgttagattgatcaatataataactggtgtgggtttcctctgccagggtttaaatgtgtttctccgagagccttccccaaatgggagggttaattactaactaacccacggtgtacaactggcaggcttccttctaggtgtatggtcatggaacagatcaaagcccatcctgtacaccaccccaaaagcccaaatgagggcgctttactcaagagcagacactcatataaaaataccccttttcggccgggcacggtgaatcacacctgtaatcccagcactttgggaggccaaggcgggtggatcacctgaggtcgggagttcgagaccagcctgaccaacatggagaaactccgtctctactaaacatacaaaattagccaggcgtggtggcgcatgcctgtaatcccagctactcaggaggctgaggcaggagaattgcttgaacccgggaggcggaggttgcggtgagctgagatcacgccattatactccaatctgggcaacaagagtgaaacttcgtctccaaaaaaataaataaataaaccaaaaacctctttccccctctctcccaccctttatttctccctctttgtctctctcaaaattgttcaattttctttcaagaatagacttccactttttatcttagaatagataccaggctatcggctgggcacagtggcttacgcctgtaatcccagcactttgggaggccaagacgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggtgtgaacccaggaggcggagcttgcagtgagctgagatcacaccactgcactccagcctggacgactgagtgagactccgtctcaaaaaacaaacaaacaaacaaacaaacaaacaaacaaaaaaggatagctaataccaggctgtcagtttctcttttggattcagaagaatgagagtggggtggggagctgacaggcacagattttccacggacggccctttacttgatagcctcactgtgtgactcactgtccactggcgtttgttatagcctcgtccagcctcctccatcaggaaagccaactcatcgtttcagcggtgtatcctgggatgaagttgtttcgtgcagtctatccctgtttcccatttcttgaaattcattggtaactttgccccaacaagtgtcttgtaaccacttccctcgttctcattattgtttttcctttttatatttattatctttccagtagaatttagtgaagaaatatagtctgccatcttgaattgtggaacagcatgcatttaaattgtattttatttaatttctgcctgaaaatattgagttctcagtgatttacatcagttggtatgtgacagctcagtgatgcagaagagaccattttgttctctgagagtctcatcagaattgtgcttgcatttatgtagtacttatgtctatgtcagagtgctgtgtcctcccatcttagatgacgactatatattaatatgtcctctgctttctgttgttccattacattaagggtagaatactgtattcacagtgaataatctgttagtattcttcaagacctcttatctgccaggcaggatgctagatcctaaagataacaaagataagtaaggtatgttccttgtcctcatagactcatgggagctcacattctaggtgggtagaaagaccagtagttatgagacaatataatagacatcacagtgtacaaagagctattctcgtgttgcgtaatgaagcatataggtactgaactagcaaataaaggatcctcagtcagtaccggtgcttcctcatcatatgtaagtaatatttaagatatttttatgtttaagatgccagaagctaaataaacttttctcccttatagttttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaacctgattgttcctttttcctgatcaccagttaaagtttgacattttgccagatagcccaggtaccggactagctggtgtttatcaaactatagccttttgtatctggttttatgtgcatccacatttccttattcacaaaatgcatttaaaattacagaaatgcatttaggctgggtgcagtggctacacctgtaatcccagcactttaggaggccaagacaggtggatcagctgagttcaggagtttgagaccaccctggccaacatggcagaaccccgtctctacgaaaaatacaaaaaattagctgggcgtgacggtgggcgcctgtaatcccagctacttgggagcctgaggcaggagaattgtttgaacccgggaggcaggggtttcagtgagccgatattgcgcccattgcactcaagcctgggcgacagagtaagactgtctcaaaaaataataacaataataatattacagaaatgcatttaaaattacagaaacctattttgtatttttccttctgagacaacaataattaataattaagcccatttattccttaactattgttttaaaatggaagtaatattgttgcatagtaatcatttatcttaaacaatgttttaatcttatgcggtatttggattttttaatgtttctaattttatgtcataaaaagcatttatgggcatgtgggatatatgtgtattctctttttaaaaggactaggtacttttatgggaactaagttgaggatgtaaccagtttgtttttctgatgtgtattaataatagatgaataatagtaaatgtttaaaaactatccaactattctaaaatcataggatcatgggactggaagagaactcagtgccatttggacctcatcctgtggagagtctgattcattaggtctaaagtaagcttggtaaatcatgattgtttaaaaagctctccagatggttctgtaattagacaagtttgagaagcatttaatagaattgggccccagccagtgtgccggcccctcttctaaggccctgcctgtaaagctgagcctcaggccatcttggaaattccaggacaacagggaactctccacctctagagacaggctggtccatctttggacagctctgtacacacagttccatcatgagccgaagctcactcctgtgagcttttcagaacaaggctaatccttctgtgtttgacagaacagcccatagagttaaaatactactcctcccatcagctccattcattcctaataagagagcgcctgcctctccctcttgcagtcatcctccctttgttacttgttcgtgtttgtctgtattaaaatggagtgcaccatttatggcctgctctggtggaactaggttattcctgtgagttcagagtatcctatagggtacactcagaggctggagcagtaaatggtcctggggcggccagcgtcatggtgctctccggctcactcttgggagtcagctgaagctggggattggtaagaggtgagactctgtaaggttctaggtcaggccagatgctccacccagctacccagaggtctgctgcggtggctggggcacaaacctcaactataagatggtactttgttttcctttgttaccagcctgtcttcacttctgtgagaatcttatagaaaggatgatcagctgggcagagacaccggattcctacttttattacctacaatggccttctccagtattctaggtcccatattttcatggagtattaagctaaaattacagaacaatgtaaacacagtcttgatggcccccctccctgtttgcatcttgtgatctgagtggccagtttacatgttacatttccaggtgagtgacaccttataccagaaaatccagatttataaataaggtatttctttacagtgagatgttttaattaaatggcttgttttaaaaatgctgttatgtcaagagctctcatgcatacaaactgctg

SEQ ID NO: 12823 - DNA, 62386 bp, Human
  misc_feature (1)...(62386): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtaaaggaaaaagaaattcaaataatactaggtatcaagattttggggttaaaaatttgaaatgagttttagcccacctatttgatatggagattcaagtattactccaatctttttttattttatttttttgagacggagtctcgctctgtcacccaggctggagtgcagtggtgcaatctcggatcaccgcaagctctgcctcctgggttcacaccattctcctgcctcagcctcccgagtagctgggactacaggcgcctgccaccacgccaggctgattttgtttttgtattttttagtagagacggggtttcactgtgttagccaggatggtctcgatctcctgacctcgtgatccacctgccttggcctcccaaagtgctgggattacaggcgtgagccaccgtgcccggcctttttaaaaaaatcttctttgaagcccgggcaacatggcaaaacctcatgtctacaaaaaatacaaaaattagatgggcatattggtgcgcctgtagtcccagctacttgggaggctgaggtgggtggatcacttaagcctgggaggttgaggctgcagtcatgcgcgcgcacacgcacacacacacacacacacacacacacacacacttctttgacttatgaaagaaaacctgcttcattctttgaaattaggttgatctctagatgaatacctattatcttgcctgttttcacttggataatttccatgtggctcatagaaatgggagtttgaattcaggtactttcctatagtttagttcaggaagaatatgctagtcttgtaaagtgcatcaataacttgctggctggttgtcaggagcagaaattctggattgaggatgagcagtccaggaatgacctctctacaactagagaaagaagaatgcatgcaatgtgttccctgtagtccaagaaccagggtagccctgctggagctctacagagccatgtgccaggtaatctttgttgtgaaagaaaaaactgttgggtggtcccagagtcaccaccccaaacacctgatcttgggcaaggtaatgctgcctccctggacttcagttttcctagtctgtgaagtggtgatgataagacccgctccacagagctggcagaagcacccctgtactggtagcagtttgtacctgtagactgtaaagttgaggggttattgttgctgtcattgtcattattagggcagcgtggacattctcaggctgactctccagggtgaactgacaggagatgaacttgaacacatagcccagaaggtactgcggaattctggtgggcaaggccccctccccacaccagtgcttccttgctgctggcctcttacccaagtactgcctggagccgactctggtgatgcgagcgtgggagcccctcctttcagcaacatccagcttgcctcagccttctgcactgctttggggcaggaggagtcccccactaaaattaaaactaaactgctacttctgtccattctccctggccggtgttcttgctgctgtgtggcttctgttagaagttcggaaacgaatttttggagaggaaagtcagactaatccttcaagtcttttgagaaacaggtcttctgcattagctgaggggcaggagttctgggcttgccatgtggtgtctgagccatctctctctctctctctctctctctcatctctctttggccaggcgggcaggaagacctatgccatggtgtccagccactcagctggtcattctctggcttcagaactggtggagtcccatgatggacatgaggagatcattaaggtaagcttagttcacctccaacttttctccctgtcctcttcctccctgcacgtatatgagaaggagcagttgatgttgttgccaaagggagcttgtggtttgatggaaggaaccagacctgagctgctagttcctggcaatctcctagaaatatcttaattaataccaggagactacagtctgcctgttagcaactttggtgcagcctggccccaggcaaggggatggactggatgaccttactaggggcctatccactgaccatgttttgctgctagaggttgtggagacaggtaggaggtgtgtttatggaacttatgttttcctataatgggttcatcctgatggaacttatttatttatttatatatttttagttttgtagagacagtctcgccttgttccctgggctggtctccaaatcctgggctcgagcaatcgtcctgtctcagcctcccaaaatgctggtattataggcgtgcaccagcccacctggctgatggaacttattttttaaaaaataaaatgatttttgttatttctctctctctttttttttataaaacagcttttttagatataaatcccataccacatgattgactcagttacagttttggtcagtgcataacaaaactgcataacaacgttttggtcagtgatggactgcgtagacaacagtggtcccataagattattatactccatttttactgtattttttctgggtttagatacattaccattgtgtgacgatcacctacagtattcagtacagtaacatgctgtgcaggtttgtttgtagcctaggagcaatagggtacaccatacagcctaggggtgtaggaggccatgccatctaggtttgtgtgtgtacactctgtgatgtttgtacaaggatgaaattgcctaatgatgcatccctcagaatgtattcctatgattaagtgatgcatgactgtatatatgtgagtgtttatgccaatacagctatatagcattgagctaaatttattgcattagggtaaatttccagaagtagaactgatagaccaaaaagtaaatatatttttaggtcttctgatccgaatcaccaaattccacccagtaaattggtggtaacaatttaccctcccaccagcactatatgaagctgcctatttttgtatagttaatttaatttgaggtttcttaactaaatggtgttcttatttcaggtgtacttgaaggggaggtctggagacaagatgattcacgagaagaatattaaccagctgaagagtgaggtccagtacatccaggaggtgggcaccccttacctctcacgcagtgcctaggtcatttctctaaatctcacattttttgtgactgtcttcttttgtggattctggtttttccccttctttttcctttatgtctctgaaatgccaccatgccctcccgtgtgtcaaatatataacttttgaccatacctgatccattaatccacaaatacttaagtactatgggcccagcactgtcccagccacctatcgaaaattaccagccacttttcacagcatttcttaactcccttcctggctcgtgtttctcgttggcacttatgcccatataacatattacacattttacttatttgtcttttgtgtcttgtgtctccccaacaagaatgtcagctgtagctccacttgaccaaggtccctccctccatcctgcagccagtcgttaggacagtgcctgactcgcagtacaggccagggatggggcacagagttgggtgagttggcatgctctctttctctaccctaaagctcaagtttcttcccctcccctcccaggccaggaactgcctacagaagctccgggaggatataagtagcaagcttgacaggaacctaggagattctctccatcgacaggagatacaggtaataggaaatggtccatggttgggtccccaccgaggaggtggggttgtgccaggcagtctcatttaccaattacccagtgtgtgctaaatctagcatccctgccaggaatggagaaaatagaggtgatgctggcttctctggagcactcacaatctggttaggactctccagccgatgagcacttacatttacacatgtcagcttaaacataagtacacctgctcctgaaacactgtacagaaattgaacttatataaattaaatatcatcagttgttagcaaacctcttatctataaggattctgtgatcaagcttcttataataatagaattttgtaaagcagacaatcacctgtaaatccacacttctcataagctgatcttgcttagtttgggtgatacctgtagcgtaaattgaagtccgtgccctagcctgttattaatcttgtatatagttatgtctaacctgggatgggaagttcctcaaggttaggagttcaccccaccccaccccacctcgtgtctgtatcctcaccctcccattccccccaggtctgggatgtagaaggcatcagtaaatgtttgttagactgaacagattgggtaagtctttcctgggagggataatcctgggatcctgcttttcagtttttccaaaactcgaggacagaaatgtcctcaggagagcagagctgtctctttgtgacttcgccctcatcctttagattctgagttgtatccttgatttgcattttggttcaggcagagtcttgctccagcagcagcccctgccttcattcccttgaggggaacagtggcccagcagctggtgcaaggaaagttctttgtcttgggcatgcacttgtgtggtggaaattacctaatttttgctttggctgaaggtaggtctttcagtgcttgagctcacatctggctggtgggagctactttgtcaggtatcagaagaacctaatgtgtgcagagactggcccaaagtccagcccccttgtttgcacaaaccggctgtcatatgatgaataatcaggctttgggtcagaaataattgaaaaagatcttccctttgtaatttttgctttgtcaaactttatcaggatccctgggggcaagggaagctctttgtttgtggcaggcagctgcatgtattccctggctaagaagaatgggctacacatacttttccatctgctgaaagattttagcctgaggtttttttcatcctccctacaagactttcaaggccctttcaaggccgcataacatctctccaccccctcttgtttctattttctcatggaacgctagaaatcttttcttctttcgcttcgttccttcttcctcttctcctttcttcattccttcctttttctccctccctttctttttctctctccctcccccctccctttcaccttcctctccctctccctgtccttctctttctaagatttgagtgttaggagaataatgtttcaaagttggttgctttcatctgttttaactaccaattttatttttctttgaacaggtggtgctagaaaagccaaatggctttagtcagagtcccacagccctgtacagcagcccacctgaggtaggtaacagaggacaccatggtggctccgcttagccaggggcaggattgcctcctccccatccttttgtttattgctttctctctctctctctctctcattaaatacaagagtagtagttgacataaaaattcaaacacagagaaatacaaagagtagaaattctccttccccaatctctctccttgcgagtatccactgttaacagattgaagtgggtggatctttctagggcagtgcttctcagcctcagctgttcattggaatggccttgcaagcgttaaaggatatgatgcctgggtcccatccctagagcttgtcatttcattgttccaataggtggcctgggcatcaggacttttaagagctcttcaggtgatactaatgtttagctaaagttgagtgccagtattctagaatatttttatatacatagacaaccatatttaaatatcatgtatatgttatatacacaccatatatacatgataaatatatgtatataatatacatgtgcttttctcaactataagatcatggtaaatacattattctttgcttgctttttttttcttaactaaagagtatattataaccttctttccatgtcagtacatatagatctacctcattcttttgaataactacatagtatttccttccatggctgtacttgattgattgactgattgattgattgattgactgactgacagagtctcaccctgtcacccaggctggagtgcagtggcaatcatggctcactgcagcctcgacccccggggttcaagcaatcctcccacctcagcctacccaatagctgggactatagggcacgcgccattatgcctggctaatttttgtagagatggggttgcccaggctgctcttgaattcttgggctcaagtgatctgcttgcctcgcctcccagagtgctgggattataggcatgagccactgtgcctagcctactttttaaatttttataattattattttttgggacagggtctccctatgtcatctgagctggagtgcagtggtgcagtcatggctcattatattctcaacctcttgggctcaggtagtcctcctgcctcagcctgggagggactgtggcagccactatagtggctgggactatagacacgtgccaccacacctggctaatttttgtattttttgtaaagacagggtctcatcatgtttcccaggctcatctcaaactcctgggcttaagtgatctgcccacctcggcctcccaaagttttgggattatagtcatgagctactatgcttggcctccatgactgtactttatttgttattttttgagatggagtctcgctctgtcacccagggtacagtgcagtggtatgatcttggctcactgcaacctccacctcctgggttcaagcaattctcgtgcctcagcgtactgagtagctgggactactggcgtgagccaccacgcctggctaatttttgtatttttagtagagatggggtttcaccatgttggccaagctggtctcgaactcctgacctcaggtgatcctcccaccttggcctcccaaagtgttaggattacaggcgtgagccactgcaccccgccaccattactgtatttttaaaaagtgtgttattatgtttttttgtgattatataatacaaaacattcatattgtagaaaatttggaaaattcagaaacacaggaaagtgaaagaagaaacaaatatcacttgtaatctactcagagaaaaaccacagtgaaatttcatctttccccgaatgcaaatatatatttaccatgtgaatacattgtacagtatgtagcatttctttataattttttttttgtttctttagttgggtatgtttttgcattcggtgtttttggccctcaagtataggttgaatcagacccacccattagttcatgacacatcatcctcatgggtcctgtcaaggcctctcactggtttcagttttttgttttttgttttttttgcctctccacctcctgcaagagaaactcactctaatgaattcaatatatggctttaaatatgcctgtaaaatgttcagtatacatgatgaacttgtgctatatcttcttccctctttgttcttgttttccctggtaccgtgttttttaggatctatctacattgctgtattaaaatctagttcattgcttctgcctcctacatgtacttttataacttacttttttgcttcatgttatatcatatgatgaaataatattttcatgaaagttttccatgtcattaaacagtcttatgagaacactctttgaaataagtgcataatagctgtgttccaggaaccttttaaaggccattggctcaggtgaggatttagggaaattgactggataactcatgacatctagatttggaatgctgtgattctaaccacttgctttagatgtgcagcttggactttctccttcttttgaatcaccatatttggcaaatacattgttggcaacaaattataataacacctggtaatatctgtttggcctctttcttctcacaagctcaaagctgtaccggatgttatcttacctagttttgaggcagcctgtaaggcagggtgtggtagggagtgtactgactgcctcacagataaagaaatgaaggcccacaggacttcacttcttcattatcacccacaggatgatgatgcagagactgggacactgtcttcctccagtgtctggtgcctgtgcagcagagacgggggtgagaccctacatgttagctcatctctaaccaccagcccacagttgggtgtgtctgggagagactgagcagttacctcgatgagacacctttttccacatcgaatcagattcgtggactcattgcatgcttttgccctaaacctgtccatccatcagtaaccctttatatgctgctgtcagtgccaaaagctgagaatggtaaaggatgtgcttttggaccactccctttgtgatgggcgcgacatagtccctgtcctgtgggaactctagtccaaaggggaacatggtctctgctctcagagagctgtaggcagatagagggaagcaggatgcacacctacagacagcatccacatattcaccaagaaatcgattagtggatacatacatgaaatattactgagcatgtcctaaaataattgggtgttttgaggctagcagggttctttagggtatgaagggacaatgtttcattgaataactcagaattcctggctgcctaaggtaactctccccttgtgtgatgacagttcttttttgagggtggtctggacgagatggtccaaaccagtgtgtgcctgggaggggggaccttttcttactgagtcagaaacttgagggcttccccttcccttccttgttctggctgtaggtggacacctgtataaatgaggatgttgagagcttgaggaagacggtgcaggacttgctggccaagcttcaggaggccaagcggcaacaccagtcagactgtgtggcttttgaggtgagatttgggatttggggagaaggtgccctaagggatgggctactgaacacaggtgccagtgatgtctcagcttggacttcctgtctttctggctgagtgccacaaactggaaaggcaaggctgtgaagcctggaacgcttgtctgcttttccctctcctggacgtttacactgtttactgtccaaggccagcccatagttcaaaggtcagctcgggattctctgctctgatgagtttgagggtggtgcccatctggggcagccggtgattcagaagtcatttctgtctgtgtcgtggtaagaatccctgggctcttgagactccgtgcaggcaaggactgctgctgacatgtcacccccgagtctccagtgtctggcgcaatacctggtattagataggtgcttcataaacgtggactggatgagtgactaaatctgtgttgttgtagaaagaactgtacccatcgagttggaggatttgggctctaaactcagctttgctatgcagagctttgtggtctggaatgagtatctttttttcactctgctgccaagctggagtgcagtggcgcaatcttggctcactgcaacttctgcctcccggattcaagcaattctcctgcctcagcctcccgagtagctggtactacaggcatgcgccaccatgcccaactaatttttgtgtttttagaagagacggggtttcaccatgttggccaggatggtctcgatctcctgaccttgtgatccacctgcctcagcctcccaaagtgctgggattacaggcacgagccaccatgcccggcctggaatgagtatattaattattgttataatacagaaatctataaatggagagtaaaagccccctactatatgtgaggtcttccatattttctagaaaattctttgagtataaaacaaggtacatgggcagttttctttctgtctttggagacagggtctcactctattgccaggcttgagtgcagtggcatgatcttggctcaatgcaacctccatctcccggactcaagccatctcccacttcagcctcctgagtagctgggacaacaggtgcacaccaccatgcctggctaatttttgtgttttttgtagagacagggtcttgccatgttgcccaggctggtctcaaactccaaggctcaagcagtctgcgtgccttagcctcccaaaatgtggggattacaggcatgagccaccacacctggcccatgggcagttttccaactgctctgtgtgaggttaaccatctgttacctgcttttgttcttccacaagtaatgtattctttgtgttataaatatgttatgatagggttatagcctgcctaggcatgctaggagctggtaaaaagagaaaggccagcttgaactcttcattttcatggaactgagaaggagaatttttgagaagaggcttggcggtgaggaggaagggcaccaaggatgataaactgcttctatgttagccgaagtattatttgaacaagtagtttaacctctccaagcatctgtttcaacttttggaaaaagggttaatgaaatacaccttacaagtttgttgtgtagatcgagtgaggtaatatatgtgagggcactttattattctgaagggttttagaaatataaaatagtctatatttttcttagcaatcagtttaacaaggagattttcctattttaatagcttggacttagggtaatattaaaattagtttgtcatctcagaacaaagtagctgtgtggtgaagaggtatgttgcatctatttcagattccacaatttgtataatttagttggtgatgtatcagttggtgaccagcagtttcctaccttttccaaacaaaacaggaagaaaggaaggttgaggctctagcactgaccaggttgtgaattttggaaaaaaatttctgcactgagagacattatgaagttgtggaaattatagaaatatttgctggttttaatcacacatggaggagtctgccgctctggatttcagagcctgagcaaaagtgccctgacagctatagcccactgcccagaatttagaaggggttatttttcttaaccccatagtatgcaggaccacctgcagcagtaggagatgcttcttcttgctgggcgctgtggctcacacctgtgagccaggaggcctcaggaggcctcaggaggccaaggcaggaggatccttgagcccaggagtttgagaccagcctggccaacatagatctcatctctacaaaaataaaaaaattagcctggtgtggtggagcatgcctgtggttccagctacttggaaggctgaggtgggagaatttttggagcccaggaggtggaggctgcagtgagctatgattgtgccactgcactctagcctgggcaacagattgagactttgtctaaaaaataataaatatggtacataaataatttttttttttaaaaaaggaggtgctcctcgggtcattcccactgttgggctaggttggcacacctttttataattaagaggttcccttgcgggcagggttggctggagctacagagtcaaatgtggaaggggagtctattttttttaaccttttgctccgacagtggggtgcaagaatcagaccatggccttattaacactgtgcttgagctcacatcaacctaggtgcagtgtttatttatgtacagaaatgtacataaataaacataaataaatgtacataaataaaatttttttaaaaggccttacttttaagttcctgcctatggggatggcctatttcaggttaatatgggtcatatgaaggcttgtctcagtctctcctagtgaattggactccttggtctacttttctgaacctatgggtaggaaaggcaagatgatcaattaccatgaaaataacttgccattaagcatgggtttcctgttctactggctgcttgctgtcaagaaggatttgcagtgagagtgagtttgctctggacatggctggtgtgtagcatggacacgtcccatcacacatcacctgtgccgtactttctcctccccagttctgaccttgggaggggctggacgaactggctgctgatgttctgttttcccagggctggctgctaggctttccagaagttacctggattcttttttaataaatgatgagcagtcagtgtgaggcacctgggaagcactgaaatggatggtgaagtatctgggtgctagcactggctgtcattcactagctgtgtaaccttgactaggtcagttgacctttacttgttaaaggagagggttggattagaagaacgtcagttccactcattattttattgagtagttactgcatatgaggtactgtgggagctctggaagtgtaatggtgctcaggtctgtgccatcaggacactgacagtctacttcggggtgcacagagtgactgggcaaaatctgttcaatgctatgagagggaaggccgtgtgttccttgtatgtcctctccctggacacacaaaggaagggctcctcccccaggctctgaaggctctctggaagaaggggcatctaagtgagacctggaggatgagtaggagttggaaagatgcaagttggaagaaaggaggcaagttctttgctttctcattctaacattctgcttctatcctctaaattggtttctcatctctgataaaaggctcactcctgtaatcccagcactttaggaggccaaggcgggcggatcacctgaggtcaggagttcgagagcagcctgaccaacatggataaaccccgtctctactaaaaatacaaaattagctgggcgtggtggcacatgcctgtaatcccagctactcgggaggctgaggcaggagaatcacttgaacccaggaggcaaaggttgcattgagccaagatcgtgccattgcactccagcctgggcaacaagagtgaaactctgtctcaaaaaaaaataataataataaataaataagacaaattcttcctgatgcttagtagcccttccaggtgccattttggctgttgtgtgtgggctctattgctggaagtgagaggggaggtgttgaggagacagaagaaaggaactggaggtatcctccctgggattatttgcttttgaatttgtaggaaagccacaacattgggttaagcttgggtggtggtggaaggttcatggggatgttgaaggagtcacctatctgaaaagtggtgcttgtgggttccaggtgtcactttaaagtggacctcaatcaactgtgagccagttaaccctggaaatagacaccctgctggagtgctgaggtggtcctgtgcagtgaaggggaggtggtggtgagcccatcagtgtcaccacctttctcccgtcatggctccagagccgcccaggttcctgggttcttttctaaggtttttttccatgtttgctcttttttccacaccatttaacatattcctgctccgtgttttaggtcacactcagccggtaccagagggaagcagaacaaagtaatgtggcccttcagagagaggaggacagagtggagcagaaagaggcagaagtcggagagctgcagaggcgcttgctagggatggagacggtaaccgggggatcttgcttgtcagtgcctggactcctgggctggaaggggcctgcgggtggatcgaaacggttgccgagacccttcttttccaagcctctccagaaaagcacacttcgcaccttcctttggcagatcccttggaatacattttagccttcaaggaattagcctccccctaactagagttgatcctatttccacattagattcctgtacagatgccccttttgaagtcctggtttctcagggactggcagccatagctggcgagtgggcctgcatgatgcagggctgggttctgcctcagggcagctgggtgaggctgagtgagagtgggaagggttctcctcatcaagggatggctccccatcaaaccagctcatcttgctgctctttggcagctgtccaggcccagtaggggctgagtcccagcctggcgcccatcttagcccaaacgcagaaactgttgccatcttctcatcctagattttcttttgtggcccacccaggagcatcaggccttactggcgaaagtgagggaaggggaggtggccctagaggaacttcggagcaacaatgctgactgccaagcagaacgagaaaagtaagggcttggctcttgttcacggtgaagttgggttgcagggaggggagggcaggccatacagcctgttgctcctgtggtggcctggtctggggaggaagctggtgctgatgtcagatcttccagctctgactcaccgtgagcttgctcagggtggagccccacccaagagataccatttgggaggccgccatctccagggagttcattttccatggggtaataacctaaagaaaaggctttcacagttttagagccaagggcaagcaagagctggtggagcatctgctgttgctgtgtgtcattccacagattagtgcagtggatatgttatgccttcgtttcctccccaccgaaacaaaaattgactgtaaactgtttgagggtaaaattgattaacagtcatgctgatgaaaaatggaatgagcagcttcatgaggagatactgaacttcctgttacttgaagcaatgcagatagaaactgagaaccacctgtcagcagggtcccgtaggtgatcactgagatcctttctacctccaaggtgagagggttttgcaaattccctctgatcagaggaaatcagaggccccagacaaccaatgaagcctacagagcaaagattgtgccttctagaacttcaggaatttggaaattatgctgttggcaattaataaataagacctcaaatggtaaatcacatttaacatcagcatatttggtttgatcttcattgtgtaaggtggaccttttttagttcaacaagacattatctgaagggccttttaaggaattccaagatgaacagacacaattcttgcccttcagggcccctcagtcttggaggcattttctctcctttaggataacctagatttgaccttcctggcatggaaaatacacgtgtcatattgtagcctcctttctgactggactttatatcagaattaatatcagaattagtcagcactccttcctcggtgggtaggtgcgcatgggcagagcaagagagaccaaaaggactagataatcggaagccagggtttgggaatggcagtgacagctgtgccatgtacgtgctgattttctacctaaaaggagactgagaagtagggcattggagagctgaaggtggaaatttagaatgcttggagtttaggaaggataaggggtagctcatgttgcattgtaccccaagcagcatgcgcttgtcagcttcctcaggcagaactggggagtgatggattcttcaggggcccaaaccccaggatactctcccaagtagcctgactagaagaagactgttcctctactcctaacacttcttacaccaaatatgtgggttttccataccaagcacttctccaattctcaattgataccagctgggcaccctacactttaattcaattctgagacgacccagagttagtgcagaaccacagattaagggccagtcctgcaagactgcccctgcttcagatgccagtcacaagtagtggggtctagggtacctacacttctgtccaacttggctataaattgggggttcccatatcctcttttcaggtttgataacttgctgtaatgggtttgctgtcatagaactcaggtaaacattttccgtatttatttatttatttttcgagacggagtctcactctgtcgcccaggctggagtgcagtggtgcaatctcggctcactgcaacctccgcctcctgggttcagcctcagcctcccaggaggtagctaggactacaggcgtgtgccaccacacccggctaattttgtgtatttttagtagagatggggtttcaccatgtcggccaggctggtcttgaaatcctgacctcaagcaatctgcccgccttgacctcccaaagtgctgggattacaggcatgagccaccgcgcctggactacttatttttttaatttaaaaagtttttcattgacacagggtcttgccatgttgcccaggctggtctcgaactcctgggctcaagcaatcctcccacctcgccttcctaaagtgctgggattatattcatgagccactgcacctggccaacatttcacttattactggcttatgataaaggataatataaaggattcaaatgaacaaacagatgaggtacatagggcaaggtcagcaggtggatgcattaaccaagctggaagctctgaacccctttgtttagggttcttgtggcggttcattacattggcatgattgattaaattattggccactggtgattagtttagtctctagctcctatcccctgtccctttcccagaggctagggggagttgtggggctgaaagtttcaaccctttaatcatgccttggtcttttcactagccccatcctgaagctatctagggaccccagccaccagtcatcattagcatacaaaaagacactcatcagtcttggagatgcaaaggctcaggaaccagggaatgtgaccaaatataacaaaacataggtgctgtatgtcaggaaccgggacagagacccattatatatttcttattattttacactgccctttgggggatcttggctcagtttgcttagaagatgcaaaggaagcaacagtggtttgggaatcaggagacctagaaacaaaattgtgtgaagaggctttaaggagcctcaaattctgtctttctcctccaaatccctgccaacagcttgatggtgttgagtataataatcccagctccaactgggcatggtggctcacacctgtaatcctagcactttgggaggccgggacaggaggattgcttgggtttaagagttcgagatcagcctggccaacatgctgagactgtctctacaaaaaaaatttttttttagttagccagatgtggtggcatgtgcctgtagtcccagctacatgggagactgaggtaggaggattgcttgagcccaggaggtcaacctggcagtgagccatgtttgcattattgcactccagcctgggctacagagtgagaccctgtctccggaaaaaaaaaaaaagaaaaggtcggagagggaaatcctagcttctacttgaatctttccagtaacgaggagttcattacacatgagactggccactttctgacagctttaatactaagaaagtctttcctgtgttaatataaaaacagcttccctggaaccatctacctattgcttctagatttaccctccagagttatccagaatgacttatcccttctaacctttccgagcctcagtttcctctcttagactaggtgatccctgatgatgcttccaatgtaatattcttttttttttgtgagacaaagtcttgctctgtcacccaggctggagtgcagtggcgccatcttggctcactgccacctctgcctcctgggttcaagcgattcttgtgcctcagcctcctgagtagctgggactacaggcacacgccaccacacttggctaattttagtattcttagtagaggtggggtttcactatgttggccaggctggtcttgaactcctgacctcagtgcttccaatgtgatattctaaggtacccaccacctactcttcagagcagcctaccggggaatcaggcaaagggaatcatattaatgggaacctcccaagctcaaggctcttcctgtgactgggtaaataagtgatcttgttccattgcctcagccttctggtctttatccccagggctgctaccctggaaaaggaagtggccgggttgcgggagaagatccaccacttggatgacatgctcaagagccagcagcggaaagtccggcaaatgatagagcaggtaagttgggctggtttgtaacctgccctcggggagtcaccccaagtctatgctcttatttgtttcctagggagcttgacttatattcatgcatttcccatgtcaaacatttatagctaccaattaccaggttcaggttattaggatttgcttttctcccatctttcccctactgttttgtttgtttgtttgccatttggcctctgctttccaataggaaaggaaggaaaaggttaatttgtcatatactctgtgaagagtgtgggtaaatgagtagttgagtcataataaactctgttatctgtgcagattatcagtctttgagcctcatggctgctttcctgccttaccccacctgagcttgagggtagcatacttaggatttgtctatttgcagaattgttttgagagcctaaggccccataactgggaggctgtatgtgcttcatgtcagctccattagtgtctgttttatttagtgctgttttccattatctcgaacagagtcagtcatatagtaagtactcaataaatatgtcttgaatgaaaaaataatttgtattttccaaagccatatggaatgggttttgtcattcattattttggattctcagggtggtattcccctcacacactcctcactcccacccctgggataatcaagagtctaatattgactgaaaggaggcctttgtagaaaagctaatgaagtcatatggagttgcagggctctgctgccttccccagcagctggggtgaagtctggtgagtgtgtaatgagtcattgcaaaatgagctccagtgtctcccacacctttgcagctccagaattcaaaagctgtgatccagtcaaaggacgccaccatccaggagctcaaggagaaaatcgcctatctggaggcagaggtgtgtgtgctgggcagcccagcaggggaacaggactcttgaagagaaggtggacataagggagacagaggttatgggaggggtctttgtcattcttgctgttgctctgaagtgaatacctagggtggttggttgactttcagttcagctgaataaacattttctgagaaccttcaggaagctgctaacaatgatgagatgaccacccccctggccccaccttcaacggacatgtcatcatggtgcaagccacatgccatggctgcacacggctaattctgaccctccaggctttgcaaaggagctggcagtggtgctgggctgtgaaggaggaggaggcattcatacagatggagccttttccagggctagattacgtaacgagttgccttcctagtctaatttccactttgccacagggccctacctgtctgttgactacctgaagatcactttgcgaacgctctgtgaagatcccctgtagtgagggagaaaaatgggagaaagggttatctttagagagtttgcagtctatagtcagagataaaatgtgtatttttaaaaagaccaaagaatgctttatagaatagcgtatcaacaaaggcaagtgagtatctcaactgaggacaaaaaattatatataggggccaggtgcagtggctcatgcctgtaatcccagcacttagggaggttgaggcggtaggattgctcgaggccaggagttcaagacctaggcaacatagtgagactttgtctctgaaaaagaaaaaatttttttaattaaccagatgtggtggcatgcatctgtagtccagttacttgggagacttaaaggagaggatcacttgaacccaggaggtcgaggctgcagtgagctataatcacgccactgcactccagcctgggcaacagagtgagaccctatctcaaaaaaaaaaaaaaaaaaaaagaactgtatgtagaggacatataggaaaccatcagtctgtcagtgttgtacagagttatggaggagcaggtattggaggataagcgcaatctatggtaatgaagatgaggcaagtgggtatccaggtggtggcacgcatggtgggggtagaggcaacagcagcataaacacaggcagagagaccagaatgcactagctgaacgtggcacccgggaagccagaaaaaggccaactctaacccctaagcttgtgttacagaatttagagatgcatgaccggatggaacacctgatagaaaaacaaatcagtcatggcaacttcagcacccaggcccgggccaagacagagaacccgggcaggtgagtgagcgtgtgtagatagaatggggccagggaggaggggagaaggagggacagagctctgtagaacctttagtgctaaggcaagaacaaggctcctttaaatccaactttcctccctcagtctgacccactgtttgccggaaccattttctagcccaattagagtagaacctgttaacacaagcccagggaggtccatgaatggcttctagagatgtatgaaccacctgaaatggtaggaaaaatttagttataatgtttgcatatttctagggagagggtattttgcctctaagagattcagaaaaggacccatgatcttgacaaaatcgagaatcacagctatatccacttctcagttgtttaactgcccctctcttttcttcacccttgctacaagacacatgtatcatgccccaaatcttcccctagttgtcactgataattactgttttaaagcacttggaacccaagtgatcagccagcactgcagtgtaagattccagaggccaatgtgaagattccaggggctctgtgaagggtgggccacaacacagctgttcccagcacaactcagtgtttccaaccttcttttcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttgacctcctggtctggtttcctttcacttttcagggaggatgaaagaagaacattttagtgcttcttggaagatgggcaccctgttatccacatgtgggaggtgtggtccaaacatcccaaatgccatgatatgaggactttgtggcatttatagaggtattagaagaagctcacctccgtgctctgagtcgtgattgtaggaggcagcccctaactttagctttgaccctctctggagcaatggccttgtaggatccctaagcctggccgcattgtgtctcatttggaagagatagaggtagagtcctgtgattacatagagatagaacagcagcactggaggtagatgagtaactgcatgccttctgcagaaatgaaaagcactctggaaatgctgactgcagctgttcaagggggttcgtttctggctgtctctgggcatcattcaattagtctcatgattttttttttcctttctgccaagaaggcagttgactgcagggccaaatggggacatagctgaatttacatgaatcttctctgggccaaagaaaccagaaacacaacaacccctcatccctggcttgtttcctttctagctcccatttctcttcttcaattgaaagagtgtacatttttctctgatttcttcccccttctcctgcttctcagccaattcacaccacaggcttcaaacacattggaaacctctttcctttgcagacccggatttgtcttctgacacccgtggctctcttctttctctggcagtcttgtttggcatggctagatctagactgtacttgctcttagaatattaacagggtggaagcagggcggggttgaccaaggtgccaagaagactcacagggctggaggaatactggagtgagtgtgctgccatacatgaaagggaggctcccgccgggcctcctgtgctcagtgggaggaaccaagatttgggttgcagataatggagcagtctggaggcattccagagactcgaaccaggggtctaagagagtccttggacaaaaacatgccactggtgtatatttcctagagtttagttatgccacaaccaaagagagtaggggcatgacacaggggagcggggggcacaggtttggaaagggaatgtagtcagggaaatacagtttgtatcttggtgatcttgtcaattagagacggagaatgggggactggaggagaatgagatggtgttcagggcctaaagaaaaggtgtggcgagtaaggctcttggtttagtggcctgtttattgcctatgttttgtcatttttaagccaactcctctgtgctgccttaatattttgtggagggaggatagagtctgattccctgggacctctgccatgaaggcctgtttctttgagctgggtgttgagagctgctcagacatgcagccgtcatcaacagtgtcctgtaaacctggagcgtcagcccagcacgggaaaagaagcagcagcaccctgcctgccgaacaactgccccatcttccccatcttcgtctgttctttcccctgcacagaaaaaagcctggcagtgacacagtatttcaaccaaatggtgcattggaacctttttcaaactaaatttctaaggccaagaattgattggctcattttcatctctatttaaacgtaccttttgctatgatatgtcccactaggaagtgtttccactttggaaaggaaaggtgctctgacatggcaggagttaaagcaacttaattaggctgggcgcagtggctcacgcctggtatcccagcactttgggaggctgaggtgggcggatcacttgaggccaggagttttgagaccagcctggccaacacagtgaaaccccgtctctaccaaaaaataaaaaaattagccaggtgtggtgtcgggtgcctgtagtcccatctactcagaaggctgaggcaggagaatctcttaaaccccagaggcgtaggttgcagtgagcagagatcgcccactgcactccagcctgggcgacagagcaagactccgtcacacacacacacacaaaagaaaagcaacttaatttgaggagggtaacagcctttgggttggaaaagcaagcagctttccctctttaaccagctttttagtgtgtgttgctgttttctgcagggcctctaataatcccctggcttcctcattcctgagagccaagcatcactgcgcttgggcctgagctccttcaggctatgactcaacaacaggtgttagcctagggcccttggcctcttttttcatatttcagtttaagactttagctttgcaaggagaaattgtttcctgtcttccctgtccaagttctaagcaggatggccttgaaactccaaagttggagacctaaatattctctattccctctttctccaaggaaaatccatacccaggctgaagataaagatgtttcttaaaggtaatttctagcacagcatgctctgtagcagtgagacctactttaaacacaaaatgtgtgtggcctttctgctggaatttctcttctcctggagccccctgagacacagaattgagggtagatagtagcaggataattaatttcctaaaaggtgttggtcgccaagtcttagaccacaggacctcagacagctgagggaaaggaagtcatgagtactcgtgacttaatctatcaattcagtgctgattacacacccagcccttcctcccactaggattccaggcccaaacttgtatatgtctgcaggaattttatcctcctatgtatgttttgtttttattttatttatttttttgagacagagtctcactctgtcacccaggctagagtgcagtggcatgatcttggctcactgcaacctctgctatccaggttcaaccaattctcctgcctcagcctcccaagtagccaggactacaggtgtgtgccacaatgcctggctgatttttgtatttttagtagaaacacggtttcaccctgttggccagactggccttgaactcctggcctcaggtgagctgccctcctcggcctcccaaagcgctgggattacaggtgtgagccatgacgcccggccctgtgtctgttttatatctgtccatatgtgcttgtgtgtgaactggcctgctatgtacaatatatttcttactgtgggaacaaatctgaagaacactggcttagaggacagacctctgtccttggctgtattgtaatctcaggatcgaggtccaaaatggacttccttccaaactgctccctgtccctttatcccttatatccagtttgtcaacaggtcctcacgtttcctctgttgaaatatctctcaggggctgggcgtggtggctcatgcctgtaatcccagcactttgggaggccaaggcgggcagatcacctaaggtcaggagttcaagaccagcctgaccaacacagcgaaaccccatctctactaaaaatacaaaaattaactgggtgtgatggcgcacgcctgtaatcccagctactttggaggctgaagtaggacaatcgcttgaacccaggagtgagctgagattgcgccattgcattccagcctgggagacagagcgagactctgctaaaaaaaaaaaaaaaaaaaaaaaaaagaatatatttcagaagtgtgccttcccatgttgacagtctcaactcatctcttgaagcctagatgaccactgaagccagtccttgctgatctctacctctagcctcttacctgccccacatctaccctccccaccactgtcatttgaatcttcctggaatgcagtgttctttctgtcagtcagggctatttagccaggacaaaaggaggatgatagcagtttccaaaaagatgaaggttggtctcttgggaggagcagcagcagttttgctccagagggcagaatctggatggtgtggggtggttgcagggagatagccaagaaacaaaagaatccattgacaattcgaggagggtgggctgtcttggcaagtagcaagttttcctacacacaccagcagtatctcaattagaaaacaacataaaatataacaagagatagaaaatacctaggcataaccttcatttgaaatgtcaatgacctatgtgaagaaaatgaccacattttgtggagaaagatgggaaaacaatgaagaaaaattttcctggatggaaaattaaaattgtaaagatgtcaattctttatttttaggctttgtgtaattacagtgagttacattgtaattcaatagagtctttttagaactggatataattattttaaaatttcatctggaagaataaatgggaaaatggtaaagaaaatttggaaggcagagctaatttgggaggattattagccttggcaaatagcaaaacattatatagcttatacatcaatttaagagactagctaggcagaaatagactcaattatacagtataagcatttaaaaaggataaaagcagcattgcaacttaacggggaaaaaggtatttgaacagttggttaaaaatttgggaaaaggctgggcgcggtggctcatgcctgtaatcccagcaccctgggaggccgaggagggtggatcgcctgaggtcagttcaagaccagcctggccaacatggcaaaaccctgtctctactaaaaatacaaaaatcagccaggcatggtggtgcacacctgtaattccagctactcaggaggctgaggcaggagaattgctccaacccagaaggcagacgtggcagtgagccaagttcgtgacactgcactccatcctgggcaacagagtgagactccatctcaaaataataagaataataattgggaaaaagaaactaaacagcatacctaaattctatataaattaattaaatattacaaattgtagaaaaactacaagaaaataaaattgaatatcaaatccaaaaggaaatacatttagaatgttagtattgaaggtcatgaaggaacatatttttagttcataaaaatgtaaaatttctgaattaaactaaaggcccaaagaatgaagaattattagtgacaaatgtggtgaacaggcaacatttttattgatcagctcaaacaaattgatacaattactaagattttactagatcagtggtcaggaaaagaatagttcatcaaaaaattcatattctggccaggcgtggtggctcacgcctgtaatctcagcactttgggaggccaaggtgggtggatcacctgaggtcaggagttcgaggccatcctggccaacatgatgaaaccctgtctctactaaaaatacaaaaatcagctggacgtggtggtgcgtgcctgtagtcccagctactcaggaggctgaggcaggaggatcgcttgaacccaggaggcagaggttgcagcgagctgagattgtggcactgcactccagcctgggtgaccgagcgagactccatctcaaaaataagtaaataaattcgtattatttttaatgcacatatttattaagctcctgctctctacaggccaccgtgtctttgaccaaggattcaggtagggacacagcagcgaacaatacaactttgctcttgccctcaaacatcttgtgttaggtaggataacatgggctaaaagttggagaaaatgtgactgcaattggtttaaacaacaaaggaccagtgtttctggttgaggtgacagaaaagttcagagacactttagactcaagtgagcctgcatagagaagcttgaggtctcaccaaatacccagcttcttttcatttcttctctctgcagaagaggtttgttgcagtgcttattataatcatataaaatgggaaacaacatgtgtccaacaatagagaaatgggtaagtaaatgaggatgcagtcactctgggacattatgcattcactacaaatggctgttatgaagactatgtcgcatcagggagcagtgcttagaatgttaaatgaaaaaagtaggacacaaaattttatgaacatttatgacagctttgcaaaacaaaatgtttctggaaagcctagaaataaatatacctaaatgctaatcatgttagcggggtgggttttgcctttgtttttgtcttctgttacctttattcttttatctaaattttctagagtgtttactctctctccagctaggctgtgttctcactgccttctgcacatactgggatcattcctgtctttgtacaattgctggtgttatttcttttaccagcaatgccttcctcttttgacctattaatccattaaatatttactgataatcgaatcaagggtattgtatagcttatgcaagataatgtatttgaaaacacttttgtaaagtgcttcacagatgttacttgttattgttaggtggaaaaagaggaggaggaggaagagaaagaacctattatttgcatgatattgagccaggtaccgtaggggatgtctggatggaaaatatagaacagggttgtagccttccagaagtttgcacttgtcagatggatgggagaaaaacagcagcatgtgaaataggtgaatagtcatggaacatgtgaaatgctaatatgagagaagggtggagaggctgtggagctagaactaggctccgaaggatttgggcaggtagatcggcaggaagaaagcttgagttggaaatgaatgtggcatatgtgggggatggtgagcccagctgaagagacctttgggaaagtggcaagagggcaaggagagacaaatggagtgggccttctgggaagagtctggactctaatctttattcttatttttactttattttattttatgtttgagacggtgtcttgctttgtcacccaggctggagtgcagtggtgtaatctcagctcactgcaacctcctactccctggttcaaacgattctcctgtctcagcctcccaagtagctgggattacaggtgcgcaccaccatgcctggctaatttttgtatttttgtaattttagagacagggtttcaccacgttggccaggctggtcttgaactcttgacctcaagtgatttgcctgcctcggcctcccaaagtgctgggattacagggatgagccaccacacccagcctggactctaatctttaaagtgaaaggtctccattagaggtttttgtttgtttttgtttaaactagtatgtaagttctgtcaaggcagggatttttcttgcctgtcttgttcaacactgaatccctagtatctagaagagtggcccctggcacatagtagatgcacaataaatattagttgaagagaagttggaatgaatgaatcactagagtgacatgataaaataagaaggctaatcccaaagaggcaaagagcatggattgaaaaggtaaaggctggcagcaaggaaacaagtaatagatgttagggcacctccaggcatgaagcaatgaggggctgaactgcgataatggccactggactggaaagaaagggactggtggtgtgagagtcactgggaaagaactgataggccttggtgactgaccaactggtgtaggagaaaaggagaggaaataatgaaagataacatcaaagaaagttcctcattcttcaagacttaacctgtgttctctttcgtgaagccctcccagaattctcaagcctgtgttgtgttccctttctgctcaacacagatcatctgtattaccctgttgtaggatgtcataatgtactgtcttccattataattcggactttgcatgtgtttgtttccccagagagactgcaagcttttaaaggtcagggatatctctaattccacagtgcctagccctaatagtgccacaaagtagatggttaatacgtgcttactgatttagaacaagtttattcaatcaagccatcctgggccgcgtcaggatggctttgaatgtggcccaatgcaaatttgtaaactttcttaaaacattgagattcttttgcagttttttttaagctcattgtctattgttagtgttagtgtattttatgtgtagtccaagataattcttcttcttccattgtggcccagggaagtcaaaagattgaacagccctgatttagaagaaacctgtatttttttcatcataaagaggcatttctgtttgtttttttttttaaattattgttttcattttctttcttagttggccctagggaatgaggaagagacagattctgggaccaatatcctccttacgggagagtcaaatgccagctattatcattgccatcagcaataaataatcttattcatgcattcattcacttgttcttgtattcagtcattcaacaataggggaatagtgtagcatagagtttaaggagttagcatgggctttggatcttgctcataatcttagatatgttactggccatactagtttggaaaagttatttaagctctctaagccttaatttcctaatctataaaaccaaaataataatgcctatctaataagaacatttaccaagtgcttacatgcactgtcatttaatccccattttacagatgagggattgagacatagtaagtcacttgtccaaggatgcacaggtagaaagtgtcaaaccagttctaggtcataggtgattcgattccagagcacttgtgcttagtgccatgcctgacaatctcatgggtgtggcagtggccagcacaaagccatatgaggggatcctatgtggcacgtttggcatgtagcacatgctaaatatgttaataattgtcaataagtattttttggcccagcacagtggctcatgcctataatcccaacattttgggaggccgaggcgggcattttacctgaggtcaggagttcaagaccagcctggccaacatggtgaaaccccatctcttccaaaaatacaaaaattagctgggtgtggtggcatgtgcctgtaatcccagttactcaggaggctaaggcaggagaattgcttgaacctgggaggcagaggttgcagtgaactgagatcacgccatcgcactccagcctgggcaacaagagtgaaactccatctcaaaaacaaataataaataaataataactaaataaataattttttttagcattcaatgtcagagaagatatagggcatggctttgaggatgtgaagaggaaaagatacacagactctgctctcaagttgccaccagtctagtagtgccaccagacactggtgtaaaccaaaaataaaaatctaagcctccccaactatctgaatggacccgtcttctcagccaagggcattccaaagttaacctgaaaaactagttcaggtcctgattagaagcaggagctggacatacctcatcataaccctcatcccttttggaattactgatggaacagactctttaagtctgataagaaacatttacaatctattgtttctgaagcctgctacctggaggcttcatctgtatgatagaaggttggtctcacaatcccttatcttgactcagatattcctttctattgattctaattctattgattcctgacatagcactcaggagatcctgagaacatgtgcccaaggtggtcaggccacaacttggttttacacattttagggagacataaggcatcaatcagtacatgtaaggatgtacatcggtttagtaaagaaaggtgggacaactggaagggggttgggggagcttccaggtcataggtagattcaaagcttttctgactggcaattggttgaaagagttaagttactgtctaaagacttggaatcagctgggtgcttacatgtactgattgatgccttatgtctccctaaaatgtgtaaaaccaagttgtggcctgaccactttgggcacatgttctcaggatctcctgagtgctatgtcacaggccattggtccctcatatttgactcagaataaatctcttcaaatattctatagtttgtctcttttcattgacacttgtatgccaagaggcagacaatcataaactaccactgctaaaagaaaccttagaaagcatccgatccaactccctcatttgacagatgagtaaaccgaggcccaatggcgggggtgggggagtgaattactttaggttgaaatttggacaaaaatctagatctacactggagtgcagtgtccttgacctaaggaaagttcaaaaagcggcagagagatggtccctatccgaggcctgcgtgcacttacaaagtagcttcctggggaagcagaagcggtttggggagggggcgggccaggggagtggctgacggggagagctcagcctttagccagaccctccgggatcccctgggatcacttggctcactcgagtacacaacccttttgcatcttgtgtacttctaaatttcaaatggtgacttcctctcccttccctgtcttttaataagggtgtggggtagcggggagattctattcctgtctacttctctaactgttgcaggttcttagctgaaggacccaatctctctgatcctcaggctccttcaaaacaaaacaaaacaaaacaaaacaaaacaaaacgagaaaccagaaaagtaggggatggactaagttcccttttagctctaaaattccatgggtcttcggaggggaagacaatgctttcagagcacgtttagccggtgaacctgaaaacgaggatttttttcatttgcgaagtggaggtactcctgcgcgcccaggatgcagccactagagggcagcaagtcttccagcacctgtgcaggtggccgccgccgggccccacaggaagacaagcaagttgtctcttcagacctgcctgggtctctgtagttttcatgttgtaaatcctaaactcagttctttagcaaagagcagccagccaaattaggatgagatgagggagccattttgtaaattaggcctagcaccagaaggataaaaaaagaggcctaaaaagatactggattctaggaaagcaaatattttatgaaaaattgaaaatgtgtccgtgtcctagtttagtctgccttacagctcacatcatcagaggcagagttttgagaagaactgggagcattttaggccggctgcagtggctcacacctgtaatcccagcactttgggaggccgaggtgggcggatcacttgaggtcaggagttcaagaccagcttgggcaacatggcaaaaccctgtctctactaaaaatacaaaaaaattagccgggcatgatggtgcatgcctgtagtcccagctacttggggggctgaggtgggaggatcgcttgagtccaggaggttgaggctgcagtgggctgagatcgtgccacagcactccagcctgagtgacaaagttaaaccttgtctcaaaacaaacaaacaaacagacagacaaaaacaaaaaacaaaaaacaaaacccaaaaaacagaaaagaactgggagcattttaagactggtaaaaattttggtagactgaaaggtgattgaaaaaaaactaatttgtaaggctcatgtgttagaccagcttttcctagagttccttgggaagtttcagttcattttgctcatgcttgtttgtttgtttgtttgtttatctttgagacagaatctcactgtgttgcccagactggagtgcagtggcgcgatcttggctcactgcaacctccgcctcctgggtttaagtgattctcctgcctcagcctcctgggtagctgggattacaggcacgtgccaccatgcctggctaatttttgtatttttagtagagatggggtttcaccatgttggtcaggctggtctccaactcctgacctcatgatccacccacctcagcctcccaaagtgctgagattacaggcatgagccaccgcgcccggcctgctcatgtttaataagcccttactcaggaagaattggttctggaagtttccagaaagtccaccaaaccatacacttattttttttttttctggagaggatgaaataaccagaattattacatatccactgaataaaagagcaccaacctgggctccttaaggggataaaaggaaggacaggacaggtacagtggctcacacctataatcccagcactttcggaggctgaggcagatcacttgaggtcaggagttcgagatcagcctggccaaaatggcaaaacctcatctctactaaaaatacaagaattagccgggcgtggtggtgcatgcctgaatcccagctacttgggaggctgaggcaggagaatcgcttgaacctgggagacggagtttgcagtgagccgagatggcaccactgcactccagcctggatgacagagggagactctgtctgaaaaaaaaaaaaaaggtaggacaggaagctcagtgagggtggcaaggagggctgggtgctggcctggctcatcctaccatgatgaggtcaagtggccccttcacctctctgagtctcggttccctcctctgtcaaatggcaggttcttcagagctccaatcagcaataatgacatttcaaatcaacgcaacttcccaaaagattccagatgacctgtccaatggcctttccaaatgtagaaggcctggatcccttgagaagacagttctcactagcagattataatcttgtagaagatctagaacactcatggaacaaagacttaaggatatcatcttcatctagaaaaatagtgttgcttactcagcagcaataggactagaacttcaatttgtttttgccttccttctccctgggccacggaggggtcatggtcgggattaagctgcctgtggctttactcgttcagtctcatttctggacctctgctaccttgccagttgtttctgagacacaccatgtccttcttcacctctctgcctttccatgtgtgcttccttcggcctgaaattcttttccctgccttatccttctgagaagctcctagtcatccttcaaaaccccactcaaatgacatctgtttggtgaagtcttctctgactccccagagaatccccagacagagttaatcatcccttatcagggctcccacagcagctggcacaaaacttatcacaatgtacactacttgtttgttttcatgtctgcctctcccccaggcctgagaattcctaagggaaggggttgattattcatcttcatgtctgcagccctggcccagtgcctggcaggtagtagggacccagtcagtgctggcagaactgaagtaagttctccttcctgtaaccagcagagtgtttttccaggtggctgaccaggatcactgagcaaaagacaatcactccatgaggcagccctggggcacttgcctggcatcaggagctcaacgcagagaactgaatgctaatgtttaatgtttgtgcactggagggcacacatcattcaaaatttgatggaggctgtttagaatctattttaatcccagaagatgacatgtaaggagaaattttctgatagtgtgattaagctctgggacatgagttaaaggggtggtgggtgttgcaatgttgaaggtctttatagtctctgattttttcagaaaagactgtgtggagtgagtagctgaaatgtgaatagatgacctctgattttaaggttatgtaatgggattggataggtctcttgctcgctctgggcattggacatggtgtggggctttggtagcttcaggtggaatgacctggccctccatgaatgagtgttgaggttggacacacggctgccacttctctgtactgctccccacagcttagcctcatctgcaaacttcggagggatcagtccatatgagtacatatgtgttgtcagtaaatagacttttccagagctgccagtatcagctggtgctctgtgcttgtgcttctctttggctctctctgcctcctggtcccaaaggctcttggcgtggatatggggatagccagctgtattgaaaaaggatgactacacaacaaaagaagaaaggtgagggtcaccttcaaggggaaaggtaagtgggtgtcatggttgattccattccgtgctggggactcccttgcagggcgttccttgggggtggaattttttgacttgtgctttagtcaaaacaaccatgggtctgaggaaagaggagaggatggcacatgagtaggacagaagtgatcgctgaggctgggaaatggctgtcactcacatattaaaatagcccaaaagcccaacattagggttattagtgaaaattttttcaagtttagcacaatttttttgctctatatcttaaatagcctcaccattgtattaaacattttttatcgtggaaaaatatacataacataaaatttactattttagccttttttttttctgagacggagtctcgctctgttgcccaggctggagtgcagtggcgggatctcggctcactgcaagctccgcctcccaggttcatgccattctcgtgcctcagcctcccgagtagctgggactacaggcgcccgccaccacgcccggctaattttttgtatttttagtagagatggggtttcactgtgttagccaggatggtctcgatctcctgatctcgtgatctgcctgcttcggcctcccaaagtcctgggattacaggcgtgagccactgtgcccggcctattttagccatttttaagcatacagttctgtggcattaagtacattcacattgttgtgcaaccaacaccaccatctatctccagaactttttcatctccccaactgaaactctgaactccttaaataacaactctccattgcccactcctccttccctctggcaacagccattctactttctgtctgtataaatctggctactctatgaaccttatataaaaggagttatacaatatttgtcgttttgtgactagctttttcatttagtataatgtcttcaaggttcatccatgttgtagcatgtgtctcactgtttttgcttttgttttgttttttgagacggaatcttgctctgtcacccaggctggggtgcagtggcgcgatctcggctcactgcaacctctgtctcccaggttcaagcgattctcccgcctcagcctcccgagtagctgggattacaggcacccgccattatgcccggctaatttttgtatttttgtggagatggagtttcaccatgttggccgggctggtcttgaaatcctgacctcaggtgatccacccgccttggcctcccaaagtgctgggattacaagtgtgagccaccacgcccagcatgtctcactgttttttaattaaacaattttgataagcatgtcctgcaaaatcatatttattgaaatttctccatctgtagtttatagttggagggaacaaactaaagagaagtgcattgaatataattggctgcttgtccaactccatcctcccctgtccccctcactcccatccttctttgacccccggttttgttctggtattcactggcaagctcctcacactgggatgggtctactctttgacccaggggtaagttttgattagtttaagtcaatcatggcatttttttggccaatgattagtttagcagattatcatgtgatatacttttgtctcatgagacatgagagaaagctgatgcaaggctactggaaagggtttcttgcttttccaatagactcaggatgaaatttcctattttcccctctccctctccctctaccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactgttgtcctatgaccctgccaaatccccctctgcgagaaacacccaagaatgatcaataaaaaaaaaaaaaaaaaagaaatttcctattttctgcttctcagtgttgtggccatgtgtgttggtgatacctggagttcagcaagccatcttgccaccgtgagaggagttggccaatggcccagatgatacaccaaagatggcagaggggagagatgaaaaggaatctggatcttctacgtgaatgagtcactaaattaaccaactctgggggtgggcgcagtggctcacacctgtaatcccagcactttgggaggccaaagcaagttggactgcttgtgtccaggagttcaagaccagcctcggcaacatagcgaaaccccgtttctacaaaaactacaaaattagcagggcgtgctggtatgtgcatgtggtcccagctactggggaggctgaggtgggaggatcacttgagctcaggaggttgaggctgcagtgagccaagatctcaccactccactccagcctgggtgacagaaacaaactctgtctcaaaaaaaaaaaaaaaaaaattaaccaactctggaactctctacctttaatcctgacatttatgtgggaccataaatttctttattatttacacttttgaattttctatgcttgtagccaaaagcattctaaggacgtattaaagatgaaagctaaacaggaaccaaagcagaggacccaagtctcacacattttcccactggataatgccaacaatgcagaaacctcattggtctatttgttatgaggtctcctgatctattgtattatttctgtagtgttggtcctgggaggtaatttctaggaaaagggacccttggaaaattgagtttgattttaagaaaaaaaagtgggggaagtactggaaaagagggagaaacacagttaatagagtgacaattgcctagatagttgctgctggaaggatagtgaaaaatgataatgatatttgggagtggcctttgaagcatgacagtctgatgtagtgagagggcatgacagaaaaaaaagccagccagtgtggctgtaagagccagggaacttttctttttttttctctttgagatggagtttccctctcgttgtccaggctggagtgcaatggtgcaatcttggcttatcgcaacctctgcctcctgagttcaagcgattctcctgcctcagcctcctgagtagctgggattacaggcatgcgccactacgcctggctaattttgtatttttagtagagatggggtttctccatgttagtcaggctggtctcgaactcctgacctcaggtgatctgcccgcctcggcatcccaaagtactgggattacaggcgtgagccaccgcgctcagccaaagccagggaacttttcttcccaatgggaaacccagtgaacctcagagaggtgatgttatggcaaagtggaagacaggggcatgatatgaaggtgaccagggaaagggaacactacagctatagaatgctgatagagagccaacagaatgataattacaagctaagctgacataaattctccctcaagttaaacctgtgctgattgtattagctattgtttagcatctacccagcaagctttcttcttaggcacatgacctgggcatgggatccaggtttggataatcatagttcttctagaaactttatttatttacttattcacttatttaaagacagtgtctcggccaggcatggtggctcatgcctgtaatcccagtactttgggaggccgaggtgggcggatcacttgaggttaggagttcgagaccagcctggccaacatggtgaaaccctgtctctactaaaaatacaaaaattaattgggcatggtggtacacgcctgtaatcccagctatttgggaggctgaggcaggagaatagcttgaacctcagaggcagaggttgcagtgaggcgagaccatgccactgcactccagcttgggtgacagagtgagactccatctcaaaaaaaaaaaaataaataaataaaataaataaaatagccgggtgcggtggctcacgactgtaatcccagcactttgggaggctgaggcgggaggatcacgaggtcaggagatcgagatcatcctggtcaacacagtgaaacccctctctactaaaaatacaaaagaaaaaaaaaattgccaggtgtggtggcgggcgcctgtagtcccagctactcaggaggctgaggcaggagaatggcatgaacccgggatgagccgagatcgtgccactgcactccagcctgggcgacagagcgagactccatctcaaaataaataaataaataaaataaaataaaataaaataacacaaaataaagtcagagtcttgttgtgtcatccaggctggagtgcagtggtgggatcatagctcactgcagcctccaactcctgggctcaagggatcctcccatcccagccttctgtgtagctaagactacaggcatgtgccactatgcctggctaattttaaaattgttttgtagagacagggtcttgctatgtttcccagactggtcttgaactcctaggctcaaaagatcctcctgaaacatcctcccaaagtgctaggattacaggcatgagccactacacctggctgtgtggtttgttatgtagctacaattaactggaatactcaatgtcctccttagctatgtgaagcaatacgtattctttgcttaagttagtttgaattgagtttttgtcacttgcaactaatcttgacaattacttgcaaggaatcttgactaataaactctctagtctctaggtattattcactccttgtgagtcagttactcagattgccaaaaaagtaatttttcatgtggtgttcatggaaaaagtatagaaaggtagtgaagaggaaagaagagagaattagggtaagggccttaaacaaggaccccctttttgttctctttaacccatgaacccatggataatggatgtgtcattgccgttttttttttttttttttttttttgaggcaaggtctccctctgtagcccagcctgaaacgcagtagtgcaatcatagctccctgtaacctcgacctcctgggctcaagtgatcctcctgcctcagttttttgagcagctgggactacaggcatgcaccaccacacccagccaacttttaaaattctgtggcaagatgcggtcttgctatgttggccagactggtcttgaactcaagtgatacttcccgtcttggacccacaaagtgctgggattacaggtgtgagccactgtgtccagttcattgcctcttttaaactatttaatttttctccttagggttgagttctggccactgatttgctgagtgacctttgacaaatcgctgtaccttgctgggtatgttgctttttctgaagggtagtggtagagggagatatttctttatcagaaaaaatgagcaaatggggctagatgtgatatttgttagaattataaataaaagcagccgggcgtagtagctcatgcctgtaatcccagcactttgggaggtggagatgggtggatcacttgaggtcaggagttcactggccaacacagtgaaaccccatctctactaaaaatacaaaaattaggctggtatggtggtgcacgcctataatcccagctactcgggaagctgaggcaggagattggcttgatcccgggaggtggaggttgcagtgagccgagatctcgccaccactgcacttcatcctgggcgacaaagtgagactctgtctcaaaaaaaaaaaaaaaaaaaaaggtgatgtgctaagcattctgctaggcattttctacatatcgctgatttgatccccaccatggccgtattagccactttttgtcctttcctagacttgtattctagaaacacttgttcagctccttctctgtgcttcttattctcatacactgtcagggcacaagtcatgtatgaccagttccttgtcttcaagaagcttatattcagattggaaaagtaaagttaaactagatattaaattgttatggtctaaactgtgcactccagcctgggtgacagagtgagactctgtttatttctttttatttttttggggggtacagagtctcaggctggagtgcagtggcacgatcttggctcactgcaacctctgcctcccaggttcaagcaattctcctgcctcagcctcccgagttgctaggattataagtggtagctaggattacagctaccatgccaccacgcctcgctaatttttgtatttttggtagagacggggtttcatcatgttggctgggctggtcttgaactccggacctcaggtgatgtgcctgcctcggcctcccaaagtgctgggattacaggcatgagccaccatgcccggcaactctgtttaaaaaaaaaaaaaaaaaaaaattaaacggagtggtactgacctaaatgcagtaagagttacattaaattacccattgctgtgtaacacagtaccacaaagttagcagcttaaagcaacaagtatatactatctcacagtttctattggtgttaggagtctgggctgggcttaactgggtccttggctcacggcatcacaagactgctttcaaggtgccagctgggctgtgtttctttgtggagcccaggatcctcttctaagttcatgtggttgctgggagaatttcttgagggtgtaggactgaggaccccagtttcttggtgtcagcccagagccacactgagcacctagagagggccctgcagttcctactgtgtggccctctccacaggcacttcacaacatggcagcttgcttcctcaaggctggcacaagtctcctgctctagtctgctaagaagtgttatataatgtcatataatcatgggagtgacacatcctcacctttgccatattctattgcctagaagcaagtcacaggttctacccacactcaagaggaagggattacacaagagcatgactcactgagggggatcacctgaaggtatatttgcctcaggaatttagaaaagagggatgtcagagtgaactggagtccccaggggaggctttatggaaggacttcagccaggtcttaaaggaagagtagaatttagttcagcaaagggaaataaagaggcagaacatctaggaccaaagaactccatgagcaaaagtatggaggtgggattctcacctaagtaattcctacacaaaaaggtaacagaaacctgacgaccttgcagatcacaaggggtaggaggaactttttcttattgaaccaaagggaagctgggtaggggaaggagaatgtcctggcttagtgtcagaaaatttgggttcaaggttcaggtctggtattaactagcagtgtgactgggacctgctggttatctgagcctagcttcttgtgaccatttcgattgactttgttattgtgagaacgagacaagctcttggatgcaaagtgctctgtaaatggtccagatcctatttctgaaagcagcatcattgactcccactctctctgggtcccccagccccctggctcctctttcactggatgctctccctctttcagtctcctaaatggggtgaccatgggagcagattctccacgttctggacttggcactcttctcatctgactgcacagtatgttttggggttctcatctaccaccacccagggctgatggctcccaaatctaagttctggcccagactcctttccccaggtccacactcatgtgttcaaccagttgttggacaattcctctgggctttcccaaaggccccaaattaaactaatcttcttcttgtttaaatcaaacaaatttaaacaaattaaattaattttccctgcaaacctcttccgcttcctttttatgccatgtcttggggaatcacatcaccatgtcaggaatcttatgtcattccttcctcccctacctttgcacctgagatcctagtggtcaccaagtcccttctctcctgtgcatccccctccttgtattcccaccactactgccctagttggcacctcattaattcccactggaatcactgcaaatgcttcataactgatctttctatctgacttcattctccacacatcctgcagcatgaactttttgaagcacagatttgtgaatgcctgtgctctgcttaaaagcaatcagaggcccctcactaataaggaatgaaattcaaactcctgggcatgatatttgattttttttttttttgagacagagtcttgctctgttgcccaggctggagtgcagtggcgcaatctcggctcactgcaagctctgcctcctaggttcacgccattctcctgcctcagcctcccgagtagctgggactacgggtgcccgccaccatgcccggctaatttttttattttttattttttgtatttttagtagagaaggggtttcaccatgttagccaggatggtctcgatctcctgacctcgtgatccgcccacctcggcctcccaaagtgccgggattacaggcgtgagccacagtgcccggccgatattcgatattttaagccctcctggatctgactcttgcccacctcccctgtccacttcctgtctcctctgctccagtcctactgaactgtgtggtctcacactgtactgtgttctttcaaatctctgtgtgtttgaatatgctgtttcctttgtcagaaatgcccttccaccatccttctctgccgcaattgctaactcttctcatctgtaatcacttagctcagctctcccatttcgtgagtcatcttccctaactcctccctctggatacgtggaagtccctccgatgtgcaatcctagcagcttgtgcaggactctcctcacagctctcatcatgctctattgcaatggttttttgttttctctcctgctagattgtgaattctcaccagcagtaatggtgtcttattttcttttgttattttaatgctctgatcatcttttcttccaacctgatcctttctaaatatttttaaatttattttttgaataggcaacactcatgtgactgaaaattcagaagttacataaaggtataaagtgaaaagtctctctcctacccctgtccccgcctctgacaccctagctatccagtctccctccccagcagcaatcagtgttatcaatttcttgtgaatacttctaaagatataaaaatatatatggttcccttttattttattattatctttttagatggagtcttgctctgtcgccaggctggagtgcagtggcgtgatcttggctcactgcaacctccacctcccaggttcaagcgattctcctgcctcagccttctgatgaatacaggcacctgccattatgcccggctaatttttgtatttgttttgttttgtttgtttttgagacagagtctcgctctgttgcccaggctggagtgcagtggcacaatctcagctcactgcaacctccacctcccgggttcaagtgattcttctgcctcagcctcccgagtagctgggactacaggtgtgcaccaccacacccggctaatttttgtatttttagtggagacggggtttcgccatgttagccaggctggtctcaaactcctgacctcaggtgatccacccacctcggcctcccaaagtgttgggattacaggcgtgagccaccgtgcctggcccatggttcccgttttatatacaaatagtatcatgttgtatagattgtgctgcactttgttttcaccaaatcatatatagtattgatgatatgatcattccatataagtgcatacagagcttccttattctgtgtttacattgattcaattttccattgtggatacattatgatttaacaaataaacattaggttgttttcagtcttttgtgaatacaaacaatgctgcaatgacttaacttcataaaaacatcacttcacacatgtgcaagtgtaacagtagaatgaactcctggaagtggaatcgccttcagtttgaggaatatgtgtatttgtaagtttgaccatgtcctgttgcctttcggggacattcagtatatttttatctaattcagagtaggcattcagtatatttttatctaataaaccaatgaaaaaataactcttttaggggaggctcccttctttttcctttctctgatgccttgctttccccatccagtgctcagttcaaaccaaattattcatattcaatccaaatgccactattattttggagcaaaactcttatatcaactttattgtgtaactagtcaagatccttcttcattagcttggttgtaaaataaggtcatattaatttttatgttctaattataatgactttgagtcctcatcccatattttgtgagatctcatctttgttttttggagacaggatctcactctgatggtcaggctggagtacagtggtgtgatctcagctctctgcagccttgacctcctaggctgaagcgatcctcccacctaaacctcctaagtagctgggactacaggtatgtgccatcatgcccagctgctttttttttttttttagatatagtctcgctcagccaccagctaattttttattttttgttgagatggggtctcactatgttgcccagtttggtcttgaactcctgggctcaaggaatcctcccacctcggtctcccaaagtgctggtattacaggcatgagccaccacacccagcctttaaaaatttggggggactcttttgtaataacagttagcttaaaacacaaacacattgtacagatgtacaaaatattttctttctttatatctttattccataagctttttttctatttaaggcaatttttaattttatgttttaaacttttttttttggttaaaaactaagacttaaacacaaacatagcctatgcctacaccagatctggatcatcaatttcactgtcttccacctccatctcttgtctcactggaaggtcttcatgggtaataacatgcacagagctgtcatctgatggtaacaataactggggccaggcacagtggctcacacctgtaatcccagcactttgggaggctgaggtggttggatcacctgaggtcaggagttcgagaccagcttggccaacatggtgaaaccctgtctctactaaaaataccaaaaaattagccaggcatggtggcgcatgcgtttaatcgcaagggatttgggaggctgaggcaggagaatcacttgaacctgggaggcagaggttgcggtgagccgatatcgtgccattgcattccagcctgggcgataagagcgaaactccatcttaaaaaaaaaaaaaacaaaaaaacaaaacaaaacaaaaaaacacaatacttggaatacgtggaaaaaaatcacaatacttagaatacctagaataccttctgaaggacctgcctgaggctgctttacagttaacttaaaaaaaaaagtagaaggagtacactctaaaatagtgataaaaactacagtgaattcataaactagtaacatagttcttaccattatcaagtattatgtactgtacataatcatatgtgctatactttcacatgactggcagtgcaggtttgttaacaccagcatcactccaaacatgtgagtaatgcttgtgctatgaccttatggtggctactgtgccactaggtgatagacatttttcagctccattatcatcttagggggcctccctcgtgtttgcagtccattgtagaccaaaatgtccttatgtggcacatgactgtagttgcaatacaggacaagaaagttgcacaataactgggccttagttcctgatacttagtagctggatgactttgagcactctaaggttgtttcctaataacgtaaaatagggaagctaatcgtgatccggttgcctcacaggttgttgggccctggtcaacatataagttactgtgccaaaaaatgagttgatataatttaagactgtgttgaatcacaaacgttaagttattctaacattattgttttttagaggttatgaaatgaaaggggggggggcgaaaaacttggtccgcatcaagaactgaatcattttaccacgctgggtgctgggttatactctccccacccagcagatcaaactcctaacccagcatgaaagataaactacaactcccggcaggccttgcttccgaactgcgtcttataacctcggctcaggcccaggcccagaccgctccccgcccccgccacccataaactacatctcccaggaggccccacggtgcccgattgtccgcttttcgcccgccccctgcctcctcttcaccccgcgccagcagctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgtgagtatcggggctacccgccgccccatcctccccgcgcccctcctgcccctgcactcctcgctacccttgtcacccccaggccgcacctcccccgagctgcgagccggccttcggacccccgcccctcaggcctttgcagccgggcccctccttgtgggctgccctcccaccacccgccccggggcttctgcgacgccggtctcccaccccgtcgtctccagctgatgcccttgcgcccccagtgctcctccctgtgccccgattactctgggctcttctccgcccctttgccttcccgtttggcgtgctgcattctgctcctcactccccctcgtcttgctcagaaggaacctcatctgctccttactgacggcgtttcgttttctgatccagccagtaccgtgtcccccccaagttctcatcttcagcatcgcagtttcgttctccaccactcccctccgcccccgtggactgccccttctgccctccagaccaagtaggcaggacctctggtctgctcctacttttcctccggaaacaccatccctccccgctcgtctcctttttctttccttagttaccctctcctcatggttacgctgcccctaaatttttccatcccaccgtgtgcccctttcctcccctcctttttgtatttctactccaagagtttaccttgctttctgacccttgcatgcctttggggtggggggcgtgggatttgacaccgtagtttctcttctcggttggccccgtatcacaccctaatttggaatctagcgtctccatcagcacacccctctgagagcatcccttccctggcctcctgccttcactcctgctctatactcatgcctcctcctagtcaggtttatggtagaccccttgtaactcctcctccttcaaaactacttcaagccctttttgggtctttgaccgctttgcttttttagggcatgcccgtctctgctgcctcttctactctatcctcctgtgatcccacacttgactttgtcctagtctttccctcccctaggctgcttttcctttcttctgttttttaaggcgccttctgctgctgcagcccaccctctctcccctgctgcagtccctcccccttcatacgcctcccccaccacatccctccatgctcttgcgggatgctgccttgtcttgcaatctctgtgcacaccgcctccattaccctaatctaggtgttacatttgcctttttgtacttcgtattgaaattcggatagtgattgccggttgacttgcaggtggtgtgtgctcgcgttgtctccgttctcctcagcagtcttcagtgctgtgtttctgcttactgaatctatgttgtgcattccttttttacacttttactctctccctccatatttcgatttgcccacttgaaatcgttctcattttttataaattttattttaattgtaatttccgcaaccttctgttgcctcttgtaaaacagtaggtttgcaaaagggatagttttttgaaaatctgccttatagagaaatccattccttcttactcatctcgtgccatctacccttatccttgacattcttaactccatggtgtccactcattctgtttcctcacctcttccacctcaagaaatggttggttttaacctgggagagttgattgaaaaaaaaaaaaagaaatagttgctcacctaggccagtgtttggagacagtatacctttcctctgtcctttctgtaaatagatgctttcttgtttcattaatgtcctacatactgtttcctagtattcctagtattgtctgacaatatattctttttttttccttgagatggagttttgatcgtcacccaggctggagtgcagtggcgcgatctcggctcactgcaacctccgcctcccgggttcaagcgattctcctgcctcagcctcctgagtagctgggattacaggcatgtgtcatcatgaccagctaattttgtatttttagtagagacgggtttcaccatgttggccaggctggtctgaaactcctgacctcaggtgatccgcccgcctcggcctcccaaagtgctgggattacaataatgactttcagatttcttatacttgggcacctaattattttctttctagataactcaaaatttgtggctgatgttttcttccaatagaaggtctcagaattgtcactttcctttccctttggaagttaattttggactcagcttcttatttttaaatttaaaactaaagcatttataattataaatttatgatgaagttctacattatttactcttcacaggatctaaaggaactaaaccaaaaagaataattctgtaggagactatagttaatatgatctatctttgcagatacacgcacacatcccaacatacatagttagtggcttcttgcctttattgtggcttctgcccaagagcctaggtataaactgtaaaggagacctcagataatcccctaggaaaggtagaaggacttgccttaggctcaggttccagactaggaagctgggaaatctttgccttctagagaaaaaacattactttttggcacatcctttgtggtaagtagagaactttgtcacttttagtgggcaggggaaaagaatactctgcctagaagacctctctggaaggttgtgataatcagaaatcttcctggcattggtttctcactcttccaactatctgtattttgatttccaaattctctgaaccttctttggtactataggggaagtaatgataattacagcccaaagccaagctagtggtacattctgtgagaccccaactatacagtgtctttctcttttctttttttttttcttcctttcttcgatagtctgcgccttctctttagggtttcaagtgagaggggaaatcagcaaccaaatagatgtggttcttgagggatatctgtgcccgctacttgtctcgatcttggttaggttgatgctaattttcctaaagcattttttaggcaatactccttagagcttttgtctgtcctccaagttcttaaagtttacctctgttgtcccaggaaagctttgcatgttgctgaagagccaggtggggtcagaattagggataggtggattatcattgtgtggatatagtttgtatcaagtcataggtgaatgtatggaccttgataattgctatttaagacttttccctattttagattcttctattgtgtttacaaattgtttttgtaacaattttcgtatttttcagttgtttggacaactgacagaggtgtgaaagaacagagtaactttgaaatttaagggcatacaaacttggacacaagtaagagcttcagtttctttgtgtttcttttaaagtcggcttaccaaggctctgtcctaatctttagtcctgaaactaaattggagcccatatggttcagtttgccttttctcctttcaaaactgtctagattctaacagggcttggtactgcagtatgaacaagccctctgggctctaaattttactgcagatggaaagtttttttgactagcaaagctggtttccaccttgtaatttttcccagtgtaacatatactgagtgttttccctttgatgtgtatgtacctggaggctaatgagtaaagaatgctttcaacaaacagaaccaaaataaatatgtctttgcactaattatatagtatgtgaagtaacatttgacttcaggttaattttcttaaggttaaagtagttccaaggactcttgattgatttctcgagagacgctgctggaaggttttagtgtgtggtggatatggatgtaaaactgtctgtatttttgaaggattagtttaagcatggaccactaagattggcttgcaagcattcaaaatcatgatatatttatgctagtcagtatatatgctttcctctttgatagccaccagataatagactcatcaactttccctcattaaagtcataagataaaataaaactgtgtatatcaatttgttttttgaaagtcagttttttaacttcattttatgtgagagtttgaaaatgaattaaagaggctggtgccacaagaagtatttttatgagttaagtgtgagtcatgtaacacagactaggtaccgtctcaaaagccgctttctcaattgcaactgaattctatttgactgatattttctaggtagattttggtaatgtttgaaataatgaaatcatggttattgatcaaaggaaatttgtttggcagcggttctcaggctttagggtacatgagaagcacttgggtgtgcttatctaaagtacagattctcaggctcaccttttaagggttatgattcagtagatctttcatagggcctagaaatctttatttttttactcctttgccaggtgtgggtaatgcaacccacatactcagttacatgcccagggtgatgcagtaggttgtaggccttggattctcagttcattttatcttcatgattatattgagagtaatgagctaaggttataccaacaaatagtgaattgttaggctctcgaattccaacctaagtggaaaatcagttaaatactaactgttctatctgatcgtctatactttatttattggatcttgctaagctcttgaaataaagatggatggttaagaggtagcacaagttaatattaatagttataataatcattttactgctttgcagcgtgtatagtgtgttatagtttgtagttttatttatttatttatttatttatttagagacagcgtttcactcttgttgcccaggctggagtgcagtggtgcgatctcggctcactgcaacctccgcctcccgggttcaagcaattcccctgcctcagcttcccaagcagctgggattacaggcatgtgccaccacgcccatctaatttttgtatttttagtagagacggggtttctccatgttggtcaggccaggctggtctcaaactccccacctcaggtgatcagcccgcctcggcctcccaaagtgctgggattacaggcatgagccactgcgcccagtcagtctgtagtgtttttacatctgatcttcacacagtcctgtgagataggaagattataagctcatcaagggcagggactacatcaaatactatgtatttgttgtatccctagccaaatgtctggtggcccatggaaagtattcttcggtaaatacttgccaaatgaatatatgagtattatccctattttataagacaggaaatggaaactgagtgttgtaccaatgaatggcaaccagaattaaatccagatctttggattctagatcttgaatattttctctttttagagctgtttttttttttttttttttttaaagagataggagtctcactatgttgcccaggctgtacttgaattctgggctcaagtgatcctcccacctcagccttccgagtagctggcactacaggcatgcactaccacacctggctaatttttttgtactttttttttttttttgtagagatggggttgccatgttgcccagtgtggtcttgaacccctggcctcaagtgatctgcccactttggcctcctaaaccgctggcattgcaggcttgagcacctggctgcttaaaattcagttacattcatataaacgtcgatagtggttgaactttggttctactattgtgaaatgtaactattttatatctttatttactcactattacccattgttaaattggatgagagacaggggactaaagcaggcattctttgcctttattattgctatctttaccctgttggttatcagtgaagacagcagaacaatcatttttaaattccttttaatttcacaggtagttgaggttgcaaacaaataaaactaaatttgaaaatagcattaccttcccctcagaaatcacttccacagattgctgtaaccaggaaaatatattttattagtagcataacaatttgtctgggtcttttaacttattgtgaagaacagttctttttccatccaccactgaccagtttttttcagatgagggcctgttaccatgctctcaaagataattatttttctaggtaagtcccattgggaataattcttatgaccttgtagataagcaaagagacttaattgacaagcagacacttaacaatttatgatcactgctcaaaatgctttttgagcataatctttggcaggttcattcattagatgatggcattgctgacaaaaggatattgtggtggtttaggttagagccatttaggttcattcttttcttccacctcagctatacagatgttttctgtgcttcttgggcaatccagtaagagcccatggatgggttggtacagttcagcccacatttggaaaaaaattttaggcagttttaaaatatcttttaaaaaattgcagctcatagtaagagatacattttacattataacctaatatatatgcaaaaaaaaaaaacacctgaaataagcttcacaaaaattatgtttactggccaggcacagtggctcacgcctgtaatcccagcactttgggaagccgaggtgggcggatcacttgagctcaggaattcgaaaccagcctgggcaacatggtgaaacctcatctctgcaaaaaatacaaaagttagccacgtgtggtggcgcatgcctatagtcccagctactcaggaggctgaggtgggaggattgctggagcctgggatgttgaggctgcagtgagccatgatcacatcactgacctcaagcctgggagacagaaaccctgtctcaaaaataaaacaaaactgaacaccagagtgcatgataccagtaaatacagtttttttggtttcttttttcctctcaccttagccttccagaaagctgggaccataggcgtatgccaccatgcccagctaattttttgtattttttgtagagacagggtttcaccatgttgcccaggctggtctgagattcctgggctgaagtgatccgcttgcctcggcttcccaaagtgctgggattacaggtgtgagccaccgtgccgggcccactctggtattttttagtttgttcatattttgagtttctttgttctgtttttttgagtgctggtggtggcctggtacattaatttcacaactcattaggttgtgatccactgtctgaaaaacagtaatttagggcatcacttttcctgatattggcatgctaaatattacttcatactcagtttggttccacaagtaagcacacactgtatataaagaactgcttggcttgtatgagtcacagggtctctgcatccctgcctttgagaagcttacactgcagtagggaaggtaaacaatttgctgtgtgtaaagctaaacgaggtaatagagataaatgaaaagcacaatcgaagtatagaggcaggagtgaatatgcctaagaagactggtggggagacagctcatacaaggcttttaaactggattgaagaacaaataaaacttcagagaaggggcaaggattttataggttgaggaaaactgtgaccaaagaggggaaaatgtgaaaagctcttaggctagcaaggggcttaaagttgctgtttgtctgtagacatttgtgatgatagaaactggaaaggaaggttgcagtaagattttaaaaagatggctttgaatgtaatcccaagaagtttggatttttttctctttatgagctcagaatatagctgtgtgtgcattaatacccaggacttcctgtgaattcagttttatataattatttaccagaagaagttgaataacttttccaaggcgaaagaggaaaatcactattagaattagagtaatttcagagccatctagtctcttggactgtcttgtactatataaagaagggaactaagaacaactaagctctgacacccagaactgggaacagctggtgaggagctggttgcctttaacttgtgtttgtattttatttcacaatcgaatccagcttctcagttatcctttctctttctcttctgttttaaatgactatacttactattgtgtttacaattgataactttcatccttgtgtgctacaagcctgttgtgttctagctctactttcctccaagtctgttcctctgatttgaagatgcttttttttttttttgtgacagagtcttgctctgtcgcctaggctggagagcagtggcacgatctcggctcactgcaacctcagcctcccaggttcaagcaattctcctgccttagcctcctgagtagctgggattacaggtgtgcaccaccatgcccagctgaattgtttgtatttttagtagagaccgggtttcaccatgctggccaggctggtcttgaactcatgacctcgtagtccacccacctcggcctcccaaagtactgggattacaggcataagccactgcacctggccgaagatgcttcttttaatttaaatcttttattttggcatacagcatgttgggagctgagtggactgaagacgggggggaaacttaatgtggtactaaagtttacacttaatacctaccttcaaaatgaaaattcatgtgaagctccttcaaataagtttaagacctggtggtgatcacaaagtgaattgttgctttctttcataatattcgtactccagggttaaattttgtggtatggtattagtcaaatgctaggtagtatgtgtgtagtctcttgtttattatttattgctccctgccaactaaataaggttctcataatagttgaggaaatgtgcctttctgcaaggtattgagttgctgaataaggagttgtatttgagtactcttatgtgtacttcctcagtgaacttccactgatacgaaaacatcttttaagaaatggtctgtttttgcttaagctgtctgaaactttttagattcttgtgtcaaacctcagagcaagaccagaatgataggcctatgttttctacaggcctgatacacaaggaattagcttacttccctctggaaaag

SEQ ID NO: 12824 - DNA, 44998 bp, Human
aagactgggcagacctttagaaatagaatgacaagtgttaggatgcaaagcaaaagcaactgaaacccaaagggagtgtcagcttgtactaccacactctggaaaacagtctgacaatatctgctaaagccaaacacacctatcctaaggccaagaagttcccagcagtgagtgcattcatctacggaagaacgtgcactagaatgtgcattgcagccctattcatgacagccccaaactggagacaacacagacatctgtcagtagtagactggagcatactcacaccaccgacaagtatactgcagtgagagagaatgacccacagctacacaacacactagaacatgaatgaaccccacaaacaacggaaagcaaatgaagccaggcacagaaaaagtacatcccatttaattccattttcatcaaggtcaaaactaacccatggggttagacaccaggatggtaggttcctttggggaggaggcaatgggtaggaaaaaacatttatctagaatctgaagtttaaaaaaattaaagtagtttctcctgctgtgctgccttttttttctgctttgctttttcgaggtaggaagttccaggacaggtaatatgtctgaggaagcctccacctccctcaccctactcacccttctcctctgggaccagacaggcaggaactccagggaaagcccaacaaggagctgtcctagagcactgatttcattttggcttcaagtaagattttcactagcaactctgcttttcatctcttttaaattttattattattatttagcattttcttatctgttacaatgtattaggcactgttcaaagcgtggcattagtattaatatgttacccattcattcattcagcctgctggagacttggtaatggcctctttattgagaacttactctgtgccaggtagtaagctaagttcccaattaatcctcacatgagctcttccttgccaggcaggagagaggggaagatatctgttagcattacagaggagtacacagagactcagagaagtcaagtgccttgtccaaggtcacacagctaagtcagtagcagagttggtatacaaacccagattccacattactgcaaagcaccaagctctgtcttatctagtgaccaccctcaagcaaatcacgttgtaagactggcagaaatacgaggtttcttagttccctaccctggcctaatgaatcaaaatttctggcccctaggctggcctgagcagtagagtcccccacagcagttcaaaacctgattccgtccccggacccagtaggcacgcagggccaagctgttgggtggacggaggggacgggactgccgggaaggtccctcacttctttctggcccctggcaaatgttatgttctctcctctgagaagccctccctaaccatccctggccaccccccgcaactgcttacccctttactttgccttaggtgtcttcctcgcgtctctcagtcttatacgtgggctaggttgaaccatatgacattgtcctttctataaattaaaaaatggttgaaaatggggcatttcatgcagtccaattcaagtgtttccctctaccagaatgtcagctccaagacggagctgggaagtggttcacagccgtgtccccagacaatgcctggcacacagtaggcgctcgataaatgacaggtgagtggccgagggaaggcgcccacttcgaggagttccgcagcctgaagaaaggccccgccgagccggaggaccccaggggactccgccctgtcctctgcaatctcgggtgccttcccggccgcgacgatcgggcggggtggggctcgccgtcatccatttaccagcctcgcctctcggacgggcgcgccgttaatgagattagcaatttaaaaaccagctagctgcgtcggcggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtgagtgcccaccgcgccccggccccagcccaactctgtgcgcgtccccgccgtgtgtgcgagccggggttagacccaagttacagaacggcacactgaggccgggaaagcgagcgtgatttgtccgaagttacagacccgggagtgttcccaggacacctcgttccggagccggagctctctcccaagccgccctcccaagccctcgggaacccctcgccccatcccgggggcggccaagcccccaaccctcacccttgttggccaggctgcggctctgagagcgcaggggacgcggtctccttcttcgagagaagtgtcaatggtctgacgtcttagtgagtaaaccttacgtttaggtgtaaaaagtgagtaggaaattgtcttattcaacagaaactcgttatacaactttcagatccgaaacttaaatcaacggtttgaaactcaggttaagagaatcttgagccatttctttaaattttttataaggagattggtttgagtttggaacgacagaaagcaggaaatgcaaatcattctgttttgttttgtttttcttaaataaatgtttcctccgaagcatcatgcacgctccggggacagccagccagccacgcgctcttaccgcactcccctagcgttgcggaaagctgggaacaccttctacacatgtctataacctcgtgaagcccaagtacctttttggaaggcaatgtggcaagagggatttaagtctcagcatctaaaacactttttttctcggttgtctcgtttctagaattgtatctaaaggaaattgtcagagttctgacagaggtagaaggatggtcaccatcatttaataagagcaaaacattggcaacttcctaagccctcaaataaaggggattggttcagtaaattatagagcatccattcaaggttgctcttcgcagcctttaaggcggcattttcaaaaaaaaattgtattttctcgtatcctgtattaagtggagggaggagaaatcagattcaaagctatataaaatggatttgacattttaaaacaattacttaaaaatatgcagagaaaagaatggggaaaagacatcaaattgttaacaaaatttctgggtgatttttgtttaccttgtcgtgtgtgtgtgtttttgtgtgtgtatgtgtgtgtttgtgtattaggacttctataattagcatgtttttttcaccataaaagatcatggaagatgttagaccaaagtatttacgaaaatgaacccatttgagaagaccaagagctaaacactgctccctcctccccttaccccaaatcaacaaaaggttaattcatagagtttttaaaacagtgcattcttaatttcctgattcctttttaaaatttgaagtgcataaatacaccataatgatgtgaagggcatatgttgccatatgctctaacagcattaccatgtgctctaacagctctataactgactcttaaaaagaattatttgtcagaatgagatttccacatcattctgtgctcagtagacctacccatgatacctttatcctgggtacatgtttcccagtcatcagtccaggtgagcctcactgtcacatgactacttaattccttgtttataataccaccatcacctgaatagtctgcagagggatgcatgtggggctgatagttctggagttgaatatgtatcaaggggttgctagggaaacctcaagaccctcaggttccaagaaaaagaaacaagaagtaatcctgtgcctggtgcagaggatgcttcggctggatgggtggatagatagatgagtggaagccggacggagcatggattggtggctgggtgtatgcatggattagtgggtgcacagacaaaaggagggtgtgggtctggtggatggcaccctgtcagccacatgtctacagaataaagaccgaacagtccacttggcaccgtaggcacttgaccacctaacttgaccacttgtccaatatttccacctcatttcctgccacacagcttcaaacctcctcctgccttccaaacacttccatgagcacctccttctgtgcctcaacccttcacacaagatatttcctccacctgagaggctgttgttgctgggagaactcccaccattccctccaggtgggaccaaatattgctttctctccgttgtgctctctgactctcctcactacttcacaggccacataagcacttggtcagaagaactgcacattgttcttcagtttctctgtctccgcccggcccaacctctgtgatgtgatggagtcacaggagccatccaataaatatttgttgagtgaatgagcaaggtattaggaaaagccacagaataaatgacgctagaggatgctagaggctttcccaagcctttcactgcacagtaaagtcacctttaagaagtgatttgtgttgccccaaacccaggcagtttacaacccatcccttaccggaaggtaaaaatcagccacattatgaaaggctgcagaggggtgtataacttccttgtaagcagagctgcaaatacccccagcaaacaaagaatttgtttataaaccacagagccaggctgtgccaaaatacttcccagaataagacggattagggatctgtgcccctctccatgggactctgcccgtgactggagaggcttgtttccttcctgctccccaggccaggcccggcccggcatgaggaatgttaattctgaagattacattccaggtaccaatcatctctgtacagccctggctgcctgctctagaaaaaaaaaaaataaaaggcagctcaaagaacttcacaaaatctctttttgaaaaagtcagcaggtcttgggcaaccatgtcaaaatctaaggcagtagttgttcaggaagaaatcggggatgcaagtgtgtgtgcactaaggtgtaaaaagcaaatactgcactaactattttacataaacatgtgcacggaagaaacatggagagatgagaacagttgtgtgactggtggaaatatggatttttttctcttaaattttctctctgcaatattgagggggaaatcagaggacacctgactatgcagtgggacagtatcactctcagactggaatgctccacatccctgcaaagcccttgctgtctgggacaggaagccagctctttcagctgcctgtactgcttaccccaaattgcttagagaattgcatgtcaaactgtagcctacctgagcatcttcataaactgcaggttgctagaccccacttccagggattctgatccagacgcctgtgggggaggacaggattcttcatttctagaaagctccctagcaaggctaaggcttggtccatggaccacacttcagggaagggtcagggttgcttctgtggccccaggcccggcagtagggtcccagtaaatgtttaacaactggctcttggtggaacagcaagacccaattccaagaatttgcagattaccttgatgtaaatcctcccaccatggccagtttcagactgccaacgtattgtgccggagtgtggggttggggagaggtggggccggttggctcttgtgagccggcctggagctgcggtggccacagctcttcaggccagcacccagcctgggactgattcacagcaggtcagtccatggatggatcagggaacagtgctgcagctgtttacctgtaaagtgggtgagggcccccagtagttgggaaataccatgatcaggggcccctgctgctcacccaagttttccagactcaatcctggtaacatctgccctgttgggctcctagcatgtgccaggcatcatgtgaggcattttctgaaggaattcaatttggtcttcacaacatgcccacagttggtcctgtcacccccatttacagataggaaacaagtcagagagaacaagacttctggagaaatagctggggctcaagtcacttctgtgacaagccagggctctctccccagcaccctgcactcatctgctacaggcaggacaggactcctcaggtgtccaggcctttctaggacccccaaataagaattgccgtggctcagggtacttcttcctgtggttctcctgtgacactcacccatggctcaccttgacattggaggagggcctggccaggagcctgtgcgatgtccacctgcaaggatcccttgtcccttctgttctaacctcctctccacctctgcccttccctgaatatacctcaaaatgtttggcatcttcccagtgtgctcttcatcctctccaggaaacctcctccctaaattaaaggtgacttcttccacaaagccctcctttgatccccgggctaaatccatctgatatgagtttggtccccacccaaatctcatgtcaaattgtaatcccaatgttggaggtggggtctggtgggaggtgattggatcatgaggtaaatttcccctttggtgctgttctcgtgatagtgagttatcagtgagatctggttatttaaaagtatgtagcagcttcctactctctctcttcctcctgctccagtcatgtaagacgtgcctacttccccttcaccttcttccaaaattgcaagtttcctgaggcctccccagccatgcttcctgtacagcctgtggaactgtgagccaattaaacttctttcctttataaattacccagtttgaggtatttctttacagcagtgtgagaacagactgatacaccatccctcctgtgcctgttgcattgtggggtctgacatgtctcactcccacttggtagggaggaaaagtgaccagtcaggaacatagagtctgcctactggtggagaagcctctatttgtctgtgtgttggaatcagcccatagctttaaaaaatactgatgcttctgtcctatccccagaaatcctgattggattggtctcagatgtggcctaaacaggagttttacactccccagagggctctactgtgcaacccaggttgagaatcactaccttacaaacaatatataatataaaccttctaggcaatttaagtcattcagtaaatattcactgagtatcttctgcaagccagggactacgctgacggaagtttacaaatatggtgattatagggtacaggggttgggggtggaccaagcaggaaaagctttaacaaagcactgttcagaggcttcgctgaaataactcaagaaggactaactgctcaagaggatctagaaagccttccagcaatggcaacatttaatagcagctgtgaaagagaagtcaaagctcatcatgtagaattaggggtgaaaatattccaggcagaagaaactgtatgcaaaaggcacagaaaagcacacatttgagggaaatggccagaaaccccaggtggctgtgagaagtgaggcggggactagggcaatggcaggagaggaaactggagatgaaaaaggagtcagcatgtccctaagggccccaaataacaggctaagaaggtggagcttagctctgacagcaaagccagattttaagcagggaagtggcacagtcagagctgtggtttacagagattgccagcatggaggccaaggatgcactgggtagctggagaaggggtgatgctgcccgaggggatgagcaaggagagcagagaacagatgggagggaattctaggaggtttaaaccagtgacagtcaggaagagtaaagacggctttaatttttctcacctgtgcccttgttcttggttttcaaaaggttgactgggtttgactccaaatgggaaacttttgggggaagaccaagatggaggcgagtgaatgaagagaaggaaggcgctggggtggagagtctcacagaatagagcagtggttcccaaagtggaacccccaggccagcagcttcagcatcccctggtgtgctcggtgttccttacattaaacattacattaaacattgtgtatatgcacacacatacacaagcacacacatgccccagaaagaaaaaaaaaaggtttacaaaaaatccctgctgtgttttttgtttgtttgtttgtttttgttgttgttgtttttggaaaaaaagatatgtaagtggagggagagaaagagtttggacacctgagtaagctttcccatgaaaggcactgactcgggcgggcatctctgtggccctcaaaggagacagattatgatgtgagggcttgcagtgatacatttcatacagaaaggaatgtctcttctagtgagattcttaggtttagcaaatagacaacgtactggctatgataattagaaaaataagcaacaacatgctctagaataacatatggtgtgagtttgggggttataaatgtaatgagtgttcatcgtagaaattgtgtaaaagggccgggtgtggaggctcatgcctgtaatcccagcactttgggaggccgaggcaggaggatcacttgagctcaggagttcaagatcagcctgagcaatatagtgagacctcatctctactaaaaatataaaagttaggaaaaaattctgtaaaatgcagaaatatacaaataataaaatacgaaatcaccagaaattccaccacccagaggtaatgactgttaacattttttgctgtaaaaaattagaaccatatttttatatgttgacttggtatttttgctttttcaaaattaaccttatttttatcatttccaaaatcatgtaatattttttgaaaatataagcttaaatagctccataatattccatttacagaggtaacataacttacttaaccattctccagttgtggaagtttaagtcacgtaaagttttatgctgttataatccagtggtcctcatgttttagtggaggaatttgatccgtttatatttattatcaggttatgtttgctgttatttttcatcacatttcgtactgccttacttttcctttttgttagttattattgttggattttgttttgatcttttacattatgaagtatatattcttcactttttttctcaagtgatttagaaggtataattcctattttttctattagcagttaatttaaatttgaggggaaagtatacttattttctctagttatcactgtcaagaatgaaatgtcatctgttgatatcaccctatgaaagaaaaaaattttagcacacttgtacttcttgcttctttcctcacccccattccagttaacaacttttgttgatataatctaggatttcagacacattatgatgattattttactctttatattttgtttcttctcattcagaaattacattttccatttgtataactttacaatgatattaacagtatgattttcagacttgattctgttttgttggtttatttaccactagttagttctactataacacaaccccatatctgagttccttattttgatccaacactggttggatgcagttcatgagcacttaagtttttcaggaatagtaaataggtggttcgctttctcagcatgtctgagaacatctgtcctttgtagccacatgagttagctacaatgttttttactcaaaaatctatagatgcttttctgttgttttcagattttcatttctgcaaaggagaactctgcagccaattttattttttattagttattaggtatcatggacctagaatattacataaatttatatggtattatgtgaatcttataatttctgaaagatcacaggctatatgtctaagtattaaatgttttcatcaagttaacctaggactagtgagtgctttcaatgtacacaactgggaaaatgacttgtagaatttgtgattgtacttttctaccagttgtgtctgcagtgttctttctgcaggcacaactgctgaaactgagtaacgcttattagacatagagtagcgcttgggtttgctgtccatgtctcttctcttcttgtaatctccatctctttatccttttcttctgagctgtgggatagctttctttttcttttttatcattttttttttttttggaaacagggtatcaccaagagccagtatggatctcccctagcaaaaaatatggcaggaccaggtgcagtggttcactggttcaccctgtaatgtcagcttaggcaacatagtgagaccccatctctacaaaaaattgaaaattagtcaggcacagtgatgcatgcctttgggcccagccactcacgggggctgaggcagcaggattgcttgagcctgggaggtcgaggctgcagtgagccgtgatcgcaccactgcactccagcctgggcaacagagcgagaccctatccaaagttattccacagttcagaagaacaggataaagagatggagattacaagaagagaaaacacatggacagcaagcccaagcattacgctatacaccacagtagagccagttactcaacaaacatttactgagcacctactctgtgccaggtccttccttaggagctagagatcaactatgagccatgcagatcccatctctaccctcaaggagctgactgtttaggagttggaggtgtggacagagcagtagacattcagtgtagcggcaggtgcctcaacaacaggggcttgcaagacaagagggtgggtcttagttttgagtgatctggtgacacttggaggaagtgatgcatctggaagatccagtgagaccctaaggattctttcctgcattcaacaaatattcaatggactctggctctctgcccagtgctgttctaagcagagcagagaacaagaggagagcttccttgctagtagagaggcagacaccaagtaaacaaagaaaattatagcattattcacatagggaaatgttcagaaggtaaatcaagcagggtaaggagtccaagatggcaagaaggctgttctagtgagggtggacagagaaggcggctctggggaagccaagtctgggcagagcactgaaagaagagagaaagcatcctgggcaggaggaacagcaagaaccaaggtgctgaggccagaccagcaggaaggccagtgtgactgcagtggatggagagaggccagcggcagggaagggaaggtgggagccctgttccccaagcctcagaggtcaagggagggagtatgggtttgattccaggtggaaggaggagccaaggaagatttgaccaggtgagaggctagggatggaaaaggcaggtgtgtcacaatctgagaacaaactgcagggaggggactggagggtggaatcacaaagacctgcctggagggcggtgcagtggagatgtgacagtgggtgccagggaggtggtgatgagtaaggattcaccaggctgagctgagtctacatcttccaataattctgtgactgtaagcgtcccactcatctggggtaatatggactcacagtggcagagacattaccacagggctcaatgtgtgcctcagttacctatttattcataacaaaccacttgaaaactccaggacttagaaggaatgatggaattaggaaatcgccatctggcaaccagtgtggcaataatcgttttgggcaaaaatcttcactggatgccaaaactactgggcaaaagtatgagaaataggatagttactgaggctcagaatatctccaagaagataattatttctaaggggagaatagtaactctcagcagagaaatccagcagacaccacctcaaccaagtgagcaaaatctacatcaccgtgaatggaacacattgacatcttgtgcctctggacaaggacacaggataactttagtgtttctgccaaaactccaaatgagggacattccacaaagtaactggccagtgctcctctaaagcactgtgaaaggtcatgaaagacaaagaaaggcaaaaatgtctaaggaggtgtcccagattaaaggagactaaagaaacctgacagctagaggccttgtgggcttgtgagctagagtctggatgcctagaggacatcagtgggacagtcaagaaaattgcaaaagggctgcagataaaataatagtttgatgttggtgttaattccctgattttactcattgcactgggattatataagataatgttcttgtttttggaaatacacactgaaaatattgagaggtaaaaagaaaaaaaattagtgacttaaagcaacaataattaatcatttctcacagttctgtgggtgcctgagctgttcctttactgtttgtgtctggccttgctcatgcagccagaaggtccctcacacacctggtagtgggtgctgagctggctggtctccctcggttctcctcctcgtggcctctcatcctctggagcctggtctggtatctgtacatggctgtctcaggcacactccaagagaaggaaggtgaagctgcaaggcatcctgaggcctgggctctggtaccaacatggacaccacattctactggacaaagccagccccaaggccagcccagcctcacagtgtggggaatagactccacctcttcaggggaggagcgctgaagaatgtgtggctgtatttaatctccacacatgcctttaaggcatgtagttgtattactactgtattagggttccctagagggacagaactaatagggggaagagagagagagagagagagagagagagagagagagaaaggggagtttattaagtattaactcacatgattacaaggtcccacaataggctgtctgcaagctgaggatcaaggaaagccagtctgagtcccaaaactgaagaacttgcagtccgatgttcaacggcaggaagcatccagcacgggagaaagatgtaggctgagaggctaagccaggctcaccttttcacttttttctgcctgctttatattcactgtcagctgatcagattgggtccaccagattaagggtgggtctgcctttcccagcccactaactcaaatgttaatctcctttggcaacaccctcacagacacacccaggatcaatactttgcatccctttatccaatcaatttgacactcagtattagccatcacaactaccaccaaaatcatgccccttgtagtcaaccccttcctactcccctactcctggccaccaccaacctgttttctgtccctatagttttgccttttccagaatgtcatataaatggaatcatcctactatggtttgaatatgtcctccaaagctcatgtgttgaaaacttagtttccaatgcaatagggttgagaagtgggaccattaagaggtgattaggtcatgaggactctggccttgtcaatggattggtatcattatcccaggagtgtttttgttattgagagagtgggtttgttataaaagagagttcagccccctcttgctccctcttgctccctttgctccctcttgccctcccacctcctgccatgggatgatgcagtaagaaggccctctccagatactagcaccatgctcttggacttcccagcctccagaaccatgagccaataaatttctgttctttgtaaattatccagtctctggtattctgttatagcagcacagactaagacaggcattctttggtgaaatgcctgttcacattttttttttacattttttgaaagggttatttttcttattgagttttgagaatcctttatatattcttggcacaaagtttttctcaagatgcgtgttttgcaagtattttctcccagtctatagtttttgtttttattctcttaacagtgtctttcacaaagaagtaacgaaatccaatttctcaatcttttcttccatagatagtgcttttaacattgtatttaagaaatctttgcctcaaactcaagttcataaaggttttctcctgtattcttatataagttttatagcttttagttgttcatataggcctgtaatccattctgagatttgtttgttataaaatttgagatatgggttgagtttcatttttctgcatatgaatgttcaattgttctagcatcatttcttgaaaaatttattgcagagcaaattcacccagattatgtgtttatttgataggttgggtcaggagtgacagaaatgattaatgcctagggccaaacagcccccatgttcccacttggcatcaggttttagatttccaccctacccatgggcactgggcagtcagaccctgtcagagagacagtcgtccctggaccttgccaggccttacatagttactgtttaacaccccgcgtaaaaacaggattatcttataaccactgagggtttgaatgtggcttcaaagtctcagtgtgtgaacccaatctttattgtcagatatttcatgattgagagccaccaatgacctcttggactcctttgatattgagagaaaactcacaaggtgctgaaacaaggttctgaaggaaaggaagggagcctggcctagaggagttatagcagtgtctggacatgagagggcaggatttgttctaggcccccacatgagcaggatgaagctaggaactccaagcctggtggtgtgggcactcatccacccatgcaagcggctcatgcctttctttctgtggtgtggccatgggggctctgcctggtctttgccccagccattccacttctgggatttgtatcccaaggaaatacacaaacaagtggaccaggcttcatttcacagctttgtttaggatggcagaaagctggaaacagcctgagtgtctaacaattgattaaatgcattctgggctcattttcagagcagaacatcatgcagctctttaaggggtgatgcaaaggtctgtgattgggagagtgcctggggaatgccatagggtgagaagagtgggttacaggacagcacgtgtgtacaatggagacatttttggtaaatattagatgttcatgtaagcatagttattttgttgtttaccttaacaactgaggatccagtttgctctgtaatcagcccttaatctttgcagttgtagtgtctgggttttatttgatcagaagtcctgccctcttttcccactggacattttgttaggctcaccctgacaaaattcacactccctggctccccaccatcaccaacagcagggaacctcaagggcagggagcagagttgctactctcccattccacaccagccaggggctggcccagagtaagtgcttagtaagtgtctgtttcatacactacctcatgtggagcaccatcagggctgtgcacaaagcccaaaggaagtgcatagaggtggacagctgaatgcatggatccaggcatgatgtctgacatatttaacaacacaattgtcttggccctgatcaactattagttgctgaaatagaagatggaatgtggggtttggcagaagggctgggacagtggaggcattgagaaaggcattcaagcagcttgggacagtggcagtttgcctcccagcgaggatgaatttaaagagttcaacaactgacatggctgcatgtcatccacagatggatggacgaacagacaggtggctgagtaggaagataaaaagatgaaaggatggatgtaaggatgcatggaaggatggacagatgaatggatggaaggatggatggatggttggatggatggatggatggatggatggatggatggatggaaatatggaaatacggatggatgaatggaaggttggaaatatagatggatggaaggaaggaaggatggatggatgtagggtggatagatggaaggatggaaagatagacagaagaacggatggatgaatggatggttggatggaaggatggatagaaagtgggtgaatgaatagtagatagatagatgagaggaatggcagcaagagggatggatgaaaatgtggaatgaaagaaggatgaaggatgagtagaaagaggaggatggatgatggaaaggtaggagaatgcatggacaagtagaaagacaggaggatggaaggatgtttgcacagaggttgagtggtcgtggagaaaagccttttggtggtggcctggctctcagctctggacatccacaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggtacgtggggcccctccagtcctctcccacccagagacccgggcagcatgggggtgtgggtgggatcccatcagcaaagctgctggatcaaggggcgagcacaaggcccaagagagagctcttgcctggggtgaacaaatggcctggtggggatgacatagaatgtgggctgagaggagctgggtttcctacccacagggcggtaagacagggaggatgcatgccccttggggaacagatgccaccctccttctcttctctggacctcagcttggtcacctgtaaaagggaaacagctgtaactccaagtcctagctaacaaccattctggaaactcaccaacttctccctgctaaataacagctctcttttagcaagcacctactacatgctgggagccagcctataggatatatgtgcatgagctcatttaatcttctttacaccgctgaggtgttgtggagtgccattaatgtctctggggtgcggaagctgaggcccgcacggacagcaggagaggactgtttcatctcatgcttctcctgagtgaccttgagccagagccccaggcacttccaggacaacctccacctgccctgcacattgcttatgacccagggctgcctctgcatgcagaaggaaccctgaccagaagtggccatagcctgtgatgctcacccctcccaccccagaaaggaaggcaggcaggaaagcagagtgacgtttcaggagcaaagagggtggaagcttatatgtgacctggttgcagatgcagaagaaatgtgtccagtgttctcacaaatcatctccaaacccagactgcctccttgtcttgaatggctattaatttttttttttttttgaggcggagtttcgctcttattgcccaggctggagtgcaatggcacaatctcggctcactgcaacctccactcccggattcaaccgtttctcctgcctcagcctcctgatgagctggaattacaggcacccgccaccacacctggctaattttttgtatttttagtagagatggggtttcgctaggctattaatttttaacacagaagtgtgtagttttacaatctgcctgaataagcaatcacagaggacttctcagaggcatcttctgcatcataggaaagataccagatatttgtgccaaccaggggatgctggtgaatatttaacaaccagtgctcagagtggagtgggggtggggaggggaagccctggtttatagcatttgcggatgcctatggggtaaatacaggcaccatggccggtttctactaccgagtgtcccagcacttgcggctggggagaggaggggacgctggttctcaagggctggtgtgggccagccccagagccctgctgcctcccacccctctctgtgctctcaggccgcaccctgggttttgtgcaggcctgaccgaattacgggcagccccctccccaccgcctcctcacaccccctctcctggctaccaggtgactcaaccgctggtgagccaaggagggagcataactgtacatctggacaaggtagcacttcacagcaacagtgcttctcacagcatgaggttgtgaacccagttctgccacttaacagccgggtagtcttgggcaggctccaggcctcagttttctcttctgcgatatgaagataatactgttgtaaggaccaaaggtaaataaagtacttatttagcacagtgcctggcagttagatctcaaaaacatgtcatcagcctcctgtcccagaaggtgaggagggaggttggagaaaaagaaatcacccttcccaagtgttcacaggtgcctggtctcgcttaatactcaccacacaaacctggtggagggaggcctcgcccaccccggggcggtcgccacaggtgtgtcctgggagcacacgctgggcctggcggagggggaagggccatcctcggtcctcagcgcggccctctgcttcctcgcaggggtcgccagcgtggtggtctctttcttcctctccatgtactacaacgtcatcaacgcctgggccttctggtacctcttccactccttccaggtgagccggggggcccgtgccagaacaggagtaggagcgagaaagggagagaaaaacagggccacccgctcggggaagggggtgtggggcaaggtgagcagcctcggggcggggagccggtgggtggtgtgaggtggaggggaagccatgcaccccaaaccacgtgaagggcttctgaacccgggctccacgggccccttacgctgtaagcaagagtccaccggtgagagtgtgcgtgttcttggagagaaggtccctggctttcagtggattctctctgatggatgtgaccccacacacacactattaagaactactgcacagtgtgcctaggaggaaatctgtggagaggactggtggggagggattccctcaatccagcaagacagcaacggcctgtcctcttcctccccgtccccttctcccgctttcctcagggccactcgtgcttccaggtttctgactccagcctgagcctcttcttttccctgcagacccctaagttctcctagaaggaccattgtcaccctgtaacacaatagggccattcctaaacattttaaaccacacatttctgatgataactacagctgacactctgtagaaaagtggaaggggctagaattgtagagaagcaagaactccaattccacacagagagctggtgtacattcaggacaagaggaattttcctttccactgctcatgctcatttctgttacctggctcctaccgtttcactctcaggaaccccatcctccactgcccccacctgcttccaggaaccaccttcaccttggcttcttcccagttgggaacagtggaggaggcaggagctaaccaggccaatgccttaccctttgcccctgagccaggccttcatgggacatgcctgtccccaaggtccgcaagcaagatagggctggcatggactatggactgaactgggtttgcctctggggtgcttgggcatagccttgactctgtgggggcgtgaggaatgcttgggtgaatgactttaataatcctgatttggcataccccactctggcttcccaatgagctccaccaagcttgccccattgcacgtatctctggcaagaaagctgtaacctgagcttagttgcagtccctccttctttccctggttcaacctagagtttcatgaacactggccacaactctgcctctccccagccttctcagtggaaacagggcaactcttcttactctatagcctggtgactgtttcctgtcctctgtgcagggctcatgtatggttgggcagcttgtgcactgcacaacagtactgccaactaagggcttgccatacacattgtaagcattatagatttgtatacttattaagacaagtttccaaaagtggaagtaatgtgtcttgtcctaacaaaatcagaataatttgctcatcccccaaaagcaaaaataaagtgcctcaagaaaggggcatctttttctaatagtcagaagtatgggggccagcgattcatgaaaatcacttaaatattcattcattccatccttcataggtctgtggacttatcccttagtccctctactttgaagccctcctccatggtcccataataatgagaggaatagtagctgcagacattcacttacatgtgctttgggccagacataggtcccagcactttagaagtgttcactcatgtaatcaaaacagccaccccacgaggctgagcacactgagcacccgagcagaggggagccgagtagctcatagctggtggggttggactcagggacctggccccggagtctgtgctcctgtctactcactccctggccaggctttccagccttgtgtccagcccttctcagcaggagcacctgggctgttatgcacacaaatgcggggatccttgtcctcacctgctggttcagaggtgagtgagggaggtcagactgggaactggcccatttaacaagttctcctatacgctaaaccttcttcaacctggctgcacactggggagatgaagttgcggggtgcggggtgcagggtggggaggtgtgaaaaatccaatgaccaggccctatcccaaacagatgaaatcagagtcactgggggtgcagcctgggcatcacccccgggtgccttagtcgtgtagccaagcctgggaagcaggcccggtctggcatcagcaggtagtccagggaacagactcaggtcagtcccacacaggctgtaaatggcccaaggggatgtcagcctaggcagctcaactgggcttcaggtctaccaggacccctgtcacctgcctgggacttggtgctggctgccactgggcacctcagttccctccacgtgcctccctctccctgcacccgcatcattcaggaagctagcctggatgtcccacagctggtctccaagagggtgagaggctagctacagggttctgaagtcctgggccgggaagtcactcacacagcatctcttcaccatattcagttggtcagcttgcatcggaggacagcccagactcacaggctgaggcaagagacaccacttctggatgggagaaatgtgcacatgggaaggggaaggactgttggtggccagctttgaacacgatatgggtcaaagcaagaaaccagctcacacattccaataggctagggtggcctggggaggtattgcaggggtgggcgtggaggtcctcaccaggacagtcctgagcactgtctgggtgtgcagacctgggctccagctgcctactggcacagtagccatgacccattaggtgataccccgggccttggttctgtctcctgtgaaatatgggattgagcccagtggggtggtcagacttgcttccattaatgatgcgtttttgtctaattaaatctgggcttgtagaacccagatatgtgcaaaactgatcaatgtggggctggtcctcaaagagcagggttggggtctcctaccccacagtcagaagtaacttttcctcccctccctcccatctcagcaccactgtttaccacttggcctcgggtcatggtcatgatgcatgcaccattgaggctcctttgttcataagtgacacgccagcagcctcctatgggggcacacctggagccttctcttttctcactaacaagctttcccaatccccgcctgccttggagccccgccaaatgcaagcgatgctgctatcgcccttgctgtagcaagtcctaagtaaacagcctctgcttgttctcacttgggtggtctttgctgatttcctcaagtcctgagatgcgtaagtctcaggttctgtgctcactaagtgctggtggcgaatggcatttcctgcaatgtacattgggtttggaagctagcaggagatgaggttcaggccccacagctgtcctgcatgtctgagcccgagagaacctggtgctggtgacttctttgagctagagtcaagctatacctgaagcagttagactcctggactttgcagggtggagccagtaagactctcatctgcttaagctactctgaactgggctctctgtcactttctctggttggttctgagttggccaaaaaatagggactctctcaatcattgaccaagtcctaagcaatctgggccagtgctgcagagggtgtggtttaagtgcctgagctgattgtgcacaggccgtgggtcggagttccatcatcagggctggcctggctgtggtccatttgctattcagtctctgggacccaccacagagttcagtagtcctcaaggaacacccgtagaattgcaacgagagtagagccccctcctccaaccccttcctgcctcacccgtgccccctgacaaactctccaactcccagtctgccttcaggggctccagccacctgcccttcggggaccagcacccttctcttccaagagtctccgctcagggccacctccctcacccctgccacagcctttgtcctcagccttcacctccctggataacacttgctttggtcccacaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtgggacagtgaggcacagaagcccggtgctcctggtgggtgggagggtgcaccaaggggcagctgcctctgtctccaaccctaggcaatgccaagggagtgccctctgcagtggaaaggcagcagctatgttagggcagagggcacagatggtgttgctgggacaagtcacctactagatgactatagagagggccagagatggttaaagttgcaaccctaaatctcaaaacaaggactttcttagaaaaaaaaagtttttctgtagcagtcagccccaaatccataccacccagacaaccagacagtgagtttgcttttctttaagattgtatgtatcctcgagacaccctagccactggctctccaactcagctgcacattggtattttctggagagttttcaaaaatctcatgccttagccccgccccccaaaattctgcagtaaccagtctggggtgtgtcctgagcactgggtggggaggcaggggaggtttaaaagctcgccaggtgattctaatttgcagctgagtttgagaccctttgttctaagctgcttccaatcaccctccagagctgtcgggcttgatctccataatcctttcttggtgcatcccaaggctcacactttcactggggctgacatgttccttcatctctagtctgctccacgtagaaggtttgctttcagtgttcccatcacccgccacctgcctgaagcttcagcagatgtctcggagcctagcacaccctgtctcattcactgtcacttctcacagtagacccaccacggcttgagcacccacattgtgtcattctggcaacagcctttcatggtagatttcatgatcccagttacctgaagcttagagaggtaaattgacctgcccaagggcacagctagtgagggcaaagcccagcctcaccccaagacttcccattgtcttggtttggtagccacatagctctctctatgccttaatgatgtcatcaattccaactgtcacctgctgagagtcctaggagcccacctgtcctcaccctctgactacctgagttgtctcctccagccacaccccaccccccatgtatttcttgaggcattagaccagagctacccatggtattccagggcccatgggacaactccagtatcatgcctggtagggcattttattttggtttctaagagcccctgatgaccagcctcttagcccccaaagtcccctgtgccatggctgaggaaagggacgagtgagcacaggtgctctttccccgagagagcttagaacctgcagcagcccactcagtcccatcgtagagcctggccatactgtcatgctcataaaaaatgtttttgtaatttatgtttgccagattattatgatcatgatccaagagatcagagggcaacatctgcagaggtagagattagagaccattccttttcccaatcactttgaaatgtgttgcataagaccatgtcatgccataaaaacttatttattcttatcatctatttcctctgcttcagctacacccttctccctgggaaaagtaccccaacagctctatgtaaatagagctaatcttgtcacagaccatgtgccatttcctggcatcctctgttggaatcgactttgtttcctgccagaatctctgcagagtggtcagaattggtttcttccaatagattaggctggatcacgtgtccagcaattctgcccacttagggactccatgagcctccaggaaacttgctcaccttgggggaaggagggaaattctcggggctggccctaagggcctgcttagtgcccattgtgatggatgttggtcacgagtgagtgctctgtcttttcatctctcttacctggtttcttataatcttgggtggatttattactcttctcaagttacaacaacctcagctaagaagcagtgataaaagacacaccccacattccacctgccgtcccctgggtgacagcgtacagagtgccattctggtggccttggaaatggatgagaagatgatgccacacctcaataggaagggggagggccaagtgtaattcaagcccacctgaacataggccaccagccatatttctcacagagagactcaaactttaagggaactcttacacaaaagacaatcttgcaaaatatttatttcctttacaaatgaggctctggtacacatatgagttgatttacagaaaaaaatccattcctggataggcacacgtgcacttgaaggtctgtattctatggctttgtaacagttagaatcacccagagcatgacaggtgactactaaagctaccatgaacaccaaagatattaacaaaacatcattgaacttacgatgcatgtcggtggagaaagaagatctggttgacaaaaatgtccattcaggtgtaatgttaaagcctaaggaagtaaaccctttctggagggttgccataaaaatcagatctgaatttcctattgtgtttattatggggacattgtcctctacgctacacctcgctgctttcctgtatgagcactcgtgaccaatctgctctcaggccccagtcctggggaaatctgtcctcctccaagctgcagatttttttttccttttaattgtgttcctgctttgtgtgtaggccaccaggaagctcagagctgaatctggctcagaaactgggtagagacttatgcacagattctatgggctgctttttcctgtgggctcattactggattgcccatatatttttttcatgctgatttctttagcaattttgaaatgttaacgtgactgatgtgtttttgtgggtaacctcaaatcctttccagaataaggtcaggttgaagggagggtggaaggcagaggctcggtacctgtttgcctcttctctactgaataagaaatgtcgtgctggtcacagctgtgagcgaccacatcccaccagcccacttccccagccctaacccagagcctgtgtgtgaccaagaatctccatgccttttccagctgtcagcagctgggcggtgcagcctgaataccccagatgtggtgttccatggggcatgggtctgtcctgtggaccccactgctccgggaggccaactctgccctctgatgcccgcaggtggtgtatttcacggcgtcactgccctattgcgtgctcatcatctacctcatcaggggcctcacgctccacggagccaccaatggcctcatgtacatgttcactcccaaggtacgggctgaagcggaagggccctacgggcacccctcacttatcctgccaccttccaggatgggtgggaagagggaaaggtggagagtgggccaacgctgtacctacggaagctgatgtgagcccaccagggtgtggcaggagtgtggagtacctgcagtcactggatcacctcctcagccaggtcatccccactccctgttaattctggagcattaagtctttctttcagcttctcctcttcatcctcactgtcccccaactgctgcacccctgccactgcctcacctcaagcccctttcagactgtggaccaagctttttgccatgagcaccactctggtcatcttgcttgcctgcttacatggttccacgcacccgtttccctacagagtttcccaacccacccattctccatgcaccccacacccagggttcatccatggagggtgcactcttgcctttgggatggggcaagttcttcatttggcaaatgcagtccctagaaataaaatgactgtgtcatccttccccttccccattccagacgccaccgatgtcagtgccgagagtcaacccacacctagacctcccctgccaggccacaccccctccatctctgaatgcccagacctgtgcagtaactgcctatgaatcagggccccatttgtgttttaattattttaccctgcagtattccattgcacacctccgcactggcgtatagtggtgagcatagctgcttctggttacacacctcctatggctgaggtgctatggaggatacgtagcaccttatgtcctccacatagcacctgtattctccacagcaccttagccctgggaggtgtgcagcttgaggtgtgtgtttcatctgccagggagtggatggggccaggagagctggtctccagccctaggggtgcccctgatggctgcgtgctgtaggtgagctccttcccctctctgggctactctcctgttgcgggtctgagcatttgggattccacccagggatcatcagccctgtccctgctggccttccagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaagtaagcctgggctgtcccaccgagtcccaggcctccctgagctctgagctgaagggtcgcctgggcaagggctggggcaaagtgcaccagttttggagtcctcaatccagggctcacatttggactccctacaccaccaccagttgctggagggcctggggcatgtcaacatctgcctggcagggatgagggcacgttagcgtgttgtgagcacttagcataataggacatacaacgatcaaattttgtttcttctaccccatctcccccacctcagaagtaaccaagaagcctctagctgagccacagagattgcaggattcactttctgtggccccttgcccaaaatacaaagacatcatccaggaggtatgctgtccagttgggtagtcactagccacaagtggctatttacaaatttacatttaaatcaatgcaacttaattcacatttaaataacttaattcatatttcagtacattcccttgttactttcaatcagttgctcagtgtccaccattaagtgctcagttgccatatgtggccagtgagtaccaaattggacagcccagatagagagcattttcatcagcacagaaacttccgctggactatgttggtccagaggttaaaatagcctagctgtgtgagtttggtgcctgttgtcatcactgttcatatctgaggcttcttcagtgccattcaaaattaccctgccctttaaaagatcaccaagcaacagactccctttcctcacctaatcagaaaagaagaggctgacgggaggctttggtgacagctgcctttctgatcagtgaaggtcgatccgatggtctgctctgcagggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggtaagatgcccaggcaaggtcaaggactggcttctctccacacactcatgggaaccttggtgagctgctgacttgggagataggcgaggtctgtaaaaataaagaaggatcctgaattacttttcctgcaactccaaggggaagagaggctttaacaccactctcttgagggctgttcgagaatgctagttataataaacttcctggcggacctctctgtcctttctctctttttcttttgtctttctaagcttttaaaatacagaaaagtagagagaataacaaacacccatatataccactcagaaagatcaattgtaaacattttgtcattttgggctcagatttttttatataaaagaacatttcagagatgaagttaaaaagtccccctttttttccctactcaccaaaggcaagaaccttcatttttatatttctattacccatctatgtattcttaaataatatcattgttttgttggcagtttttgttttattttttcttttttcaacaagccttttgcactcctatgtcagcagtttttaaatgggcataaatggtctggaaagatacttctctcattcagcattttaattttgagatctgtccataataatacatgtggaacctcatttgttcatttaaatgctgcattttatttatccattcccttactaatagacatttggagggttttttttttaatttttgctactgaaagtcacctttatttatattttacagaattatctctgctgtgctgggacctttattttttcacattgttttgaggatcagtttgataagtttcattggaaaaaaaaaatctagggaatttttactagacttgcattgattttatagtgtaatttggggagaattaatatcttttgaattgtgatatttgactcaggaacatactttctcttgttcagtcaagtcttttaaaacattcttcagctaactttctctatgaatgtcttggcacatctttcattagatttctattaccttactgttttattgtattgtgaatggtgttttttcccctcatttctatcatttgtttttgttgcaaaagaaagctaaatattttatatgttgaccttgtatctagcaatcttgatgaattctcttattaattctcatatttatgtatagatttgcttcagttttctatgtaaactatcatatctcctgcagatcaaattttgcatttttcttttcaatgcttatatctcattccctttttcttattgtattcactaggacttctagcacatgggagtagaagtgatagtgggcatatttgcctaattcttatatttaatgcaaatacttctagagattattcctagagagtgttcctaggtaatgtttttcaaggatagggagtagggagggcctgtggctctggttgctagtaagctactttggaggttgatatttttggggtggttggttggttgggtttggtttgtttggcactttgtttcatgggtacaaccactgtaggtcatttcatgggtgggacaatgcttttttctcctggttgttcagccctagctccatgcttgttattggcctgtggcatgagcctgcttccccaggcaggcatcagaccccagcccacaaaccccagccctcaaggcctaggtcctgttcaggtgacccatgaggtcctttggcttcagcacttgttcagtgctctcacttcaactttcctttatggatggcacctgggagttttcctcacttacttttgagcttggctctacagccaagaattacatggttggttattgatttatctagacttcatttttcctgttgctttgttcttttttttttctttcttttctttccccattccactttattccctgctgtttggaatttggttgcttgatttctcttcttgaaattttcctttcatatttaacttaataaagtctaaagttaaacagtatcttgacctccttcccaaaattcaaaaggactttagagtactttcattttatctcccattttaaatgattgttttctagttctgtctccttaaccccatacattggacatgacattatggttattttatacagctcttgtatttacctacatgtttgccattttatttgttcaccattctttcttgcatcccagcatctccaaaggtttttccttaaaatactttcatttagaacagttttcttaaattttgttctataattggcatctatcttttaaagacattgttcctcggagtagaaaattccaggttaacaattattttctctcaacactttgaagatgtttgccatgtgattcaggcttccattgttgctcttgatattttcttttattctttgtaagcaagcagctttttctctttctcatgatcttctcttcgtctttggcctctgcaatctagacatggcatgaatatatttttatttatccactctaggcctgggtgaggttgggcttcctggatctaagggtccaatgtttcttatcagttttggaaaattcatacctattatctcataatcgttgtctctgattctctcatttttctccttttggaacttcattagatgtgactttttcatcctgtcctacaggtctcttaacctctcttttatttttcccatctttttatccttttttattttattgattcatttctggatatatctttcagttcactaactctcttttcagctgcatctaatctggtatttaactgtcaattgagccttttaattcaataactatattttttatatagatgctatttttttcagatttacttgtccatcccaatagtttattgatacatgtttatttttgtaatgttatcctttgtttctttaaacatttcatacgtaactgtttcagtggtggccataggcaagagaaggagagcagtattttaacactatttagaattgctggctcatgataatcataaaaagtatatcaactttttgtagatttttactattgtttttaagttctctacaagtgatcactcccttgttgtcagcacataaagccaactattttcagtatgcccctgagcaactggtatactatagaattgacctgtgttcttatattagtcagtgcagcctgccataacaaaatataggctgggtggcttaaacaacataaatttattttcttttatttacttttagtagagacaaggtcttgctatgttgcgcaggctgatctcaaactcctgagctcaagtgatcctcccacctaagcctcccaaagtgctgggattacaggcatgagccgctgtgcccagcaaaaaacaggaatttgtctctcaatcctagaggctgagaagtccaagatcaagggccagcagggtttggtttctgatgaagacctatttcctggttcgtgaacacctatcttctcactgtgtcctcacataatagagagttctctctctctctcttcctcttgttataaggctacagtctggtcagattagggctccaatattataactcaatttaaccttaattaccccctaaagaccctatctccagatacagtcacattgggagctagggtttcaacatacaaatttcaggtggacatggttcagtccatagcaattctgaatctgacagtccaacatctgccacctcggggagggatgttctaaatctgatttcttatcttgctagttcttcactcatagtgacttctctccttgtgggtttgtaaatccctgtttatgagcactttgctcaatctctgggaatcctgtgcatctaaaccgggtgggggggcttctacccagggagggcttgtttttgcttcttctgtgggtagccagagagtacgcacaacctattatcccttttgagccccttaggggatttgtctttaagcaggagttccagcctcaatttccatagtttaacatttccgcaacagagttaccagcacagggacgtgaccgctgagcacctgcccctcctggttgcctgctgaccaagctgtctccctacaattctgcttcctgctgccctggccccgccctccctcctcaggtcccagccacggaggtttcaggacacctagtcggtcatcacattagaagcagaaattatccattgttttattatctttcatccagaatgtacgtaagttggggcaggagaggggaactcagtgttgcaggctggctacaagttctcacgtgctttgcatatatgagctcctggcagctcccatttcgtttcagcccagctgagtgtaaggggttgatctgcagatggaagctccaacctcacaatgtggcttctcatggccacttccaaggtcccccatgttgcttagtactgagtgcgtgaataagactataagtccctcttgcatgtaactggtgtcttctcaccctgggcaggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtcagcggggccagccagtggaggaggcaggggtcaggagggccaaggcgtgggggtgaacaggggagagctccctcaggggtcatgggctggttcaggtggctacagggggttgcagccacctcaccacggtcctgccatgtcttctcacaacctgggacctgggccatgtgattcaccctgtgcgttccattctccacatcacagggaagtgaagtggccaccccaacccaactccccaacctgacattcaaagttctccaggctaggagagaactcgattttgtttctgttcattttcattgaagtatattatatatatttcagacggagtctcgctctgttgcccaggctggagttcagtggcgtgatcttggctcactgcaacctccatctcccaggttcaagtgattctcctgcctcaccctcccgagtagctgggattacaggtgcacgccatgacacctggctaatttttgtatttttagtagagaaggggtttcaccatgttggccaggctggtctcgaactcctgaccccaggtgattcgcccatctcagcctccgaaagtgctgggattacaggtgtgagccaccacacctggcctgaagtatgaccattataaagtgtacatttcttaagtacaaactcagtggattttacatatgtatccacccaaggaaccaccacctaggtcaagatacagaacattttccacaccctagacagttccttcacaccccttcccaggcagtatgcacccctggagttcacctctattctgacttctacattttaggggtttttttccttttttttttttttttgtttttaaagaaacagtctcactctgtcacccaggctggagtgcaatggtgcgatcttggctcactgcaacctccacctcccaggctcaagctattctcgtgcctcatcctcctgagtagctgggattataggtgcacaccatgatgcctggctaatttttgtattttagtaaagatggggtttccccgtgttggccaggctggtctcaaactcctgacctcaagtgatctgcctgccttggcctcccaaaatactgggattacaggcatgagtcattgcgcctggccttcctgttcctgaatttcatatgaacgaagtcctattgtacacactctacgtctattgtcttcactcagaatctacctgtgagatccactcatgttgtttcgagcagcgatcgtctgcccctttttgtgcctatacaataatccattgtaaggtgacataccacagtttctttatccattctgctgttgatggacatttcagatcttaggaaatgagctggcttttccaattacatctctcatggtttcactccctggcccatctgctccactccaatcaggcagtgcctcaaggaccctgtggcctacactactccgtctctgaaaacaccattccttgacatgcaggatgaatcaaacccagctcccaggccatctccttcaagccccgaccactccagttggagttgcccccacctcttcagagtgctgcagcacttagaccccctcctcaggcctggtctttgtagccaacactaggtgtgcccatagccttcagccagcgcatggcccctttctccttgtgtgtccccgtcgggatagcaggagggctcggtagctggcagtgtacggtgtgctagtggaaagggcaggtgtgggctctagactcagacatgcatggggtccccagggaaggcagctggaggggcctgggatgaaggcccaggttctggaggctaaagggcctgggtctgaatcctcactctgccatggatgtgctatgggatgtcgggggagccttagacatctctgagccttgccttcccatctgtgaaagggggctccggacacctgcctcagaggcctaagggtccaacgcattgcaagtgcctggcacaagggaggatctgggtggacatttgtctcttccctgccccaccctcttctgggtggaggcaagtcctctctaggaagtcctgatggggccactccatattcaagcctcctcccctgattcatttctcatgagctccagggctgagttgttgggataaacagcgggggttataattgtagacccacagcctgggcgggatcctggaatgacagtgcccactacgtctgcttgttcattgagctttaagctctgccacccctgcagggcagctcagtgagtcaacatcagtgacccctgccaacacgcttcgggacaccattgtgccccctgccccacacacgtggcacacaccttcagagagtccaaaccatgacagctctttcaacccatgtggatgaagcaatcagccaaaattccctgagggccgacgaccccactgtcctgtagagaactggtaagcagtagtgggggggtctcgggcaggtgagcagctggtcttgtggcccccaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggaggtgaggaggcccaggaccctcatttgcatagggaaaacacagccacagaggccacgcccctcaaggaaaacagctgtttcttgatgcacatcttcacctcttctttaagcttcgcatcatgactcaacgtttgttctttgcccgcagatctcagcttatgctctgcctctattccatgctcagtttgcttcagtgaatatctttttctctattccctgtacttttgctttgtatcataggctgttttagggttgaccctgctggacccccacagcttactggggcagggaattgtgcctccaggcactggatgctctgatcatcggccaacatcagtattttccaagaaccctgaccaaagtccagttgataacttagaccttagaaaatttggcagattcaaaatttagtcagtgaggttctcaatcccagtgcacagcacgggactggaatgttttagttctccccaggtgatggaatgtgcagctggggcaagagccactggtctagagcaaccttcaaactcgagtgtgcctcagagtcccttgggctggtcaaacacagctgtgagactcacccccagggttctgatcaggcaggccaggggagggccaagaattcacatttctagcaggttcccagatgagtctggcacccacactttgagaaccactggcctagagagctttgctacctcaagtgtggtccctagagcgggagcagcagcaacaaggcgctcgttgggactgcagaagctcgggcccaccccatcctgctgaatcagatcctgtatcttcacactatgtccagggggcctgaggcacatcacagtttgggcagcgctgctctagtgggtgcggtttgggcgaggaggctgtgccacgttgttttctgccctcttccccagtctttttgatcctctgtgctggttcagggtggggagggagacattgacaacactctgggaggcaggcatccctgaagcagcaatccctgctgtgtccccggaaaggccagggtcccgtgccatgctgagggatctcccatgatccatcaggacataagttaaacaaagccaaattgatgtctttcccgtaggacttctcagaatcttaaagacagttgtggatcccaaagagagggttagaattgcagcatttccagacttacttggtcaaggaatgccttttcaccctcctctcacccgactcccacccttagctactaacattttgaggacactagtgttaaggggaccaactctccctgtttccccaggattgaggggttttctgggacgtggaactttcagtactaaaattgggaaaatccctggtcacctaggaaatgccagtctagagggagaaagagattggtcactgagagggtgagtgtttcaggataaaaagagaaggttgggagagaggaacagaacctagggcccgctggaggtcactagatgggtgaggggcacaagtccatcaaaaaggggctggtgaagggagacagaggcagaaacaaacgtgccttggagatgtcgtaggtggactgaccatgtaagtggcaggaggggagtgcttcggcttgctcaggtgacaccgccatctagtgaccacccagcaacagtgtcctggggcttttctgcagccagctcttcccaactttctccatccaggaaaggggggggggttatgggggtgtgaagggacaagaggacccccaacactttttcacctgtctgattttgaaagccccaggttttcgtgtcacatacatgagccttcatggcctgcagcctagagtccaactacgtcagcagcagcaaagggcaggtggtggtcgccacacagcctcgcatggacacccaggacatgcagcaggtcccagggagggaggggctgtggctgcagctggtgacgtcacacccacaccaccccagcccctcccgccaaggctgcctcttccgctgtagggagcaggtttaaaggctctgggctggaggcaggaggccaacccaggttctgggcctggtctttaccaagccctaaggaagaaggcatcgcagccctgggccttggttcctcctgtgtgaaatggggagtttcgttgggccaacatctcccaaaatgccaaagatactttttatactgtgtacgtgtattcaaaaacacacgtacttagtttgtcaagtcgatgagaaactggctgctgttgtgctgctgctaaccgtaggtttaaaagtaaagaagagggaaaagagagctacaggcatgatggaggtggtgatggtggctgtgggcaacgcctttgggactcactgccctggccactctagaccagctccagcaggccagggctacggtccttcagtccgaggttggctcttcctctgtcccagaaaacctgctctggtttcaatggaccaagtgattctgctccgtggtgtttctactgggaaagggagtcactgattgacaggggcgggctgggtaggggggtgggcaaagccgcccaagaagtccctgtcattgatgaccagcctgacaaatgtccatcccctgctgcctgtgcccaccattcctggaggctgccctctgggctatgccagcagccttcatctgaaggctggcattaggaaggcgtcttctgatgtccactctctgcgggttgcttgctccgtcatcccttctgggcagcctcagcccttctcccctccccaccgcagcactcgtctctcaagaaggtgtcacagaggagcccagtggccaagctcagacatcctttaccacctagaacagaatgttcctttgtgaatagggacaggcaagctggacgccctgacctccgcagcctggttaatccagactttctctccctgttttccaaatagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccaggtatctactgtctccgtagggctggcgctgggcccccatggccactgaaaagcatgggccattcattttccgaaaccaggggactatttccatggtgtgggtaggttatttgtcacgacatggaaatatcactgaggtattttagaaatagtccagcacggaggagctgggctttgagcttttaggtatgtgcttcagtggggcgagaggaaggcactcctccagagcttccccatccacctgtcccccggaagctgagaaaaactcccgctgcaaaggcgccagctcctgcctcctgagcagcgctctcctccgcgcctaccgcagcagacagcactgacagagaacgttgctaccttcacgggaaagtcccattccaggctaagagtagtcgcctacagtttaggttccctgaaagttgccttagacataaggtgcttgattattaccatggttattcattatgggtagctccaaacaatagctctacacccactggttcaagtagttactattattcctagtttatggaagaaaaagaaggtgagggcagttaggctcctggcacatttgctagtgaattgcagagcccgtggccccaggagtgaggacaccggccccacatgctctctgcccacgtcacatcacctccccatcacggatgggccctgaggcccaggggcagtgctcagcaggtgctctctgctgacactcagtctctcctttcagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaaatgtatctacagtttttggttttgggttttgcttttgtcacttactggatacagtttaagacttctctcaacacaagattttctctcatgtagaaacacaagctaattttgaaaaaatggaaaataagtgggggggacaaatccatccaacctttttttctgtcacccttttctgcgtttacctcttcatataacccgtgagaccgcaccaatgcagtggatgaagtctatcatgggaagatgagagatagatagagtccacaagaaaagttagaaaaaaaatttctaattggctggatttaaaacagaatgtgagccccttggaattgctgcagaatcttgccactccttttgagagtgtcccgggcagtcttgcccatctcagcgtctctttttggccagggccatgcagaaccacattaggtttgaatgtgacctcagagcctcacctcagaggggggagtgtgtaaactattgtatttgatttttgtatgagttactttacatggaaaaattaacttatgccaccttataggtagaaaagctggggtagagaattaactaagccgattttctgccctacatcagtcaggggaagaaaaaaataacagatttacacatccctttgcaaggcaaaaattgcatctacaaatagcaaattcttaacctgaatttcctgaccagtctcttacatgtggatcacttttctattattcaccctcctgtagggtgggtggatcagccttttttgagattacccaactagtatattacaaaccagtcccttggtatgcgccgggggcaatggtgaacaggatagacacagtcgctggcctttatggcacttacattctggaaaaggagacagacaatgatgcataacaaataaatcatatgattacagactgtgatcatgtctaagaaggaaataaatggcccgatgtggtggcgttaacaggacagtactttaagcggttgaggaacttcgtgaactgaaatttgaagaagaaggaacgagtcattaaaattcctagaaggcctgtccaggagaggtgacagcaactgcaaaggccctgaggagggaaagagcagagaggaggcctgtggttggaatgggaaagtgagcgatgggaagtgagcttggaggagggagcaggggccagatcacataaggcctcacaggccacagcaaggagcttcattttcgttgaagagaaagagagtgccactgagggttcactgtggggtctggcaagatctgatttatgtttgaaagatcactgttgccatagaggatggatgggagcggggcataaagggaggctggaaaatcactccagaatctactgtagtaaagccatggaagatgatggcagcatggacgtgggaatggatatggagaaaaataggcaagcttgagttatactttggagggaaagttgccaagtcttgctgatgggttggattcccagctgagggaaagggggataaagagctttacctgctggggggatgctggtgccatttccggagatgaggaaagtggggaacagagctggcctgcagagtaaaaatcaagagtggtttgaccatgtgaagtttgagatgtctgtgaattaggtggaaatatccagtaacctgttgaacacaagaatctggaggttgggttacgtctgggctagagatatacatttgggagttacagtggagagatgctatttaaagccacaggtctaaatgaggtcatccagggtgagtatacacaaagaagagggcctgcgaccaaggcctacaggaactccaatgtgttttcggacatggccacatgtgattttccacctctcccacggagggatagggtctgtgtatttaggtgggcttgtgattgcttcaaccaaaagaatatgatggaagggacaccatttgacattcaaggctagatcatgtggccatgcagcttcaacctggtttgttggaacattcacctggggagccctaagttgccatgaa

SEQ ID NO: 12825 - DNA, 28809 bp, Human
ccattgtaggtgggaggctgagctgtgcatggtttttttgtttttttttttgagacagagtctccctctgtcgcctgggctggagtgcagtggtgtgatcttggctcattgcagcctctgcctcctaggttcaagcgattctcctgcgtcagcctcctgagtagctgggattataggcatgcaccaccacacacggctaatttttttgtatctttagtagagactgggtttcaccacgttggccaggctggtcttgaactcctgacctcgtgatccgcccacttcggccttctaaagtgctgggattacaggcgtgagccaccgtgcccggccggttcttggttttaaagaggtaagtcaggatggtggatcactgccattgacttgaggcatgcagtctgttgttatggcttatgaccaccacccattcatttgttctttcactcattcacctgttgggatatttaatgagcccctgttgtgatgtagtagaatatggttgtctcttggaatcctcaggggattggttccaggacctcctttggataccaaaatccacagatgttcaagtccctgatataaaatgacatagtatttgcatataacctacacacatcctcctgtatactttatatctctatattacttataacacctaataatgatgtaaaagctatgcaagtagttgttatactgtattattagggaataatgacaagggaaaagagtctatacatgttcagtacagatgcagctctttttcaaatattttccactggtggttgattgcatccatggatgtggaactcacagatatggagggctgattgtacttcttccttgcttgaggtttttgtaatggctatcaagttttttgttttgttttttttttttttgagacagtctcgctgcgatgcccaggctggggtgcaatggtgtgatcttggctcactgcaacctccacttccttagttcaagtgattctccaggctcagcctcccaagtagctgggattacaggcgcacaccaccatgactggctaattgtatttctagtagagttggggtttcaccacattggccaggctggttttgaactcctgacctcatgtgatctacctgcctcggcctcccaaagtgctgggattacgggtgtgaaccactgcgcccggctggttatcaagttttaaggaggatacctgagctgctagttttataagaaagtgagaaaaaactgtttttgtgttttctcttgctcaatgcttgtaggcaagttttcttaaaagcaagatattgcttactgttcccttcttgttctatttatgctccatttggagggcatttcagctcaagggagaggggtgtgggaggccccttgagggcatatctctggatcactactttctcactcattcctttggaacacagaatctcttctgctcactggcctcttaaagaggcagttgggtttgatgttctttggcctgatgtctggagtcagcttgtatgtagtgcagggtggctgtgtcttagcccttacttaaccatgagtagtaagatgagggcctactggagagcgagagcaggactgtgtttgggcagggagtgaggggccctggggtggccaggaagacagatggcagtgccctgtcatcttaagcccagaaaaggccatttataaggaggactgtcaatgtcagaattggttgggaactgtggacttatggggacagtcatgctggcgggggggtggggacagggaggtatttgaagagtgtgagtagaagggcttctctttgtagagatgaggctggggatgagtgtttggaattctgcagctctggggagtggctgtgagcagagaggggccctggttcgggcactgggtgtttgtggtggttgtgggtcaggtgggtattgcagcttggagaaagccccagacccctaccctgggcccctaacttgtgcctcttgtccctgccttcaccagacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccaggtgaagacgggcacagtgagaggctgggaacaccagggcctgtctgggctgctttggtcttggggacacaacagcccctcgtccccgcctacctggcaaaacagacagcctgtcagggctccctgctgtatactgtgtgtgcagtgtgctgggggcctgacctagtgtcatgggaagaggcagcaggagagatccagtcccttgcctattcgccatcgttgctggctgggcctctcagggtatgtggcaatggacgtgcgcctgggagcttgcttccctgccgtgtctccaggaggaagccctgagtgcccgcaggtgacttgcacatggccttggagagctcacttggtgctggacaccccagcttgacctgtcgctgccaggaaatgggcaggggccaggctgggtgggagaggggaccagtggttcccaggcagcctcaagtgacaccctccttgtgccaaacagagaattcagcaaagagccagagctgatgcccaaaacaccttctcagaagaaccgacggaagaagagacggatttcttatgttcaggatgaaaacagagatcccatcaggagaaggtaggaggggttgggggagagtgagctgagcagtgggctctgcggaggcttggtgccatctgggagtttgattctgaaggtgttgatttggaagtagcagcctgtaggaggggtggtgggtaccaccgcgggtactgcgtgggccatgctgagaggggttgggatgccacagggaactatagcttgacccaagaccctggagtccaaatctgtggctgtgtgttgggggtgggggtgtttgatctgggccctggagaatgggaaagatttccgtaggtgggatgagaaagagaagccatccttctgttaggtgagtgtgaccaggggtgtagaccacgtgccttgtcccagccgtcatattgtcatgcttgttttagtccccctcaggaatgattggggctgcagagtgctagggaaagaggctgggtcttggggttaggcttgggtgtgaaccccagctctgccccttagcagagcagtacggctttgaattgaatttctgcctctctgagcctccgttcctcatccctaaaatggggatagtggtctctgcctctcaagggcgtgctctggattaaggcagagcgtgtgtaaggctttcagcaggggctcggtgtggtgtaacttcagtcagccggaggtttggatgaatataatcttcctagccagttctgtgcggactgtggcatgatccccaatttacagttaggaagactgcggctcagacaagaatggcctggggcctcatggctagaggtggcagaatctggcctggaacccagatcttttgccttcaccttctcttatcatactctatccaagctggtggctcttggagagactgggtgccaccctgtcctgctgcccgtctcagcctctgccctgctgcccctgccaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtgagtctgggggcttggcagtggcgggtggtccttggtgccaggctcagatggaggctttctgagggatcatctagcaaggagctgtccagagagctttctgcagtgaggtagatgttacacatctgtactgtcctgggatggtggccgctagctggcctcatctggcgattgtgtcctcaaaatgtggctagtgtgattgaggaactgaattttaaattgtattgcattctacttcttttagatttaaatagttacatgtagctagtggcttccacgttggatggtgcaggtctgacccaacctacttgctttacaagtgaggaaactgagcttcgggaaggtcggccactgtgtggctgtggttactggccatgttgaggctggagcctgggcctcttccgcagggccagctcattcctcccaaccctatgctgcagaggccacttaaattcaccgggtttgcgcgccgcctattggcgacactgtgtttgatctagaggagggaattatggcagcaggctccttcggggagatcagatgactgggcatctgatgggagccaggagggggaaccaagctgactctggagctggccggcctgggtctgagtgccaactcagccattcacccaccctgcagcctggggcaggtcctggaaacttcacgggcctccactccttgcctgtcaacgggggctaatcgcgtcacttcaaagggtcgttgtgaggttttctttggtcaccccacacagggagtttagaagggtgcctggcatataggaaggactcggtaatgttagctgctctctcagatctcagcttagggggccattgcccactggagcaggtgtctggaggggcaggctggctgcatgaggaggtgaatctgagctgggagggttctgaaggatggctgcgcttttgctgagtggaaaaaaaatgcggggatatgtgttattggcagagggaacagcttgtacgaagaccctgatgcctaaagcaacaagtgatgggtgtctggggctcatgctcacacaagagcttgaacttgaccccactgaagcaaaagaagtggcttgatgatgggaaagtgagggaaacagggagaccagataggaggctgctgtaaggatgcaggcagaggacgggcgaagcagcggattggtggcgaggataggccaggatttatctttttttttttttgatacagagtctcgctctgttgcccaggctggagtgcaatggcacgatctcggctcactgcaacctttgcatgcatctcaggttcaagcaattctcctgcctcagtctcccgagtagcagggattacaagtgcccgccatcacaccaggctaatttttgtgtttttgttttttagtagagatggggtttcaccatgttggccaggctggtttcgaactcctgacctcaagtgattcacccgcctcagcctcccaaagtgccgggattacaagtgtgagctactgcgcccagcccaggttttatctcaacgcatgttaaatagtagctggcatctgcctggcactttaagatttataaaatgaaaggttatttcatttggtccttacagcagcattgttagcttgtgaggaatttttcactttacagaggaggaaactgaggcttaaggaggccatggagtctgtaaatcgggaagctggggcttgagcgctgtgtgtttcattctgtccagaaagtcaggtgcttgcagaagaggctttgtgcaaggccgcagggcagggcctgtcaggcaggggagggcacctcaccttggcagctttctctctgcctgagtcacactgcctggggacgggcctgctccagggtttggggtgacatactctggggcgtgtgcagatgtgcagtctgccacactgtctatttctggattctcagaaggatctaaatggttctgatctgttttggagattttctcaggcctggatctgatcttgggaaggggcttcaagcgggggcaggtgagcctgggcctgtagagggagggccaggcagggttgcagagaatctctggagacctttggagcagacatccagatctgcagctctcatgcccttccatcactcttccctctctgtctaccctttccctgcccatgaatgggcttctgatttgactggtgcatgttacctgggtctgtctgactcccagcccagcatcatctctcctcttgagggggtggaggagagagaggaggatacaggatctaggatctggagtcacacagaccctgggtgaccttgggcacaccccttctctcaacctcagcttttctgtgaaatggtgataacacttgctttgaatgtgaatagataactcatcttagtgcttgagtgtagtggatactcagtacatcttatttgagaaaactcaccaatggctgatgctcagtttgggtgcgacaaggccgacccctagtgaggagctgcaagggtgtcagggagtggggcggtgacaggggaggaggcttcctgagggtcttcctgataccaggctctgggagaggctctcgggcagctccaaggtggggtcttggtttgggtgttccccacgagcagcccttgacacaaggatttgagttcaatttgttaatttttgggaaattaacaaatttaatttcccaaaaattaaattcaggatgggaaggaaacacctgcaccagaggaatggaaaaatgagataggaaaaaaagccagcagtcagcgtgggtggagggggcttctggaagccagagtgtggccccggggcgtggaactgctgtgtgtcagcaggaatcccctgcctcctggcctggtgcgcacctgcctgcggggcccatcgggcagcagttctgaagtggataggaagggacaggcccactgcctcaggactccaccttggggcgttcgagccacctctgcattggagaagagtccttccatccctctgccagtgcttaggccacttccctaccaccagaccagctctgaggcctgaatggcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatacccaggaagggtcctggcttcccttctctgtgcctggcctgttgtcttccctcttttcctgagaccctgtgcaccccaacctcccgctggccacctcccagcctgaactctgaccaagcccccatggctcaggatgcgccagctcagctaccttctctctgttccccaaaaaagcctctttttttcctgcctcatggccttggccctccttctccctagaccagtggcactgggaacaggcatgctcccagctaggaagaagccggggacataaagctagcagctgtggtgaggataccagggtgagtgctgagggtgagggacctgggcttcctgtttttaatgattaagcctcagcctcaaaaagcttttgacagcctggacaacatggccagaccctatctctaccaaaatggaaaaaattagccaggtatggtggcatgtgcctgtagtcccagctactcaggaggctgaggtgggaggattgcttgaacccaggaggtcgaggctgcactgagctgagattgtgccactgcactccagacagagtgagactctgttaaaaaaaaaaaaaaaaaagctttgattatgaggttatatctattgatcgttactgtattaaaaattaaaactgaggagtttaaaagtattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagacactggcattattctacattttgcaaatctctttattgtatgactttaaataagccacattctgcgtttgatctgttgttgcattgtgttgtttgggttaaagtaactgaagaactggacgggcgaggtggctcacacctgtaatcccagcacattgggaggccgaggtgggcagatcatgaggttaagagattgagactgtcttggccaacatggtgaaaccctgtctctactgaaaatacaaaaaattatctgggcgtggtggcacgtgcctgtagtcccagctactcaggaagctgaggcaggaggattgcttgaaaccgggaggtggaggttacagtgagctgaattcacgccacttcactccagcctgggtgatagagtgagactctgtctcaaaaaaaaaaagtagctaaagaacatctggcctcacatagacgtgtagttgggaaagggaggagtatcttcatagctttttcagataattatgcatattctttgttatcaggaccagcgcaagaagtggtagttcttaaaggtttgttgtggtgtggaatctgaaaccatgttgctgattccacacgggtctaccttgcactttgttttgtttttttttgttttgttttgtttttgagatgaaatctcactctgtcgcccaggctggagtgcagtggtgcgatctcagctcactgcaacctctgcctcccggttcaagtgattctcttgcctcagcctcccgagtagctgggattacaggtgcccaccgacgcccggataatttttgtcttttcagtagagacggggtttcaccatgttgccaggctggtctcaaactcctgacctcaaatcatccgtctgcctcggcttcccaaagtgctgggattacaggcgtgagccaccacaactggccacactttgaatggatcttttagatgtgtctgatttcataaccacatacatcgatcatttcgaaaatattgtttcaccaagttatgcacgtcttccaagtgttgacacccttcattatataatatcctaaaaaagcacatttgttttctgacctcatcagaaaagtccttagatattaggatgctgtgaccctgctggtggtggatacgcgcttttcaaaattctactcttggattcgttttggctcaattttttttttctttttgagatggagtcttgctctgttgcccaggctggagtgcagtggcacaatctcagctcactgcaagctccgcctcccgggttcacgccattctcctgcctcagcctcctgagtagctgggactacaggcgcccaccactacgcccggctaattttttgtatttctagtagagacggggtttcaccgtggtctcgatctcctgacctagtgatccgcccgcctcggcctcccaaagtgctgggattacaggcgtgagccaccgcacccggccttggcccaatttttaaattattgtcagcacgtggtgttttatttttgtgatggattcacttcattgacttgtgaaaaaatgtcttccagatacccaagactgaataaccattgtcagtcgttcttttaattaataatagtggttcaggtgaaaaagtggctagtgcagctggcagcttagagacgagcgcttttcacagagagttgggtttgcagcaacaggcattgtgcacacttcccacgtcagcacacagaagagtagaatggcatgtacttgagtttagatttagtaaaattaggacttttgcaggcgcagtggctcacgcctgtaatcccagcactttgggaggctgaggcaggtggttcacttgaggacgagttcaagaccagcctggccaacatagcgaaaccctatctctactaaaaatataaaaaattagctgggtgtgatggtacatgcctgtaattccagctacttgggaggctgaggcaccagaatcccttgaacccatgaggtggaggttgcagtgagctgagattgcgccactgcattcagcctgagtgacagagtgagagtctgtctcaaaaaaagaaaaaaaattagtactttttacaccttcatcaaggacattcctcagtgaaactggacatctctccttcccgtgagtgtgtggtccgaggatagtgtttgatgctctggccttgactggggctgaggcttcagcagctagttcctcattgcttttgtgccatcagggcaaatgtcaacatagtgaaagggaaagtaacattttagtatcataattttagtatcatgattagttacgacctcgtggatcccccatgggtctcaaggacgtccaagggtcagaggatgcaagctgagaaccactggcctggacatcctcctcctttgtaaactcctccaggccagctcaggtccccccatcataggcttttaaaattctctgctctggaccaggcgcagtggctcacgcctgtaatcccagcactttgggaggccgaggcgggtggatcacttgaggtcaggagttcgagaccagactggccaacatggtgaaaccctgtctctattaaaaatacaaaaattagccggaagtcgcttgaacccaggaggcagtggttgcagtgagctgagattgttccactacacaccagcctgggcaacagagcaagactccgtctcaaaaaaaagaaaaaaaatttctctgctctgttccaccattgcccatgctggtgttgttgataggactatttgatgattgttatctagaccagatggtggttctgttttgctcaccattggggtcctggggcctggcccaggtcccagtacactgtagacacttgatgaatatttgttgacagaataagctgctttgtgttgggccccatgctgggagtttggggcctggagctgcagcaaacattgtccctcttctcgagatattcccagcccagtgaaggtgcccagccgtgctctcagatgggcatgggaagaccatctgggaagcagccggggacatgaagccagcagctccgataaggacactagtatgagtgctgaggggagggtcctgggcatggtgggggctccacggctagtgatgggagcagtggccaggcccttgctggaacccggtcccctggaccccttagagtgggacctgtgtggtctctgatgagatcttttgtgcctttcttttccccctcaggtcacagttacctggagaggctcctgaatgttgaggtgccccagaaagttgggtgagttcagttccagggcttcggaggtaggcagggcataccaggacagggagccaaggtgagcaccagggctggaagcaattcctgggctgagtcttccccactgagccttgaccgcccaggagctgccccgttttccctgtctgaccaggcagtgagtgatgtgggtgttggccacctggtctccttgcagcacccgtcagcgttgctggttgcctggctagacctgaccctggggcgtgggctccagaggttgggggtgaggcggggctgccaggaagagctacattcaaactggctggggtaggataggagtgctccaggattacacccagtgctgcttcgggccaggacacagactccttttcctggaggccgtgtcctgccatcactaaaaccagccccctccctccttgctgcagagcagagggtttgttcttgggacggggaaacagggtgacagggcagacctgctggccttgccagccccatggtgaatagagaacagaccacaaaagagatgcagctcacctgggcccaagaggtggaggcggagctgaggacagggctcacatcctgagacagctctgtggtggggtgccagggagatgaagccacattctgaagctgacatccctcgtctgtccatggagccattgccgggagctgccatcctcctatcctacagggggctgtgggttcgtggccctggccagggcaccttgtgttgacctcttgggtccccatccctggaatggtagagggactccctagggggagggcttggactagctgggcagtcccctcagagtccctcttctgttttcagttctgagcagaaggaaccccccgaggaggctgagcctgtggcggcagctgagccagaggtaagacggctgcctggggaagggaggactcacctctggggctcccgctctgcactgcggccatcctgggccttgggttccaggtcaagacccctaaagccttggttctttccacaggtccctgagaacaacggaaataactcgtggccccacaatgacacggagattgccaacagcacacccaacccgaagcctgcagccagcagcccggaaacaccctctgcagggcagcaaggtgaggcttcctgacctgccgtgtgcagtgcccggagccacagcgggccttggcggcctcggcctgaccttctctctggggataaggaagccccattttctgggccagtaggctaaagagaaattaaacctgggggtgcagagatcccttttgagtctgtagacttcacctcccaccgttgggctggagctgtcactgagtgcagcatggggggctgtggctggttgggacaggaagcagaggaaggggctgcatcggggtatggatatgaagaggccaggtcaaggccttgaccttgactccaggggccagtgggaagagctgtgggctggggattgaacaccccacctggcctcctgctttgcctcccccgccagctcctttctgacctttgtatgtccatccttgtctaaagagggctggagagcagtgggtttgggagtgtcccagggtcctgctcacatctccctgagaagggtgcctctctctggtggaaagtgcactgtagctgtgagatcttgaacacggcctcctcctctttacgacgtggtcagggacaatggtcatgccagccctgcagccccaagggctgctgtgaggaacttttggagtaaggtgcaccttctcctagcagtgaaacaaaacaatactgaccctacaccctccatgttgaccctgcagcgggagctgccccctcctgctgtcatggccacaccagctgcatggcccaggaggggtggaatttagaagctgtgcaaggggcttggagctcctgcttctacaaggcgtccacacactgttcttcgtgtcagaggtgggtggggcacgtctggggctgccgcctcgacaggaccgtcccgccctgccttgcctatcatagagccaggcactcgcggggaggtgttcgtgagctgggggtagccaggccctggcatctgtagatttgtatttttagtagaggccgggtttcactatgttggccaggctggtgctgaactcctgacctcaaggatccgcccaccttggcctcccaaagtgcttgtagattcctcaaggctagtcagggttaaggctgatatgtctgcgtttggccaccccggagctgccaggaagggagccttgcccactgccaaggctgctgcccaaggaccccttccccctacacccccattcccaccctgccgccgccatcgtttctgcagccttgctgaaattgctgtcttcacagaggccaagacggaccaagcagatggacccagagagccaccgcagagtgccaggtttgcatccgggaaggggtgtgtaggtaactctgagggccctggaggatgtggccttgtgtccttgctcagggaaggtggatgtgtgctcaggggcttcagagcctctctgctggggtgtggcctggtgttgtgacttaaccaaggaggcggctccatgctgtggatgagcgcaaacctgggaatagggcgacccgattgttgaccccgtcttagtgtggtctcctggccatgtgaccttggactgttcacctcccttcctctgagtgggcagcagagggttgcttaggctctgcagcctctttcagtctagaggcctgtggcctgggcccggtattgttcaccggggtgacttttgatggggtgtggctgggctgtggcgggctgccctgtgatgccgccgcccgcgccttggcaggaggaagcgcagctacaagcaggccgtgagtgagctggacgaggagcagcacctggaggatgaggagctgcagccccccaggagcaagaccccttcctcaccctgcccagccagcaaggtgagccaggcacctgccctctcctggagccctgacccccttcagtaccctgccccgcctgcccacttctgaccctggtcctcgtctgcaggtggtacggcccctccggacctttctgcacacagtgcagaggaaccagatgctcatgaccccgacctcagccccacgcagcgtcatgaagtcctttattaagcgcaacactcccctgcgcatggaccccaaggtgaggggcctgtgcccaggccgggctttgtgggagctgggcagtgtggctgaaggtccagtctgtcctgtaagatactgggagtagtgtgagcctgggcggaggcaagtgtggcctggcactgttaggggccggttgaagcctctgtggccaccagctgtcttgacctctgagggcactgtcctgcacttgaccttgtgggctctggactacagcctggaggcttggccggctcaatgtgagccctggggatctgtgtagttaaggtgagaggtacttgtggacacctccaccactggggtgagggttgggtgacaggagaggcggtgggggtgctgctggcaggagggcaggccccacgcaggcttgctggcacagctgggcatgtggcctgcccggcaggatgctccccggcctggcattaactcttgccttttcccttgtctcctccacagtgcagcttcgtcgtaagtaaagccttttcctgtcggtaacctcgccccacctagcactcacccgctgtagccccttccctgcgtagctgacagcacctgtagatgcactaacattgtaagcgggaggggagccttaggaagagagtgggacggtgaggggtgcactggctggaggcgcccagcagttctgggccccagcgtccttctctgccctccctgcccttgactctgctcttaggaggaagcaagggggtgtggcttttcaccagggctacagcttgatgtgttctccacagccaccttccctccctcctcccctgcaccaggccccgtcagggtctgtgggtctttgaagagaacagacaggttgtctgtggtccccagagctactgagatttattggttcacagacctgagcagtagccttgaggcagtggggtgatgggggagcgcaagtgtgggtctgaactgaggtggaagtgctgggtcttgctgtgctgggtgacagtagaacagtgggtggtagcgtctagaaacaagtcgcagaagctgttctcttctcagacacctcagagctgagccgagccaggctggccctgagcaaggaccctcagatggggacatgcttagcctgcagccccagctccccgtgccatttgccaaggccacagacacctcattcctttagttcctgcaagccttctgaagggtcctctgcagccacacagggacacctgtgacagccgggagggcttctgcctccagttgagggcctcggcaggtgagaggggcttcccagcagctggccaggtgggccctgagctggcttctccgcatggaggcctgttcccctcttgttggagagggtgactgacagtataccttccagtggccttaccacctgtgccgattagagccctgcaggtctcacagggtgatagagaagaccaggaagtggtcccctttcctgctttggggatcccaggtccctgcacaaggcatctagtgggtggggacagtccatagttaggagaccagggggctacggagtcattttggactgcatcctgaacattctgctatgagtctctgggtcttgtttaaatctatggacaatgttgatattttctcagcattgcaatttagtagcaattgacctggttaggtttaggctgcaggttcccatctgccttctgtggactctggttccaatgttagtcccgattttgaagatggcagtgctgtttggacttttcccgggtgtgtgccagtcagcagtcagcctgggacttggcaggtggtctgttagtttagttctcagccttcggtgtggtaattaggatcagatcctagcatctgcagcttagagctgagcctgggcgttcgtcaataacctgcagcatcattttcccgatctcctctggggctcccttttctgtcctccagccaggaagctggggcttcagttaccttgttctgctttgtgtgcttctacgactgtgtccagggccacctgccagggggacagggaaagaacaacacataggatttggcccacacttttgggatcacagctcctcctctgagttttgacttggcagctttctctgtccagggtcgcctggcagggggacagacggaagagcaacacacagggtttggcccacacttttgggatcacagctcctcctctgagttttgacttggcagctttctctgtccagggtcgcctggcagggggacagacagaagagcaacacacagggtttggcccacacttttgggatcacagctcctcctctgagttttgacttggcagctttctctgtccagggtcgcctggcagggggacagacagaagagcaacacacagggtttggcccacacttttgggatcacagctcctccctcgaattttgacttggcagcttttcttcaactgctgctgcccctggttgccataggactgcttgtgggctggggcacaaggcaaagaagaaaagagaacaaacaaaaatgggatttctgccttctctgagcattagatactccctttctgctgcttgagtcaggactagagggcttgtcctggaattctttctgtccgtgccccagtgactcctttggagttccaggctgtgttgagttaggctggagaaaaacaatggagaactcactgctggttggctggtgcttccaagtctggtcttcttccctatctgcctgctcctctttagttttcagaggcctcaagtagccgctccttgcattctgtccaggttttgtagctgcattcagtgggagagagaggtggagtatgtccactccatcttacccgttcccgggaccccttctctccgtctttgggaggatggtattaccttggagccagatttctaggcgagagtgctcctccagttaggctcagaagccaaggagaaatcgatagtaaccagtacaggaagagggggaagctattggacactgtgcctaaaggtgggagtctactgggagccaggttggggtgatgggtgtggggcttccctctgggtcccagcctccacccagccccagactgttcaaggggaaagcactagccttgtccttggccagggagggcttagagcccctgcccatccctgctggctgcccattgctgtggctgtgcccctgggactttctgtgtctgcccaggagggggtgccagcatcaatcagcttttcagccaactagtacttttttaaagttgccttaaaaatgaacatagccagctgggcgtggtagctcacacctgtaatcctagcactttggaaggccaaggcaggcggatcccttgaggtcaggagttcagcaccagcctggccaacatagtgaaaccccacctctactagaaatacaaaaattagctgggtgtggtggcacatgcctgtagctccagctactcgcgaggctgaggcacgagaattgcttgaacctgggaggtggagggtgcagtgagccgagatcgcgccattgcactccagcctgggtgacagagcagactctgtctccacacaaaaaaaaaaaagaaaaaaaagtgcatagccatgtcacaggaagtttggaaaataaaagaaaattaataccatccctaatccatctcactagactgttagcatttgtcaatatttccttttatttttttcaactattatgaaatagttgatatacacaatagaatatatgtatacatatagtatggatattataaagcatgacagtagtaagttaaaccttgcatctgcaccacccccttactagaacattcaccatgattgggagagctgcctttctgctcctcacccttccaagctcatccttcattttctttttcaatgcacagtttatgtagttgtcattagcacataaatcctatttggagcctgacttttgtgttgcccaaaacttggcagggctcaatggagggcactgtggctcaggcccttgcgaggtagctgagtgctcctgggaggaaaggcgggagctgcgggccttggcttgggtgctgttggggccacgttggggatacctctgcctaagaagcattctgatgctgccacccacgtggctgcaggctgctggggactgtgggcagcttttggggctgggtggggggtcgtccttgctcatgtcccatctccctcgctccccgccaccccaggagaaggagcggcagcgcctggagaatctgcggcggaaggaggaggccgagcagctgcgcaggcagaaggtggaggaggacaagcggcggcggctggaggaggtgaagctgtaagtggcctggcttcctggactgtggcccatcccagccttggtggggctccccatgactatcctatgccccgcaggaagcgtgaggaacgcctccgcaaggtgctgcaggcccgcgagcgggtggagcagatgaaggaggagaagaagaagcagattgagcagaagtttgctcagatcgacgagaagactgagaaggtgggagcctgggctgtggaggcccaggcaattcaggacttgggccaagggttaggactggacccctcaggaaattgcagatttgtcactgtacccctgtacccatctcctgtctgccccatgggccctggagtccactcagctctgggtttccctggcagccctttgtgagtggggtctgacactcaggcaggaccggcttctggtgtcctctccctgggtggtgggaacaagccaggtgtgcaggggcaggtggggcctgtcacacacagttctgggctccactctgcaggattgaatgtgggtgctccaatgggcatgtgtgggtgggctctgcaggccaaggaggagcggctggcagaggagaaggccaagaaaaaggcggcggccaagaagatggaggaggtggaagcacgcaggaagcaggaagaggaggcacgtaggctcaggtggctgcagcaggtgcgagcacaggtgggcctcagggaggaggtgggcggggtgggcgctgtctcagcaccatggggccctactgggtgcaccccaccttgtggggttgacccagaccatcttgttgcttcatgctaagaaggaggtttcgcagaagtctccagggcggggatggtgaccagaatctgcctctcctgtagcagcagtaatttgagggttaagtgcttgtacttggagccagactgcctatctcagctctgccatttattagctgtgtgactttctacaggctgcttgacctctctgcttccatgtcttcaagtagcagtgagggttaaatgtgttaatgtctgtaaaatgctcagtagtgtctgatgcctgctaagagttctatacaatggctgttatggtccaccccctgactgttctgcctataagagtaagggcccacctcttcccagccagtcttaggactctagagaaggcaaatccaccattaggggttatgtgactagtcaccaaggtcagttatttactgtgtgctaggccctgctgtgtgttgtgcgtatcaacccagcaaccccatgaagtgtgggaataactgcagtctccattttatagacgagtaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccattcctgggttgtccgtggtggtggctgatatgaggggcacctgggcttcaggggagtagggctgctgtcctgcctctctggcctgggcctggccgcagcacctgaccttgctctctgtttcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagaggtgagggacctgctggcccgcctgcctgccttccatgtgtgtggaagagagacggtgtgaaccttgcctggacacagccccacctgcatgtgacggtttgcaggtgctttccttggcaccaaacccagaggcccacctgaatacactgcccattggctatgggagatccaaggagtggtaggtgggcttgcttagggcttggcttggttctgcctccagctgcatgtgctgacctcttaggtgtctttttgtaactgtcaggagtgtggtgctcagaggatgagctgatatttctcagcagggccaccatgggcattttgggcaggaaagatctttgtgttacattgcaggatgtttggcatccttggcccctgtccccactaaatgcatctcccctggtgaggacgataactcagattaccccctaccgatattttcagactgttcccctgccttgggaaccgtggacccaggagccctgggattttccagctgtgcagatgcagtggtctctgtacaatagacaagagttccatgtttagttttacaggcatttgtccctggcctaccctgtgcctggttgttctgagagtcgtggggatgccaaggaggaaaagccacactcactgttggtcaggagatacatgggatcctgtgtctgtgtgcacagaagtagagcacaaggcccgtgtgtgtgagacacgcaggccccgtagctgttccctctcccgctctacctcctgggaaacaccgggcagcacgttttttccgtgtccatcttcgtgggtggcttcaggtttatcagataagtgaagagtcacagccagggggctgcactgagtcagggctgcttgatggggacaaagctgtccttggtcctctgggcagagtctgggaaggcgagaaggcgtagggtgtagctaatgtgcagggtgctgggcagagcagggggctttgagggtggcggtgtgatagtcatagtgtcggcagctttggtgggtacccgagctgcatgctttacacctgtttccttgtttagtcctcagttgaagcccatggtggcatgggagccatcagctccacttcacacagggggaaacaggtccagagaggttaaatgacatgttcaaagtcatgagccagtgtgttgtggaggtgactccagaactcatccacagcctcttgttcatgcttggagccagtgtctgccctgaaggttaggataaaaaggggtattgtggattatcccatttgattctcatgttgaccctggaggaaatgtgttatggtctccattgtataaaagtgttatgaggctcagagacccaagttacaaggaaaagtgggggccaaatgttgggctccagcttgtgttccctgcaccctcaggtgtgcacacttctagccccggggcaaaagcgcagctcttggctctaagctggttgcccattcagcaatcccactttctaaggtgtgtcctactggctgggcctggtttccccagcagggatgggaacagggcttgggctgggcctccacttcctgtcctaacaggctcttgctgggtcctcagggagctgcaggagcgggagaaggccctgcggctgcagaaggagcagctgcagagggaactggaggagaagaagaagaaggtgaggggagctgggttgcgggctcccctggggtctgccctgagctgtgggcgggtctggactcctgcagcaggggctgcctagggaggggagggaaagggaggagaatggagcggagggaaggggaggggagggaagggcacctgcacagctccctaacaccccattgccacctgggttccaggaagagcagcagcgtctggctgagcggcagctgcaggaggagcaagagaagaaagccaaggaggcagcaggggccagcaaggccctgaatgtgactgtggacgtgcaggtgccacctgggccccagtggagaggctctcaggtggaggggcccactctattctcttcccagtagctagaggcacaggctgtgttaggcccctaaggaaaaggacagatacacttggcccaattgtttttacttctttttatattctttgttattctaaaagtagaatttgttgaggtgggggataaaaaggaactaaactttatagaagagtatacagttttaaaaaaagggaccctcaggaaaactctactaagcgcgttgtatatccttctagatttttacttatgtaacccttttaacacacacacagatatcctctctctctctctctctctttcacccatacacatacatatttaaaatgggcacataccatttggtggcttgatttccaggcccccaacccccatggttttttttcacttagtatattatagacatctgtctatttcaacacaggtcaatttcttagttttgatgactgtgtaccttaattgtgctggaattcagccggctcctcttgatgagcatttgatctattttcacttcactgctgttaccaaacaaaacaatgttttcattgcagcattgttaagatgtggaaaacttggaagttagtatggtatctgtcaatgatggatggttacgttgcaaatcctggagtctccttagtggttcccgggaggattctagacacactgacctggaagaaagtttgcaatacaccttagcatcaaaaaaggagatacagagtcgtgtgtgttctgtgactttttaaaattaaaaagtaggcctggtgcagtggttctcgcctgtaatcccagcatattgggaggccaaggggacagattacttgaggtcaggagttcgagaccagcctggtcaacatagtgaaacccagtctctactaaacatacaaaaaattggccgggtgtggtggtgcacacctgtaatccagctacttgggaaagctgaggcatgagaatctcttgaacctgggaggcggaggttgcagtgagccgagatcacaccactgcactccagcctgggcgacagtgagattctgtctcaaaaaaaaagaaaaagtgatcctgcaccttttgtttctcctgtgaaataggaggaggtgagcagtgccccagcactcctcggtggtgagagatgggaatgccatggagggaactgacggccacgtttgtttttgcagtctccagcttgtacctcatatcagatgactccgcaagggcacagggcccctcccaagatcaacccagataactacgggatggatctgaatagcgacgactccaccgatgatgaggcccatccccggaagcccatccccacctgggcccgaggtaagcaaagcccacagctccctgggagactcaggccctccctggtcctcaccttgagggccctggaagtagtgggttggctgctgcggtgttgggaggctgccgtgtgcttcagttggcagttcgaggctctagccttgggtatgcatgtgccctggggagtgtggggcaccctgtggtcattgtgctttcctgaggaccagacctatgaggttgggttcctttgttctcaacaaatatatgaaattgtgctgggcttgggcatggcatatgctgctgggtgtcctgacttggactaggcccttccttagagtcccatccagcagggctgaagagacttggacctaagtaagccacctggggcagaggcagagctagaatggggaagggtttaggcagaacaccaagctggagcctggggcttccagccagctcggggaggcaggaaagtccctgaggagtgcatgaggcacttgagcaggatctgacctggagtttacaggccccagcattaaaccagaatgtgggtgagcgtgactgcaatgtctcaggcctgagtgcaaggccagcttgagtgagcagggtaggtgctagaagtgggtgctgccagagtggatggggcccgtgggtaccatgggtgccttgcagtggttgctgagccggaagtcagggaggggtgcagacgccccagagggaagggcctggaatcccatagctggtaggcacactacagaaacttgtttttgtgagtttcacctcatctgaaccctacagtaactggcatgtgctttaagcctcttaactactagtgtcaagtcatttgggagatggcagtgagcaggagccagctcgcttgcaaagccatctaatcggaggtgactttgaacagcttacttaaatagtttcctcatccgtgaaaggggggtgaagacaagacccagctgaggagttctattgagagtgacatgagtgagctcacggctggcccttagagccgcacctggtgctgagcaagtgctggtgcatgtctggcctcctgatcccctgggtcttcctcagccccgttgtcaggactgtgccttcccacatccactgcccagaggccccctcagcactgcaccagggcctgtggggtctgtgagaagcagctggccaaggtggtcaaggatggcatcctatgcttaagctctggaactgggcttgtcttcaaacacaggctctgccattattagctgtatgcctttgggcaaatctgctgaatgggagaatacagaacctgcctcccaggtggtggtcgggacaggttcaaggagtgcctggctcatgcgagctctcaaggactttgtaaggttaagctgccagaggaaggttggaaggatgtgacacaagggcgttctctgggtttgatggtggtacaggcaggggcagggctgaagagggtgacagagctctctgtagggaggttggagagggtgacagggctctgtggtgggcaagggatggggaggttcatggagagccccaaggcagtgtctggtctgtggtctcctgcaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaactttttcagaagttctgcttaaggacaaaataaagcctaaatccaagaacacttttaaaaatgaggaaatagtgaacacaatagacggaagtctggaagtttctacccatgccaagaaaagcattttatgttttgttcacatatgttgtgcaattcaaatttttttccctatattctctgactagacacttgtactgagtcaattggcgagtgtgtctgtctaaaagcacaatatcaaaatatcacttaaagcatctttacatagtgtgtttaagaaaaagttgttattcagcagaaaggtaattccaattggtctgcatatttatcagcacttggtattgtctgtttcttattttagccattctgataggtgtgtactgatatctaatcatggctttaatttgaatttccctaatggctgatggtgaacatcttttcatgtgcatttctgtcatctgtatgtctttggtgaagagtcttcaaatcttttgttcatcttaaaattggattgttatattaccattgggtttaagaatctacatattatggatacaaatatgttgtcagatatgtgttttgcagcattttctcccagtctgtagcttgtctttaaaaaaaaaatttttttttttttttttttttttttttagagatgggatcttgctacattggccaggctggtctcgaactcctggcctgaagtgatccttctgccttggcctcccaaaatgctgagattgtaggcatgagccgccatgcctagcccagcttgtctttttgtttacttaccagtgtttttcagagaacaaaaattttaatttgatgaagtccaattaattaaatttttaaaatagagtgtgatttttttgtcatgtctaagaaactattgtctagtcctaggtcctaattctcctttgttttcttctaaatgttttattattttacatgttaacgtttagatttatgatctattttaagttttttttaagtatgaggtttatgttttttgtttgtgtttaggagcatatggatggatgtctagttgttccagcaccatttgttggaaagactatcctttctctgctgaatttcttttatatctttgtcaggaattagccatattggtatgggtctatttctagactttttattttctcccattgatctgtacatctctccttttgccaataccacataagtcaagatgactatagctttgtaataagtattaaaatctggtaatataattcttccaattttatttttcttttaaaattattttgactattgtatcagtgttacctttccatttaaattttaggattagcttagctacaaaagtcctgctgggattttgattagaattgcattaaatctatagataagtttggggagaattaacatatttatgatcgccttttaatccgtgaacatgacgtgtctctccatttatttgcatgtttagtttctttcttcagcattttatagttttagcatacagatcttgtacatattttcttagatttgtaactattttcttggagctgttgtaaatggtattgtttttctgatttttggtttctacttgttcattgctggtgtatagaaatacagttggcttttgtgtcggctttgtatcccgtg

SEQ ID NO: 12826 - DNA, 21535 bp, Human
tttgagactgaaaggggacaagatctgtaaacctagattaccctagagaggtgacgttgcttgctttaatactttggttgccttattaatttttcaaaaattgcatcctatttttttggttttcaaaataagaaagacatacttgaataaagttatttcctcttcaaagtctttctagattccacttttccccatgctgagttaaatgcctttctctttggttctggggcagtggttctcaatgctagggggtggggtaaagctggaattttggtcctttctcccctaagggacatttggcaatgtttagagacattttgggatgcctaggtcagaaggaatgccaccggcatctagtgcgtagaggcctgggatacagctaaacatcctacattgcataggaaagcctacacagcaaagaatgatcaggccccaaaacttaatggcgccaaagttgagaacccctgctgtatggtatgtttgtcatagcacttcataaagacagctgtaggccgggcacggtgattcacacctgtaatcccagcattttgagaggccaaggtgggtggatcacctgaggtcgggagttcgagaccagcctgaccaacatggagaaaccacgtctctactaaaaatacaaaattagccgggtatagtggtgcatgcctgtaatcccagctactcgggaggctgaggcaggagaatcgcttgaacccgggaggcacaggttgcagtgagccaagatagcaccattgcactccagcctgagccacaagagcgaaactccgtctaaaacaaaaacaaaaacaaaaaaaggccaggagcggtggctcactcttgtaatcccaacactttggaaagccaaggcgggcagatcacctgaggttaggagttcaagaccagcctgaccaatatggagaaaccctgtctctactaaaaatactaaattagctgggcgtggtggcacatgcctgtaatcctagctactcgggaggctgaggcaggaggatggcttcaatccgggaggctgaggttgccgtgagccgatatcgcgccattgcactctagccggggcaacaaaagcaacactccgtatcaaaaaaaaaaaaaaaaaaaaaaaatctgtaattgtcaactgattgacctacccagctagactgcaactttcataaagacaagtgatacatgcatgttgtagagtgtttggcttgcagttgaaacttaataaggattggaggaaagtgagaagacacatccagattcaaatttagggacctgtgggatcatgctgtttgggttttttttgagccatttcccacctccctttgggtactaatcagtcaactgataagcatttcattcattcaactatctatcttatctatcgatcattatcatctatttatttgtttttgagacagggtctctctttgtcgcccaggctggagtgcagtggcacagtcacggctcactgcagccttgaccttccgggcccaagtgattctcctgcctcagcctccagagtagctcggaccacaggcgctcgccaccatccccggctaatgcttttgtcttttgtaaaggcggggtcttgccatgttgcccaggctggtcttgaattcctgggctcaagcgatcctcccgccttggccttccaaagtgctgggattacaggagtaacccaccgggcccggctggaagcctaatttatacttttttaaagatcatgctggcttctctgggagaatatgtaaaacatctattatacacagaatctaaaatacttgccataaagtagttacactctcggatacctattgtcaaaagggaagtctcccagaaaatatgggggcgctgtagccgccgggtcagccgagtccactctctggtacttttagagacgtcggtcgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggtaagcagggcggtcggggaggaggtttgggagcaggagttccgggctgtagggaatgggctttcctgccctccgtgcctcgtccgccgccctggcgcccccgtctcgcccccgtgacttctgagagaaagaggagctctcgaaggggcgtccgccctcccgccgctctaggccgctccgcaccggccgcggccccctccgttcttggccggacttgtgccatctcctgcggtgtgggaccctcaccctcgcaactggcattctttttttgaaaaaaagaacctcaggtgcacaaaattgagttgatccttctcagttcttgacaccctgtgggccaatgcaaggctccttgtttattttatcacttcctctcttcgttcctattcccagacccctttcactccccttttcagacagccactctggtgtgttatataagtggctttacggtccaccttgggtaaatttgtgcaagtgttactttgaaatctatatagcggtttcgaattcttcaatataatatgctgtgatttttctttaaacctttttcctcaacattgtgtttttgagtccatccatgctagtcatcttgttttcacttctgagtgcttgcatgaggggtgctgtgtgcatagacttattcccctagtggtggatagatttttttctagtattaacacccccacaagccacactgtaacgaatattctggcagttgtctccttgtgcatattgttgcatttctctgggtatccaccccagagttgggtcctggtcatatctaattttgctggattgttctttggaatggtcacactagtttatacttcccgacgggcagtgcataaagcttcctgtttcccggtatccctccatcgttcagtggcggctggttttgtaatgtttatcagtctggggggtgtaaggtggtatcccatcgtgtacattttctttctttctttctttctttcttttgagacggagttttgctcttgttgctcgggcaggaatgcagtggcatgatctcggctcactgcaacctccgcctcgggttcaagcgattcttctgcctcagcctcctgagtagctgggattacagacgcgcgccaccacacccagctaattttttgtatttttagcaaagatgggggggttggccagtctggtcttgaactcctgacctcaggtgatccacccgcctcggcctcccgaagtgcagggattacacttcccgacgggcagtgcataaaggaattacagacgtgagccactgctcccggcctacattttcatgtgtttattaaacgtgggttttcccttttttgaattgcctgtttatatcccttcccacttctctgtggatttcctatgttcctggcttgcaggaattcttgtaggctctagattttagatcctggccatgcccggtggctcacacctgtcatcctatcactttgggaggctgaggtaggtggaccactggagtccaggagttcaagatcagcctgggcaacatggtgaaaccccatctctaccaaaaatacaaaaattagctgagcgtgttgacgcacgcccgtactcccagccactaaaaaggctgaggtgggacagtcgcttgaacccgggaggcagaggttgccctgagctgagatcgcaccactgcattccagcctgggcaacagagcaagaccttgtctcaaaaaaaaaaaaaaaaagattttaggccaggcgcggtggctcacgcctgtaatcccagcactttgggaggccgaggcaggtggatcaccggaggtcaggagttcgagaccagcctgaccaatatgatgaaaccccgtctcctactaaaaatacaaaaattagccgggcgtggtggcatgcacctgtaattgcagcttgtcaggaggctgacacaggagaatcacttgaaccagggaggcggaggttgcagtgatccgagattgcgccgttgcattccagcctgggcaacgagcaaaactccgtctcaaaaaaataaagatttcaagtccttgttggttttgcactctgcagataccacctccaagtcttctaacttaatctatggcactgtgttgaataaaaacatttaactctaatgaagttaaattcatcagttttcccctgtataggtttttaaggtatcttcattaagacatttttctacatttccttctattaacatgatagtgttacttttcacgtttagatttttaatccatttgtaattttttaagttttttgtttttggttttttttttttttttgagacggagttttgctcttgttgcccaggctcttgttgcaatggcgcaatctcagctcactgcaacctctgcctcccaggtccaagcaattctcctgactcagcctcccgagtagctgggattacaggcatgagccaccacgcttggccaaagaatttcctttgtatctgtggtctgttcccagcctaccatcttcagcatttgaaaaccattctttctgcatggcctggaccctctacagaacaatgtggatgagcttaataactactccctaaggcttaattattgtcttgggcttttctctgcctccccaccttctcttcaggcccaggttagatctgcaatttctccagcggttcctgcagatactgaaggttttgtttccttcttggtcatcacaaaatgccttgatgttcctgacccttttgtgcctgaccctactgggtgagtgagtgagcccagactagaggagggaggggagctctggtttggggtccctttccatcttttttttttttttttttttttttgagacagagtttctctcttgttgcccaggctggagtgcagtgacataatctcagctcactgcaacctctgcctccctggttcaagtgattctcctgccttcgcctcctgagtagctgggattacaagcacccaccaccacgcccgactaaactttgtatttttcagtaaagacagggtttcaccatcttggccaggctgatctcgaactcatgacctcaggtgatacacccgcctcagcctcccaaagtgctgggattacaggcgtgagccaccgcgcccggccccttttcatctctttggggtgctgatgaggcagggactcaggaagaagcctcccttctttttaacccctcatcactgatttcttactcctctccctcctttcagagcaatttgtgatctaccaggttggcctgatccccagtcagtactatggggtcctgggaaacaaagacttggaagggtttaagactctgacattcctggctgtcatgctcattgttctgaactccacggtaagatctttccctctctctgtgtctctcgtcctctccagtccagtgtgaccgtaatgcctagtggaacttagcctccaggaagcaggaagcaagctgtgggggtgtgtttcctcccttttctgggaactaaagggatagttgcctttattaagcacgttgatcttgctattggcccacgtgggactgattcctcagatgtttccactcctgggcccaggccacaggttctggtttaattcagcatttagcagaactgatcattgcccctttccttcctagaactcttatttccggcagctcattaaaacggctcagcagccagagctgctgctcctcctctgcgggaccgaggctgtgactcaccctggcaccatgtcacacctcccagcctttgaacagtgctttcttgcagaatggcctcctcccctacccctcattcagtaggggggctaccacctgctcactcttcgtcatccctccgttgtcacctctttcaagtctttctcagctttctcctttgtgtctcctccaccaaactctgccctttttctgtacttaacgaattccttgagtttacctcgctgtaacactcctcacacgcttgtaattgttttctggctaaactgtgagctcataatgtccctagtgcttagcacataggtgccctggaaatggtaaatgatgagactcagggctgtaccagaactcaagcctaatgctgtctgccaggctgtgccacctgttttcttggggaagccactgctcatcgtaccatggccacttttgttgggtcttcggtcagtaagcacctatgcatacaaatctctgtcccaagcttgggggacaaaggagtaagaacataaatggaatcgacaatatggtctccaatcttcagaagctcatctactctcaaaataagacagtgtagaaagagggtcttgcctctggtaagccctttaatatttggtgaaggaggctgggtacagtggctcacgcctgtaatcccagcactttgagaggccgaggcgggcggatcacctgaggtcgggagttccagaccagcctgaccaagatggagaaaccccgtctctactaaaaatacaaaattagctgggcgtggtggtgcatgcctgtaatcccagctactcgggaggctgaggcaggagaatcgcttgaaactgggaggcggaggttgtggtgagccaagatcgcgccattgcactccagcctgggcaacaagagtaaaactccatctcagagaaaaaaaatttggtgaaggaatgaacacgtgagtgagtgaggaagggaaagtcccatgactcgatgatttaaaaaagaaaagtgctgagtggacggagtaatcagagtcagagtgggctgggatgggtcagcggaggctcttgcgagccttgagctttgagctgagattttcaggaagccatctctcccttccccttgcttcccccactgcacagctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccgtaggcgccccaactcagtcctttctacactctgtgtggtcctttccttctggcctagccctggagactgctggtggcagacaccaaggagatcatctgcagtcgttttcaaatgctgctgcccagagtcatgggggagggtgccctgcagaggactcctggagaagctgcagggctgtgaataggcagctaaaaagaagaagcctgccaggtgcagtggcatgcacctgtagtcccaacaactcaggaggctgaggcaggaggatcacttgagcccaggagtagtgcaccgtgagcacacttgggaatagccactgtactctagcctgggcaacatagcagaaacccccatctcttaaaaaaaagaaaaatgttaggagcagctttcttttgtccttttcatactttatatcttagtcttccagtaagaagactaaggggtttctttagagggttctaaagaaaatgtccttgctagaaaaaccagctcttagattttcatcagtaaaaaaaattaccactatccaggactcagtctaggattcacatctccattctatcaccactcaggttataactcttaaagtcaccaagccccaggttccccttctgtaaaatgaggacaataatagttcctatctcaaagggtgtagtgaggatgaaatatcattcatgtaatgcacatgtacagtgcttgacacatagcaagtgtttcagtgtaagttagctattgttattttacagatgaggaagctgaagcccagagattgcaagtgacttgcccaaggtcacgtcactcattgggaataggaatcagtatggccctagtggtgagatgagacatagggggtctccttcacacccatcccctcactcaccaccttcctagcaagcactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactgaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaaggtgaagcctccctcctccccagcctggtgtttccccagagggccctcagtcagctctcccaggtcaaggtccaagagaagcttatttcccctctctcccaccgtaccttaccacgtgctcacccatcccacgtgctcaggcccctgcccttcctttggccctgtgttgcagtgtcacagatatcctggctctgagagctcataccagatgcccccacataggagcagagggcccattgggccactcagattggacaggggctacctgagagggaacaggagtcagggctgaggcatgtggggataggtggcaccccacaccctctcccttctctccctctctctctatttcagcacaggctggctcgggcctgtgagcatcttcgggtatttcatcctggggaccgtggtgaacaaaactttgatgggccccattgtgatgaagctggtgcatcaggagaagctggagggagattttaggtgtgtctccctcacttgaggtttctgggctggggcataatagttaaggaaggggatctggagtaaaactgcctaagttcaaatcctagctgtgccagttactagctgtgtgatcttggagaggtctttaacctctccaagcttcaatgttcttgtctctaaagtggaaatggtaccgttgcctactgagaggattaggaggattaatgaaatcatacctgagaaggtctgagaaccgtgtctgcctggccatcaccatcgtcattgtcatctcttggccttctcactgccctggcataaccgccctgtcttggatcagttgggtgtggcagccaatggatccagtgcctgccctgtgcttcttgtccccctcctttgggccaggccctgggaggaggagatgctgtgagcaggaatacccctgtcctctctgcagaaagctgaggggcagccctgtctctgcagagctcctgccacaccacctagccctggggttttctaccccataacagtccaggaaagggtcagactgaggcagccacggttttgaggcagagccgggctccgcttgggcggtctttgtgatccaggactccaacaagagtgaggccagtactccctgttgtcagcacacatttccctttggtccgcccaggttcaagcacatgcagattcgggtgaatgcggagcctgctgctttctacaggtgagtctggagagatggttccccttctgccttgccagagctgagagtggagaaggaaagatgaatcctcaaccctcccaccaccaccgagctcaggggctgagtgttgtcacacttggctgtgaccctctccctctacctccccctgcccttgcctgcctcatccttaggtccaggggtttgcttctgaagctggtggttccttactgtggccagctttagtcttagtggcctagcgtggggcctgaaattgtcaaatgaatgaatgcctcatcctcttgctggtgactgtaagacatccgtctgcctctgctcttctgtctgttaagaagctttcttgccagtgcctgaggttcaagcctgatcctttgtctccgtagcgtgggatggaatgggagcttctcagaaaaccaggagacctgctccccacaatgctgtctaatggagccaagcgtctggtctcctgacggcagcagcaggagcagcagcagcggcatgaaatcccatcccttccctccagggccagaaccggtccctgtgctctgccttatgtgaggcctctgaaatcagcgttaggattgatagtgcaggcagaggtttgcgtttaagaagtggaagctactccttggctctgtacttggggtggatgtgatagccctgggacctttgctcctcagtctctgctgcagtttgcaacctccaccacttgagggcaccaagaatactgggaatctgcgctggggtggggttgtgaggtgggcagggctgggtgtgtaaaaaagttgcttttggaggccgggcatggtggctcatgcctgtaatcccagcactttgggaggccgaggcgggtggattgcctgaggtcaagagttcgagaccagccatggccaacatggtgaaaccctgtctctactaaaaatacaaaaaattagctgagcatggtggcgggcacctgtaatcccagctactggggaggctgaggcaggagaatcacttgaatccgggaggcagaggttgcagtaaggcaagatcctgccattgcactccagcctgggtgacagagcaagactccgtctcaaaaaaaaaaaaagaaaaaagttgcttttggattctgcagcctctgctcatgaagctctggggaaggcaggttagtttgtagagtttcagatgagttcttctgtggcctctgtgcaaaatctgaaatctccctccaccttttctgcctagcgaatttcttcccatccttgaaaccccagatcacctcctctggagagccttcccagactcccttaatggctaagcctatctgctgccatggccctgagggcacacttagtactcctgattccaagtgaagaatgcagtgtgcctgcctgccctctggactgagagctcctcaaagacagagataattttctcatttctttattgcactagctaactagtgcaatgcctggtacacctagtgaccgctctgtgtatgtttatttaacaatagtttttatttattgagggctccttatgtgcttggcactttatatttagaaacttttaattctaactctaacctattacataggtattattggctccattttatagattaaaaaaactgaggcttggaggcttaagtagcctgcctgtgtcacgcagctagtaactggccagagccaggatttgaactaggtctgcccaactctagagtttatgttcttcacacagacaataccattaaggcatgactgaagccgtgaatgggcgctaccagtagacagatcctgagaccaagatcatttgaatggccttggtttctaaaggagggtgtgatatgggacaggcggccccccaacctggctgaacctctccagccctgtggacatcccagcctttccttgtcagagctgggcatgtggagcacatgaggacagaccgcaggctgcagagactccttcagacccagagggagctgatgtccaaggagctctggctgtacagtaggcgagggggcccagggaagtgggaaccatggggttggactggtctgcttcccttcccacacctctctacctcctgtctgcaaggataaatgtgccatgatgaaggaattaaccggggatgaggagggggggctgttgcctttctgtgagtatcctcaggagaatgaggatccagagagtccacgtggccctacttggcgtcctgctccctgtcttagggttgtgtccgctgtagggcatgtggatggttcctgggtgtctcacagatgtgttttctacagtcggcatcaacacctttgactatctgggcagcatcctgagttacgttgtcatcgcaatccccattttcagcggggtctatggagacctgagtcccgcagagcttagcaccctggtcagcaaggtgagactccctcttggtcaccccacatgctgtccctctctgtccttggcccagtgtctgtgggctcgagtcgagacctgcttgacctcttcccatcctgtccagaatgcctttgtgtgcatctacctcatcagctgcttcacccagctcatcgacctgtccacgacgctctcagatgtggctggctacacgcacaggtgaggccgtgtcccacccctctggctcctgagcaaagtgtgtgctgctggcagaagtggctgagtgaaaaaaggaacagagacataccatgtactcgtgggtgtgagataggaaaaggagttcaccttcacctggctcccagaccctgcctcagattttcttttcttgttcagaattgggcagcttcgggagacgcttctggacatgtccctgaagtcacaggactgcgagatcctgggcgagagcgagtggggcttggacacgtgagtagcgggctggcagagcagtagttgaggctgcaggctgtggcatcacctggcttgggttaccctggagtcctgccctttcccagctgggcagcagagttgtaaggagtaaatggaaatggaatgccaggcacatgtaagttcacagtcgatgttgctgttccggcatctgttgtgttaatttacaccattccccggccagtggaagcaaagtacacacaccttctgcctgagataacaggaatctgcagtgtcctccccttcctgtgcttcctcctcccgctgattcctctccctgcccctttccttggggcatgtctgtctttgttcccccacctcactcagccccagagatgtctgtatccgtgtgtctgcgtggatctgtaatatttctgtgcattcaggatttgcttgatctccacactttccttgggcagattacctaactgttctgtttcttcatgtctgaaaaggaggtcataatgaacttccttcacttgttgtagggattagatatcatcatccatggaaagtgcttggacagtggccacatcataagctttcaaaaatcagtctgaattccagggcctacactcaacttgcttttcttaggagctaataccttaactgttgcttctgttccaaatgaaagcttcatgcaaccatgagtgcagaggctgggcatgaaggagggtctgtaggaaactggaattgctgttctgtggggagccaggcatccatgcagaggcagaaactccagaaccatttagctttaaccactcccattcttgttattagtactctggtcacactgtgatgccatgaagacccaccagcattagaatttgttgaataccgctctgcaacctgggcagttacttagccacctgattcttagtgtcctcatctgtgatgatatttgagactcatgggcattagactgagtaagatcagtcccataaggggctttgtccagccaggcagagagtagaagttccacccctacccctgtattaatgtgctcaggctgccatgacagaaaaccacaaaccggctggcttaaacaatagaaattaatttcctcacaattctggatgcttatggtccacgatcaagttgtcagcagggttggtttcttaggccactccttggcttgtagatggccaccttgttgctgtgtcctcacgtggcctttcctttatatgtgcgtgcccctgccacctctatcttaagaggacaccagtcatattggattagggtcccaccccaacaacttcatgttaacatcatctctttaaagaccctgcctccagctgggcacggaagctcacgtctataatcccaccactttgggaggctgaggtgggcagatcacctgaggtcacaagttcgagaccagactggccaacatagtgaaaccctgtctctactaaaaatatgggcacggtggtgggcacctgtaatccagctactcaggaggctgggacaggaaaatcgcttgaacccaggaggcggaggttgcagtgagctgagatagctccactgcactcaagcctgggtgacagcaagactttctctcaaaaaaaaaaaaaaaaaaaaagaccctgcctccgaatgcagttacattctgagtcactagggggctggacttcagcatgtgattttgggaggatgcaagtcagcccataataatccacaggtggtggctcccgggagcagtgcctcccccacagcaatactgaccctgcccatcttcctcacgccccctctcttctctgacacagacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgagagccaggccctccctgcctctgacccagcctgggccctaggggtggggtgaaggcggggacggtgtggtagaatccattcttttctgttggggaacaaggaagagaggagacaggcagttgcctcttctgggagatctcacaatggaggtttctgtgggctctgcaggctcagtgcagatgctgacggactttgggccccatggggtgctattcctgccacaaaagccattcttcactgacgggacccttcgggagcaggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggaggttccagtgggttctggagggagggtgggctgtgtgcagctccgtcttttgctcgccctcctaggttggtgtggtttttttcttttctcaggtgatatatcccctgaaggaggtctaccccgactcaggtgagctggtcctccttaggtcatgtcctctccttctgtcatggttgtccctgctctacctgactgtggcctcatctgtgcccttggggagaggctccagccaggccgctgattcaaggaagaggggctcctctcctcttcctttgactgttttggggtctgtacccagatctcacctcattctttctgtccttaaggagagatgcccactgggacaaggaaagtgatgccttccttcacccaccccttcccttatgaagatctgcaacctgtggtttcaaagccttcgcccagcattctgaggcccccacccctgcatcatccatgatgtgccctgtctattctttttttttttttttttttttttgagatggagtttcactctgtcacccagactggagtgcagtggtgtgatctcggctcactgcaacctccacctcccgggttcaagcaattcccctgcctcagcctcttccgtagctggggctacaggtgcacgccaccttgcctgcctaatttttgtatatttagtagagacagcgtttcaccatgttggccagggtggtctccatctcctgaccttgtgatccacctgcctcggcctcccaaagtgttgggattacaggcgtgagccactgtgcacagccttgccctgtctattttgaccagccaggaggctctggctttttgcagaaggcttctttgttgtgcaggttctgccgatgatgagaggatcttgaggttcttggaattggcaggcctggtaagtggggagagggaccctcaggacccgagcccacctgggagcaccagctacaggtaggcaggtgctggccctgctatgcttgggcccaggactggaagtctgaacctggggtggagaatgggagtatcagttgacagtgtgtgctgttggccaggtttaggcacgaagggggtagtgctctcattggagaattttaaaacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaaagccaagctatattcttcctcctctagcagtcctctctcctacctttcctcaggtatgatgttctgtccccgggggagatgcaacggctctcctttgcccgactcttctacctgcagccgaagtacgcaggtgaggtctcgccttgtggctgcacatgccatgcgctgtctgcactcacgggtgtagcagcatgtgttcacaggcacccaggcacacctgtgaatggctgggcttctccgcattccctgctggagaggacagcaggccctgcccgtgtaaacagtgcctggcatcgtcagagttaacactgaatatgcggtactgccagctcataagcttgcttttcttctgttttcttttttcttttctttttttttttttttttgagacagtctcactctgtcacccaggctggggtacaggggcacagtcatggctcagtgcagcctggaactcccaggcttaagtgatcctcccacctcagcctcctgagtagctgggactacaagcatgtgccaccacaccctgctaatttttttatttttatttttgtagagacagggtcatgctatgttgcccaggctggtctggagttcctggactcaggccatcctcccacgttggcctcccaaagtgctgggattacaggcatgaaccactatgcctagctcataagctttttgcctggcagcagctggagccaggagccaacattgaagggttataattttatgctcctctggctccaccatcaaatgaatgggcacccatcctcctctcccaccaagctgtgcctggcaggtggatgggtgtggacttttccaaagactgacattcttgcgggggactgggattccctggattgagtggtcccagggagtggctggtgcttatctatagaagctgagagatttcatgcagctgctcacaggctattcccttggagagtctggccctctgctcctctggcccatccttctccctgaggcagggcttctggaagccagagcagctttcagcctcccctgggtcccagctggggttgagtatgggtgggaggagaagcagcggcggcagagggcagggctttgatctcttcctctgtgctctgccccctcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccggcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgatgacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgatcttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttccaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatttttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatggagtgagaattgtattttctcactgtaaaatataagattatttaacgctttcttggtaccacttaaaaatgacttactctatccttactgacttcttcagctcctaagcctttttcacagacgctgctgccgctgccaagttattttgtttatttttattttttatttacttatttatttttgagacagtgtctcacacctcactctgtagcccaggctgtaatctagtggcacaatcacagcttattgcagccttgacttcccgggctcaagtgatcctcccaccacagcctctcaagtagctgggaccacaggcaggagctcctatgcccagcatccagattattttggagaccaattcattcctatctcagggtctttgcatttgctgcttcctctgcctctaactggttcccagtgctgttctgttcttaacacttagccttctccctcacagaaactgcccaagaaagctactcctaggggcacactctgcacctctatccctccctcatgtcagagatggagactactcttagatgagtcgacataaacatgcgtggaggaaaatcaggtcttgtgtccttcatagtacattatggacaaaatgtttgttttaaatgcatcgtacatcagccaggcaaatagtttcccaaacttaagacccattttggccacccaggaatctacagtgacccatgtggatgagacataaagatagccataggtttcccatcactcttctggagggttctgggctgcaggacaggcagaaaagccatcttttgtcatctctatccacgttggcttaacatgtcaatgtgtgtctagtaaaggcagctcaaacccaacatgtcccaaactgaacaagaagagctttccctggccgggcatagtggctcatgcctgtaatcccagcactttgggaggctgaggtgggtggattgcaaggtcaggagatcgaaaccatcctggccaacatggtgaaaccccgtctctactaaaaataaaaaaattagctgggtgtggtggcacatgcctgtaatcccagctactcgggaggctgaggctggagaatcgcttgaacccaggaggcgggggttgcagtgagccgagatcgtgccactgcactccagcctggtgccaaagcaagactctgtctcaaaaaaaaagaaagctttcccactcacgcctgtaatcccagcactttgggaggccgaggtgggcagatcacaaggtcaggagttcaggaccagcctggccaatatggtaaaaccccatctctactaaaaatacaaaagttagccgggtgtggtggcaggcgcctgtagtcccagctactcgggaggctgaggcaggagaatcatttgaacccaggaggcggaggttgcagtgagcagagattgtgccacggcactccagcctgggcgacagagcgagactccgtctcaaaaaaaagctttccccagagccttttctagcatctcctctgatggcaagtggcgttactgtccatctagcacatcaccaggtgctgttgctctgaccccataagtaaatcttccagccattcacttctctcacctgcttgaatcctagctagaagcagctcagagggagccagaaaaatgagaaaaaccacaaggagaatcgaggaacaggagcctggacggcagctggactctgaaaaaaagaagtgtcaggaggcagcctgagcctgccacgtaggggaatgttagtaaccagtggcacggcattctgtgggctatggggcagttcttgaaagtgagggcactttggtttgccgcacaccagccatgtctgaggcaccattctcagttccagggttacag

SEQ ID NO: 12827 - DNA, 21535 bp, Human; identical to SEQ ID NO: 12826

SEQ ID NO: 12828 - DNA, 21535 bp, Human; identical to SEQ ID NO: 12826

SEQ ID NO: 12829 - DNA, 21535 bp, Human; identical to SEQ ID NO: 12826

SEQ ID NO: 12830 - DNA, 6373 bp, Human
ctttgtgctcattgcagtgtttctggaactctgctcagcatttcaccttttggtcataacatcgttcatgaagtgcttctgcaatcacctgttaccctgcctttctttttatatcaatatccactacttcacaggtcattgcaagcttctttccttcagcctgaccttaaatcctactattcctgagcgatccaacctggtctttctctgctcattcctcaccatcccatgaggcatcatcatcagcttttatggcttcaatcagcaccactgtgcagaggactccagttcagctccaactcaggcatctcagcccagaggatgctgcctactcgtctgcagttgagaaatcccttcttcaatgctcctttactggcacctggaaatctacattttgcaagcagagcttttcatatttatttcctttatctaaatctatttgttctgatgtttttcttctttgagtggttagaaccatgacacacacatacacctaagccagaaacatcaacattctttttcatttttgcctctttcattctgggagaatccatgcaagcattaagtccagcagagtctaagtggttttaaatctcttggagctgtcaacttttgtccttccctaaagagacaacagagttgactagtaaagaacacaggctccgggtagagttgcctaaatgttcacagggattgcttcagctgacgccaccttctgaaccatggtacggttttcatgtcctcatgtgcaaagtatgggtgataatagtagtacctataacctagggtcatggtgaagatttaatgggctgatttatgcagagcatagcggggtgtgtagcatgaaacgagccagtcttccataagtactgcttattatcagccctaaggccatgctttctgccaacagacaacattgcttggtacaagagcttttaactagtctccctgactcaagcctgttcctttttaacctttccttgtaattcagccagatggaatctcccaggaacaaaactgaaaatattcctctcttatcagaatccctcagaatcacctcatgaccttccgatttgcccttttacggacgataaacccttccattttctgagccagaggcttcttcctttgtggagtcagcctcatcgctcgactaggaacataaccagctatctacctttctcagaaagcacttgggtttgctcttataacaggcactttttctaggttcttcccaccattgcacatggacacacaaaaattacactgacccctggcaccccaaagacaaacagcagaaagcactcccaggcaaaatgagctcaggacctttctgttgcctgggcccacaactaaggttcagggccttctctaaaaagaagccgcagccgaagacagaggaactgcccagagtggggctgggggtgtggagtctacgctgatactttcaggctgtttccactcttgctggttctgatgctcctttcttttgccacaagcaaccctagtggaaaactgggaaatgtccaacaatgaagttaggacagtggcccataaaacatcggattccaacctgtgtcctaaggtgtaaagacacagagtaaaggcaaagatacagtgagcctttaacacgttctcctttgttcttcctatttctctattccttctccatttccgatggtgttctctaccctctctccaacccacgtgccaacagcccctcttttctcttttattctcgcccacgtttccctcctttcttccacctgcgcccaacggtacggcccggaaaacgaactggatgcgttggacaggtcacgcgcgcattgcggacgccagctagaccgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaaccagtgcattctacttctcgagtgttcacttgcccctcagtttgtgaccaagttgtgggtattctgagaatcatgctctaatggcttttccatacactaaagctctgaaagtagtgagtttcctagaattaccatgctattcaaggtatagtcttgtttctcagaatcccagggaacaaagcaattgtctgcctctccctctgcctccctcaacttgatccatgtgaacatccgcacctgcacccatgctgatcaataaatgccgacaacacattttatgaatagaaaatgattctataagcattttcagtatttggggtgatctcaggtgggttaatgacgctgagctgtcctaactcttgcattgcaccacagtgcaatgatgacaagatgatgccaggccctggcagtgtcctggggcaaggctgttaagaaaattttgtgtttgcagtgtctgcttgcagaggcagagcttttgtgagtgcgtgtgtgctgaatgacacctggccctatgtttgccactctcctaagtagcacagaggaggagtgaggaacgcctttcaaggacccccgtgtctctgcctccacatcttccttcccgtttgcacagtgattttggtgggaggagaggactgaggggtgccttggcaggagtcagtatccacttcttatatccaaggggggattgtccctctcagatttgtgtcaggctaagttttttggtcttgctctaggctgggtcttcctgcttttctctcatcttacctcagtgctcctctccctcctcaggcaacaccgcaggcctgcagtgccccatcccaatctcctgtttcttttttttttttttttttttttttttgagactgagtcttgctctctcgcccaggctggagtgccgtggtgcgatctcagctcactacaaactctgcctccagggttcacgtcattctcctgcctcagcctcctgagtagctgggactacaggtgcccgccaccacgcgcagctaagtttttgtatttttagtatagacggggtttcaccgtgttagccaggatggtctcgatctcccaacctcatgatccacctgccttggcctcccaaagtgctgggattacaggcgtgagccaccacgctcggcctcctgtttcttagtcacacttctaatgaaagatgaacttgcggcagtctcacagggaaggttggtccccagactgttttttctcagcatatgtgccagcagccttctaagagctacatgtgtattattaacatgcatactgctgacaacagctccatgagataggtgtcattattttctcattttagaaaagagaaactgaggcactgcaaggttaaataacctgcccgaagttacacagctaagtaatgacattattgaaggaaactttatatgaaaattaaaaaactgaattgagagcatttatttaaaaatcataaggatatttacacattaggattttttaaaaatttcgattgtggtaaaatacacatactataatattgaccgtcttaaccatttttatgtgtgtggttcagcagtgttaagtattttacattgttgtgcaaataatctccagaactcttttcgtcttgcaaaactgaaaccccatacccattaaacaacaattctccattcttccatccctttacccctcccaaccaatatcctgctttctatctgtgtgaatttggctaatctaggtacttcatgtaaatagaatctcatagtatttgcccttttgtgattggcttatttcacttagcacaatgtctttagggttcatcaatgttgtagtattttgtgttggaatttccttatt

SEQ ID NO: 12831 - DNA, 12116 bp, Human
actgactttaccaaaaatttcaacaaaaaaaattagccaggtgatatagtgtgagcctaaagtcgtagctacttggaaggctgaagcaggaggattacttggaattcaaggctgcagggagctatgattatgctactgcactccagaaggagaccctttctctagaataaataaatgtgcacttagtaggaatgcctgtatcatggaagaaactcaataaacagtataaaatgcatcttagttaatttctagcctatgtatgctctgataggatttatgttacatatgattcattcaggcactggtgttcagaatgcaagtgtgatgataatttaatcagagctgcaaaggtgtgttctaaatactgcataaacctaatcatctttgtctccacctttctgaatgctctaaatacccataaagaggtgggtgtggtctccacaggttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccagggtgagtgaaacatattgataaaattatatcatctttcctttacacaataataaattagagtgttaaaaatatctcattatctgaaatctacacaatgataccatttgtaactcatgttcttactatagattttatgaattataaggatactaattgttgttattttgtgctttctatgattgtttaatatagttctgaaaaacttaaaatatctagtgtttgctgcaacagatatgtattcataatgaatatatggagttgatacatatatgtacacataggtgtgtgtgtatatgtatgtaatgagtgtattaatattgtcaaattgaattgagaagacattaatgaatgatgaagttatttgctttcataacattcaggttttagacatgactttaaattagtaaggtaatgatgagcgatgcaaaatagtgaaactaaaacaatgagaaagctccccaaaatatcctactttagaaatcaaaacacaatttttcgaacaagtaaatttataagacctaatatggtatgtgattgtgattgtcatctcacttgagtctcaatcttattaaactgtgaaaaatttcttaaaatgtcttagatgagttctggaaaatatttgcaattctaagatttttcactgctttcacttaaattcagaagtgatataaaactagcagctttatgctgctttatgctaaaggatttaaaattgccaaaacaaagattatagtttttatattagtcagggttctccagacagaaccataggatgtatacatatatgtgtgcagatacattcatgggccatttgagtcagccacaaaccacatatggtggtcccataagattataataccaatatgtttactgtaccttttctgtattcaattatgtttagatacacaaatagttatcattgtgttacagttgcctacagtatgcagtacagaacatactgtacaggtttgtagcctattgtaggaacaataggctatagtgtataccataggtgtagtaggctataccatctagatttgtgtggtatattctatcatattaaaacaatgaaaccgcctggctgggcactgtggcgcgtgcctataatcccagcactttgcaaagccaaggcaggcagatcacttgaggccagaagttcaagtgcagcctggccaagatggcaaaaccccatctctactaaaaaaatacaaaaattagccaggcctagtgtcacgttcctgtaatcccaggtacttgggaacctgatgcaggagaatcgctctgaacctggaggcggaggttacagtgagccgagatcacgccactgcatttcagcctgcgtgacagaaggatactctgtctcaaaaaaaaaaacacaaaaaaaaactaaaaacacctgacacatttctcagaacatacatctgtccacaagctatacatgattctacatgggacagaattcatcaggaaaattaatttgcttgattatggagtctagagagttccaatataggctgtctctaagctggtgtcctgagaataccggtatcctggctaagctcaagtctgaaagcttcagaacaagtttcaggagagagatggaggaagttgccttttttctgcctttttctttatatctgaggtgtcagctgattggatggtgcccacacacattgagagatgaggctcccactcagctcaccagctcacatatctctcttctctagaaacaccttcacagactcacccacaaacaatgcttcactagttccctaggtgttggttaatccagtcagactgatacctaaaattcaccatcacactatggaaatataattacacctctctgagtttaacaaaaacctcctatatgttagttcagagcttgcacagccctaggggaagttaatttaatccgcaagaaaataaaaagacccaatatctttaataatttttcttttccctactagtgaaacttgattagtttaattgcagtctttttctttgtttatttggttggttggcttttttttaaattttgttttgatttgggtctttgtttttaatttaatttaattttaagtcctgggataactgcaggacttgcaggcttgttatgtaggtaaacttgtgccatggtggtttgctgcccggcttttgtgaccctctataaaaatatgtcatagaaccatcttctcatatttctttggccatcttctcatatttctttggcccgggtagttttttccctcccactctttcacagtcattcatcagttattgaaagaagaatagggacaactatgatttattctgaccacttagaatcaaaacccaatttccagatctatgttcagaaaatgggtagttgaataggttcgtattatgctacagacaggaactaggagtagaagggactgtgagtgctctagttagtaatatctgttataaagccaggagactccctctatgtgtaaatttttaagtttgtaacagaagaaatagtttgttgtactttaatgaacactgtcaagagaagaaaatataactatcacatatctccacatgtttagaagcttttcatcaacccaggccccaaaatgacatgtttctctttgttcctcagaaacatgaattctggaatcttacaggtctttcagagggaactcatctgccccatctgcatgaactacttcatagacccggtcaccatagactgtgggcacagcttttgcaggccttgtttctacctcaactggaaagacagcccatttcttgtccagtgctctgaatgcacaaagtcaacagggcagataaacctcaaaaccaacattcatttcaagaagatggcttctcttgctagaaaagtcagtctctggctattcctgagctctgaggagcaaatgtgtggcactcacagggagacaaagaagatgttctgtgaagtggacaggagcctgctctgtttgctgtgctccagctctcaggagcaccgggatcacagacactgtcccattgagtcggctgctgaggaacaccaggtaagtgatggctctgaagatcgatttctgtaaaggatgcataaaattcctgtgggtctattttcttggagattggataaaacaaactctgagtccctttaagcagctctgtttgggctttcttagcttccaacctctgggctttgacaaacatgaagggaaacaaaggaaatgccatttactaggggtttatttgtctctcattctggggcccctccctatgtcatggtctgcactggtgcttcaatttatggctcttttgcaggagaagcttttacagaaaatgcagtctttgtgggaaaaagcttgtgaaaatcacagaaacctgaatgtggaaaccaccagaaccagatgctggaaggttagtcctgtactactctaccttctccaggaacttatggtgggcaaatgggtgactcttaaaataggaactggatatcaaactgtaatgtttctgggattcagtaaaaaaaaagaaaaaaaaagcgagagaaaacattgagaaaaagtggcctcatttttatatagaatagtatgcctgttaggtaggatttctaagaaaactactgatgtcacccaaagcatgctggtttgtttcatacaaaccatagttatacaccaacagatccaagaaactgggccatcacacagcattctatatttgctggttggataaatgctaggcaaaagggttatttggcagtcatggaatgctcagctgaaacttctgagtgtcggtcagcattaatctgaatgctagtgtgcaagtagtatttgaaattgtatggaaaatttgaggcagaaaaagtgacagggcaaatctagggaaaccatgaaattaagaatctcaactaattaatattgaaaaatacataacatacgatgagaaaagtggtgagaaatacggatttgtgtcttgagggagacatgtaaacatgccagaaatatgggaactagtatctaaatataaggagaactctgaggacttcagaaaaacattaaaaataattttctctttgtggatgtatattttgagggaatgatagctaatattagtttgttgaaaagcatttcatgagaacctagtctacgttgaatattaaattagaaaatatactagtaaagaagaaaggaagcacctttgtcctcacaaatcatacaatccaaataagagagtcaaatggtcaatacacaaatatatgcaatacatgatgtatttgagtgtggtaggttttttgttggagaataatcaagcagggaagtagaaaaggacaatggaggccagaaactggagattagtgtttgagttttaaatagggtggtcagaaaaaagactcactgaaaaattcaaattgaaacaaagttttgaagaggagggggaacacaaatgtgtgtgtggatatatatgtggaccatgagtgtgtatatgtatgtatgtgtgtgtggttgtgtgtatatatatatatgtatgtatgtatgtgtgtgtgtttgtatacatatatatgtaattctagttggagagaatagcatatgcagtaattttgagtttgtgtatatttggaggccagaggaaccacaaagaagtctatgtttcagattgggatgacttagaaaaagaatagaaggaaatgaattcagggagacaaagatggccaaatcataaatgcagccttattaggataggttttgctgagcgaaatgcacttagctggacatgctagtctaaggtcattttcatataatgagtttaagcaacttgttgcatatctcagaaatagaaataattgtttcctttctagtaactatagccctatactccaactcttaagcatgaactcttcttacttttccataaatatgggttggaatagcgaaattcaaattgtgtttttttattttcaactatcttagaaaacacattatcttgaataaatttaatgtaattggtcagatacagctatgttgatctttacgcagaaaaaaggaaaggaacaaaatttgtagattctaagaactggcaagacagaggtttgaactattggacattcgagagacaaaaggaatcagtgagatttaataggagatggatatatacatttctcttttgactaacccattatcactgcaggattatgtgaatttaaggctagaagcaattagagctgagtatcagaagatgcctgcatttcaccatgaagaagaaaaacataatttggagatgctgaaaaagaaggggaaagatatttttcatcgacttcatttaagtaaagccaaaatggctcataggatggagattttaagaggaatgtatgaggagctgaacgaaatgtgccataaaccagatgtggagctacttcaggtaaaaactcgccatgtggtttcaggtttttgaatattcacatgtataagtattttcctcatggctgaaatccatctccctacttttatttccatgatgtgtttccaaaaacacattcacataactaatgctactttgttgggagagtatagccccactaagggattctaccaggccaaaggtccctcctactttatccaccagccacaaaactttgtggaatggtcaaggtaacagccccaagaaatattccccatctaattcaataatatactttgggttgttaaacatgtatagaatagtgagtgattcatttacatttaggttaatttgtaaacatggcaagatcagaagttttgggaatctaggtttgcattaacattattttggggtccactcatttgggtaacaggttcagttaaagatgactgagtaggtttttcatggttaccacagaccatagaccttctgggcctcttctcccttcacttgtttagagaatgtcttcaagactcagactttcccaggacgttaattaataacaatacaactgactgggtttttcattacagaagaaatgaaatagaaaatactttccagaagagaagatggtaggggaataatatcttcagaaactgagtacaaatctcacactgaacttagtgaaagatgcatcttgtgaaatgcactaaatctctcttttttttttttttttcaggcttttggagacatattacacaggtgagtgtgtacctagattttagcatatgttctttaagattccacgactatcaaagcaggctttattaaagtcatggcataaagtcatggcataaataattaagatattgataccactttttttttgcatctactttcgttcccacaccttaaaagacaaggccacgaagtaaataaatgaataaaagaagagtgaactaaaacaaacaatttgattcctgatttttttttttttttttttttttttttttttttttttttttttttttggaaagggggtcgggccctgccccccaggcgggggggaaagggggcgatctgggcccactgaaagccccgcccccggggttcacaccattccccggcctaagccccccgggaacgggggataaaaggggcccccccccaaccggggaatttttttttttttttagaagagagggggttcccatgttagccaggatggtctctatctcctgaccccgtgatccgcccgcctcagcctcccaaagtgctgagattacaggcgtgaaccaccgcgcccggcccctgattttgttttattgcttgaaagcctgcacaggagaaagataagagttttgttttgtggatggtgagaaagtcaccagaggaagcaggagagaagaggaggaagtattttagcagtgaaaaagtgttgatgttttgttttttatacatatatacatatcagttaacagttctgaaaaatagattgaaaaaaactgtggagtgttagaactgtataagtctctagggaagttctttgctaaaaggggagagaacaagtttccattctttatcttgagaaggaagcagtggatgcatcagtctccccagaaccccgctatttcagacaaagatgtcaggggagtctgccaagaagtggaactcagaatttcgtttctaaatattctcaaggccataaagctaaggaaccttacacatttggagcaaaaaaaaaaaaaagaaggatcagattggattctggcttagattcttccatcatgctttaaaatttagaaactgtaaagaattaatttgcaaaaggaaggattaatttttgaattatcaaatgtgtagattcaaaggattctcatgaaatgtcttttatatacaaatagtgatttttatttattttatggctgtagatgttgtaactgcaggtttttccttgcaggagtgagtccgtgctgctgcacatgccccagcctctgaatccagagctcagtgcagggcccatcactggactgagggacaggctcaaccaattccgaggtaagtctccacccacaggcagcactcccactatctaaatattattattgttaggatcacataggtaatatttcatattttatcaaatattttacttcttttaagacataagtgaacaatataaccatgcaaccctttggtatccgtgtctgtatttacagtcagatttatagcattaagtttgaaagatagtgaaaaagaaatactttctggcataatatgtactgagttatataacgggaaaaaggagtagtgtagaaaattttaaaaaggagcaaatgaaataatgctcagaatggtgaattatttaatgttaaatacaaaattgtgcatttctttagtgtattcatttgaactgctaagaactgttctttaggggaatatagttttctggagattcttgggggttttgtatttttttaatgtgtatatattattcatatattgcaaacatttgaattaataggtaaagctaaaaggaagaaatcattttgtgaatataagtaaaattacaaatgaaaataagttcagtttaattgcaatatgaagagctacatgttaagtctaaaatccagcttcagcccagagctagcatggaggacagcagagagactggtcaaagattttgcagagatctgctttaaattatcacttataacatgtaaatatggacttttatccagatacctagagcagttcttaagtgaaaatcttcacattcacattctttccaaaatgatagcactagtttttaagaataagaaacatttctaaataatgatcttgataacagcattacatttagggcatacaatgtataaattttactttgaaaattggattgaaagaagttggtctcacatttggctctcaatatgtttttttcaaaaaaacataatatctgtggttagggttttgtttgtcttgtatataatattaaccatctctatactttactagaagttacaagcaaaactttttatgactttacatttgctggtaaagtaacttcttgatagacaattatttttttcttatttacacgtctatgcatgttttctcttttttttgcagtgcatattactctgcatcatgaagaagccaacagtgatatctttctatgtgaaattttgagaagcatgtgtattggatgtgaccatcaagatgtaccctatttcactgcaacacctagaagttttcttgcatggggtgctcagactttcacctcgggcaaatattactgggaggtccatgtaggggactcctggaattgggcttttggtgtctgtaatatgtattggaaagagaagaatcagaatgagaagatagatggagaggatggactctttcttcttgggtgtgttaagaatgacattcaacgcagtctctttaccacctccccacttatgctgcaatatatcccaagacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcagtgataactgggaaatgtttttcttcctctttatctaactatattacacttatccatcaggtttcattgtattaatctatcctttgaggtaatactatttgaccttctatgctgggctttattttgcaattctcaccacagatatgaataatccttcattattagtgtgcttgtctacattgaaatacacaatgtgatcagaccaatgctggattaattgaatttttttttaaagtaactaaatattgactcctacctcaaaccatacacagtcatttccagatagtttgaagtcctgaaaggaaggggaacctgatacaatattctcataaggatttcttaaccagggcacaaattaataattaaaacaattagttcatttatattgataatgatgacttctgtgtttcaaaaaacattatgcaaactagtagtggagaaagatattcaccccaacatacataaagtaaaatataatacatgtatatgatgaatacttaaattgtaataaataaaagacagtgaactcaacagaagattggctaaaatatctgaacagacactttacagaattggatacataaataactagccaaatataaaaaagtgctcactttcattagtcttacaaaagtaagaattaatccaccagttgtaccacaggccctcataaaaaaataccaaaatttaaagacacacaatattgtgtgttgtcaaagatacagaataaatgaaatttattcatggctggagagatgtaaatggaaatcccttttgggaaactgactattagcatttcttatgggctagatattctaattctaaaatatagtcaactgattgcctacatatacttcaacatacacaatattgttcactgcatcaatttttatagtagctccaaattagacccaaaatattcttcaactgtagaatagctaaataaatttggtgtatttatgcaaaataatcctataaaacaataaataactcactgaatgcaacaaagctgatgaatctcagaaacaagttaataaacatatgccaatttaaacgataaaattgaagttaagaaaagacttttccatgtatataatatgttggtaattgtaagctctttatgggttccataattacatgaacgctgtggaattataacttttaagacccaaaatgtcaaataatgcataatgtagtagaataaaaaaggagcccaggcatggtggcacacacctccaatcccagcacttggggagaccaaggtgtgagaatggcttgtggccaggagttccagaccagtggaggcaacatagtgagacctcatgtctactaaacattcctttagaaatcagcctggcatgatggcacatgctatagtcccagctactcaggaggctgatgcagcaggatggcttgtgcccagaagatccaggctgcagtgagccatggtggtgccctgcagtccagcctgtgacagaatgactgtctgtctcataataaaacaaactataattacttgatataacacaaaccaatatattataaatacgctaattataggtattttaaatattgatttatttaaaataactgagaaagctgggatagctacatgtttgcttagactagacaaaagtgccttgggaagtaagtttaaagtatttttattagagtaagtgaggatgaagtgcttcattacaaatgtgatacacaccagaatctgctatgaatagtctcatgtctagaagatttgcggatatctaggtaagcagtaattattgggtgcctgaagcctagcaggtgcatattcagtgtgtcttctctggagatgtcttctctggaaagtttgatttttttttattatactttaagttctagggtacatgtgcacaacgtgcaggtttgttacaaatgtatacatgtgccatgttggtgtgctgcacccattaactcctcatttacattaggtatatctcctaatgctatccctccccctccccccaccccataacaggcccctatgtgtgatgttccccttcctgtgtccaagtgatctcactgttcaattcccacctatgagtgagaatatgcact

SEQ ID NO: 12832 - DNA, 37711 bp, Human
atctgggaacaactgatgttcttcagctcagtgaaataaagcagtgtggggagtatccacttcgatagacattactctgtgatagacattactatttgcctctccccttcatcactcaaaatactattttcttgagtccttacatgatatatggtcaggcaatgccaagaaatgttaatacttgcctaagtaggttattattattattattattattttttttttgaggcagagtctcactctgttgcccagggtagagtgcactggtgtgatcttggctcactgcaacctctgcctcctaggttcaagtgattctccttcctcagcctcccaagtagccgtgaccacaggtgtgtgccaccatgcctggctaatttttgtggtttttttttttttttttttgagacaaagtctcactctgttgcccaggctgagagtgcagtggcgcagtctcggctcactgcaacccctgcctcccgatgtttaagctattcttctgcctcagcctcctgagtagctgggattataggtgccggccaccacacctggttaattttttgtatttttagtagagacggggtttcaccatgttgggcaggctgatcaccaactcctgacctcgagatctgcctgcctcagcctcccaaagcactggaattacaggtgtgagccaccgcgcccagccaatttttgtatttttaatggagatggggtttcaccatgttggccaggctggcctcgaacccctgacctcagataatctgcccaccttgacctcccaaagtgctgggattacaggtgggaaccatccagcctggccggtaagttatttatttatttcttgagacggaatctcacactgttacctgggctggtgtgcagtggcacgatctcagctcgctgcagtgtccgcctgctgggttcaagcaattctccagcctcagcctcccaagtagctaggattacaggcacctgccaccacacccagctaactttttgtattttcagtagagacagggtttcactatgttggccaggctggtctcgaagtcctgacctcatgatctgccctcctcggcctcccaaagtgttgcgattgcaggcgtgagccactgtgcccagcctggtaaattatttttaaaccacatttactaaaatgataaataagaaataagacataaaaagaaataattgtttgattattagtgtcatttcatttgtatgaatgaccaagaactagccatgtggctgggcatggtggctcacacctataatcccaacactttgggaggccgaggcaggtggatcacctgaggtcaggagttcaagaccagcacagccaacattgtaaaaccccgtctctattaaaaatacaaaaattagctgggcctggtggtgggttactttaatcccagctactcaggaggctgaggcaggagaatcgcttgaacctgggaggcagaggttgcagtgagccaagattgcacccctgcactccaacctgggtgacagctcgagattctgtctcaaaaaaaaaagaaaaaagaaaaaaaaaggaaccagccatgtgtattttatactcaaaatgggtctgctctgacagcttgatacaatagggtggaggatacagttgttgaaaagtttaattcccgcccttcagcatagtaatttataatctaggtcaaagacaaatattctctaaactcaccgttggtgaaggtagatggaggcatggggtttgagaaaaggaagattttgttcctcatttctaatccggcaggcctgagaaggtcttgatacatagttccctgactaaagaaagccatcatggtggagaagttccttgggaaatggatatgacttggggtgtttgctcagtcagatatctgagacctaaacagaaatggtactgagcaataactcagtaggactcaaaagttccaaggcagttggtaaatgacagttatgaataaagcaagggcagaaaaaaacatgtaggggagagaatgaggaactaggtccaggagatgctgaaactgaataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaaggtaggctggaccttgaagagctctctcaaatgtggcatcctctacctctggtttgggagaagataacttgagccatcatttctttaatcccctcacttgatcctattcttttgtgggttgtaggtaactagaatgagaacactagcaatagatcagatctacaatcaggaaaacatgacacttacctacctctcatgtatactttttcctatataatgtctttccatttgagaagatgctagtttttgtttgtttgtttgtttgtttgtttttgaggtggagtttcgctcttgttgctcaggctcgagtgcaatggcacgatttcagctcactgcaaccttcacctcccaggtacaagcgattctcctatctcagcctcccaagtagctcggattacaagcatgcactaccacgcctggctatttttttttttttgtatttagtagagatggggttttaccatgttagttaggctggtcgtgaactcctgacctcagatgatccaccagcctcagcttcccaaagtgctgggattacaggcgtgcgccactgtgcccgacctgccagtttttaatttattatgttttttaaacgttcagtttattgaaagttttgttttgtttggtttggtttggttttgtttctgagagagtctcactctgtcacccaggctggagtacagtgatgcgatctgggctcacttcaacctctgcctcccaggttcaagagattctcctgcctcagcctcccgagttgctgggattgcaggttcccaccaccacacccagctaattttttgtatattttagtagagacgagggttcactatgttggccaggctggtctcaaactaacctcaagtgatccacccgcctcagcctcccaaagtgctgggattacaggtgaaagccactacacctggctgaaagtattgaaagtgaatttctttgtcttttatccttctcatcattttagaggtaactggaatacttttttttttttttgccatccaattcttgaaattgagtagcaaattactattcttggttaccactgccagttcacccccgtcttaactcttggatctcaggagataggtatttggaacatttttaaatactgtcaaaaagaccttcatcttactactttttcctagcctggaccttaatatttagttttatcaaatttatatctcatcaagttttagtgtattcaaatagggaacggaaggaaaagaaatgtgtgaaatcaagaaaaatagaggcaagaaccatgtttaggagcacatgccaattagtatgtttgaagcacaaatgaagtcttgtaaggaccttcagggcaatctaatttaatcccttctctaatgcatgatggaaatgatctgctcactaaacaccgattacctttattccctgaaaaacacacacacagcctggtgtggtggctcatgcctgtaatcccagcacattgggaggccgaggccagcagatcacatgaggccaggagtttcagaccagcctggccaacatggtgaaaccccatctttactaaaaacacgaaaattagccagtcgtagtgtcgtgcgcctgtaataccagctactcaggaggctgaggcacaagaatcgttgaaccctggaggcataggttgcagggagccaagatcgcaccactgcactccatcctgagtgatggagtaagactgtctaaagagaaaaacacacacacacacattggaacacagaaatgcccatcctccatccaggccagggtgggtgtgaagatgggtgccacagagagctagtaacctagaagtcagaatggagtgggggtggagttggtgagatactggtttcgatgctgctgtcaaaaagtttggattaccctagtcaagtgattccctttctgttttgtgttgttattgttattccactttccactctaccattctgcaggtgtcttttgttttcggagtgcaagtagtatcacctcagtttactgagtcaataagctagagtcctcctctgtagaaataatagagaattgcttctcaaatttataacattaattaaaccttagtgggaagattaaattcacacttgatccaactctgaccatggtgataaataactacagaatttcacatttctggattatttttccccagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgaggtaagagcctctttaaacaaactagtccactctgcagagagatctctggcaaatatctctagggaagatgatgagattagaaaactaactaaataatattttgtcctgactgaggacactctttttttttttgagacagagtctcgctgtcgcccaggctggagtgcagtggcgcgatctcggctcactgcaggctccgccccctggggttcacgccgttctcctgcctcagccttccgagtagctgggactacaggcacccgccacctcgcccggttaatttttttgtatttttagtagagacggggtttcaccgtgttagccaggatggtctcgatctcctgacctcgtgatccgcccacctcggcctcccaaagtgctgggattacaggcgtaagccaccgcgcccggcccactcttttttttttttttttttttttgagatggagttttgctcttgtttcccaggctggagtgcaatggcgcgatctcggctcactacagtctttgcctcccaggtttaagcaattctccttcctcagcctcccgagtagctgggattacaggtgcttgccaccacagccggctaattttttgtatttttagtagagacagggtttcgccattttggccaggctggtctcgaactcctgacctctggtgatccgcccaactcagcctcccaaagtgctgggattacaggcacgtgccactgtgccctgcttgaggacactttttggaaaactgtgagaaggctgagcgtagagaacttcatgagctccacccatttcttccactctttgcagctcataaaatttagaatctttttcagatgaggacttgaaaagatctgtggaagagcaaacagccattagtggctgtatcatctcccttcactgctgctactgaacatgagaactaggggaaagagcacttgtgaagtcatacaggtccttgtttacattttggagtagtttctgctgctggcattttactactaccaacaactgttttatggagaatcattattactttacctgtcatatttatactcccttttaccaatgcgtttccctctacagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggtgcaaggaaagatggtacaggaaggggatggataacaggaacgtgggaaccactcacaggactgggaatgaagcaagacctaagtttccagggctgataccaggtgatgtgctatcctgagcaaacacacaatggctgtcctttgaagaacttgaggactcacacatgcccacggcaccttggcactaggagccagtgatggggccagcccatgccaatggcaagcgtaagacttctgggttcaaattttgccagtcctaggaaccaccctacctcaatgatagcacaactagtcttggaggggtctgcaaggaaatcaaaccttcttctagtgggtgaacctgcccagctaaggatagcagtcttcttgacctagccagtgccacattttttatgctctttggttttaggccactgagatagaaaagttcagacattattttgtttcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctggcaagtcttagtcctttgttctcctcacttcgggacccttccacagctaacgcctgtgttccactctgtgtacttgtcaagaagggtgcctctcatacccttagcatatgacttatccttcttgttctttatcctatcatttttgttgtttttttttgcttgtttgcttttgagatggagtcttgctctgtcactcaggctggagtgcagtggtgcgatcttggctcactgcaacctctgccttccaggttcaagcgattctcctgcctcagcctcccaagtagctgggatgacagttgtccaccaccatgcctggctaattttttgtatttttagtagagatggggtttcaccatgttggccaggttggtctggaacttctgacctcaggtgatccacctgcctcagcctcccaaagtgatgggattacaggtgcgagccactgcgcccggcccatctttgttgttttaatacatgttagcagcttctttccctccatcatgtttttctgatttctctgtagagtttcaagtgggcccagcaattgcttccaggggcttaattctgttgtgagaatgagtatcactgttggctctcagggtggtggtgtaacacacaatctctctctctctctctcattctttctctcttgctcctctcccctgtccctctctcctagtcactgtttcctcaaagcagttttagtcggataatagaacttcatcactcatctcctgttattcttgtcagtgatttctctcttaaaagctctaaaatctttgttgcaatttgaggatgctgacagtgacagggcagctggctggacactgaatgcaagtttcatattgtggtgcctcctatacttagtgtagtcactgctgaccagagcctggtctcaggcttgtttgtcaagacacttggctttgttattatacccagtggtgaaagatctgactcacgaaaaccaaattaaccagaagctgatatttaaacccaaatgtttgttattttacaatagtggctattccactgcttccatgaggaacttggaaccacagttcagggcagccctctttcgggaagcaaaatcagtaagtaggtttcttagcgagcatggaatagaataaagggacatggctgggcacggtggctcacacctgtaatcccagcactttgggaggacgaggagggcggattgcctgaggtcaggagttcgagaccagcctgaccaacatggtgaaaccccatcgctactaaaaatagaacaattagctgggcatggtggcgggcacctgtaaccccagatacttgggaggctgagacaggagaatcgcttgaacccgggaggcaaagttgcagtgagccgagaccaggccattgcattccagcctaggcaacaagagcgaaactctgtctcaaaaagaaaaaaaaaaaagaataaaagcacataagtgtctctgggccgtgatttatccatgtcagcgtgagtctgataaaagatcactgcttctacctacgtctgaagatttatttgctttagctaatagttctttgatcactggtaagactaaagagtttttctatgttcaccagttatttgtattattccttttgagaattgaccgttcctatcctttgcctacttcttaacagtatcctattgatttatagaaattctttttatgctgagattattactcctgcatcatgtaatgcaaaattttaagtatattatatttaattatattaatcttgttaattaagaaagtagtctccttattcgtgtgtgtgtgtgtgtgtcatgaagacattccgatgtgtccagaatattttattctactgctttaactcttaaaataggaccttcggcagcagcacactgtgttgactcaaatattccccaatttgaagcaggctatatatcaaagtttctgattggttggacttgggagataatacccagatttgctagactgtctacctatctttgcgtcccactgccaatatttcctacctctttccagtaagtctcttttcccactttttactccattactctttaacttataatgtactttttgccttcttatgttgaaaccaaattctgaacagaatgaaagatctcctgactgacctggctagagaaggagaagcatttcttggtgggactcaatgtaatgtcatagacactatgtctgcaacttgctattatctccacggccaatataccaaacttgtagaaatattcatgtttttgtgtttctagtacttctcttatggaattaccagttaatcatagggctgcgatgtacaccaaaacaatgtcatatataagataaaatgtgcccccagtgttttcctaagtttagcatctactttccagtcactccttttgtaccttctccctaaagctggcattggattatttggctatcggaattcaatgctcctggttgtccttctgttgcttttccttttgaatcacgtggtttcttgaaataatcacaacttggacttccaccatgtgttttatatttcttttgtccaccctcctctaccctaagaaagagctccctaccctttaacggataggcagctttctttcccctctagaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggtaagtgccgttggcttcctgcggctcctaagcaccaatgcagaatttcccaaagcctacagttgcttttctggtggtttcttattttcttcctttgtcttgttcttgatccttgccacaccatctgtattccccctgctttcacactttctgctacccaggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggaggtgagaaaaaagatgtgccgaggcatctcagaggagcctcagccaaacagctcatgagcacagttcagtcttccactctcaataagtgtttgttgaatgtgaatgaaagagaaaactgtcacaccacaactagtctggattattcccttggtcaggcttgagtctgaaatgaaagtatgcctttggagcgagctacatccttcatccttgctgtgaacagaatagcttctctgtgccattctctaagttaagtcgtgagtgccagtatctccctgaaataactgccagagccagtttgcaggcaggtgaagatcattaggtttcttcctgatccagttgggatagctgttctctagatcatagctcttcctcaccacagatcctaggcttcacctacaacagtctcaagctgcccttttcctcaatccatgaccaacatctttccagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgggagttcgaggttattacatcttcacgccctcttcccagtgttgtctccctgtcctgattctacttttctttgattacttgcttgaaacagtctctcttaaaacctgaagataaaggatttagaatattgtcaagagcaacagagcagaagacttagagcctcactacttgtgtggaaacactggcttcttctgcttcttttcagccacaaagacaacattcctaagtgggtagagccagcaacctgaattctatacctctgtatctgaataaacttctttgttttttgagatggagtttcgctcttgttgcccaggctagtagctgggattacagacatgcgccaccacacccggctaatttttgtatttttagtagagatgggatttctccatgttggtcaggctggtcttcaactcccgacctcaggtgaacctcccacctgagcctcccaaagtgctgggattacagacgtgagccaccgcgcctggctgaacaaactttttcaagctctgtaatgctgtctagtatctgtctttactaaaggcctgttgtttcttagtgcatgactacatagatatctgattataaactgagaccttaacactcccccatcattctctcacttcttttaaacactggacacaagttagagagatttccacaccagatcatgacaaacacaaatttcttggattttttttttcctcccaatgtggagctgagctccatactgtctttcctaacttttatacctaggattgtgggggtgtaccaagaggggtcaactctttgactacagtcctgggagggtgaggtgggggtatccatgttttccttaggaagtggggatagctgcagtcagaaacaaccatatttaacaagattctggatgctccaggacatgtatgcagctctctcctcaatacaactgcttaaaaaaaggctgacacttctggacacaactcctttgccaaacaggggaggcagtataagccacctgttaatcagtgttacaaatcagacatctggcatttcgaaagagccattttgcttaagttttcttgggaccacttgagggtagaggtaacagttttcttggtacaactaaggcacagtaagcatttgataatagtaataataatgcagccttgttcattggctggatgactgatgacaagcaagctgtactccttttcatacacccttcactatctcttcctgaatcctagagataacccatcttccctgattaatattctaactgcactgctgtttgattttacttctgagtgtatcatcatcgtaattatttaatggatgttaattaattgctgataaaatatgttgaaattaaaaatgggaaggaagtagataaggtgctgacaaatgctcacttgcttatttcatgtgatcaggtcttattaatatctgtttgtttctcaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggtaactctccaggactccacaggtagcagatctctgccaatcctatggagcagatttgaaggagacagtattatagttgaagtaggtgcagtggctcacgcctgtaatcccagcactttgggaggccatggcaggcgaattacctgaggtcaggagttcaagaccagcctgaccaacatggggaaaccctgcctctactaaaaatacaaaaaattagctgggcgtggtggcacatgcctgtaatcccagctactgggaggctgaggcaggagaatcacttgaacctaggaggtggaggttgcggcgagccgagatcacgccattgcactctggcctgggcaacaagagcagaactctgtctcaaaaaaaaaaagaaaaagaaattccctctgtgagtgtcatgtgtcctgtgaacttaatatatatccctcataatgccatgagactactgatggagcgaaagcctgggttttactgcggaaaagagagagaaatagcatttctcagctccatgaggagagaaatgaagtctaacactagttcccaaatccctttcttgtgtttctaggttgttaaactaccagcttgtaatgctatctctgatctttctattcaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagaggtaagaccttaaaaactctgaagcactaaattgtgggttgtagtgtccccagatgtattattctcagaggtagaagcagaagcagaagcagacacacaagataagcactaatcggccgggcatggtggcttcggcctgtaatcccagcactttgggcagttgaggtgggcagatcacctcaggtcagcctggccaacacggtgaactcctatctctgctaaaaatacaaaatgaggcctggtgcagtggctcacgcctgtaatcccaacactttgggaggccgaggtgggtggatcacctgaggtcaggagttcgagaccagcttgaccaacatggtgaaaccctgtctctactaaaaatacaaaaattagccaggcatggtggtgtgtgcctgtaatcccagttactcgggaggctgaggaaggagaatcacctgaagctgggaggtggaggttgtggtgagctaagatcgcgccattgcactccagcctgagcaacaagtgagaaactccatctcaccaaaaaaaaaaaaaaaaaattagccaggcatggtggtatgtgcctgtaatcccagctactcagtcgggaggctgaggtaggagaatcgcttgaacccaggaggcggaggttgcagtgagctgagatcgtgccactgcattccagcctgggcgacagagcaagactccatctcaaaaaaataaaaataagataagccataatcatagctaattgtggctagcttgtgtttccacaaacacaagtagtttaacaaacccctggactgttcatttcaatgtaatttaattcagcatattatgtactctacagtttatgcttaaagttttaatactatatatatttttaaacaagtactcactttttttttttttttgagaccgagtcttgctctgtcgcccaggccagagtgcaatggcatgacctcggctcactgcaacctccgcctcccaggttcaagcaattctgctgcctcagcctcccaagtagctgggattacaggcacgtgccaccacacccagctaatttttgtatttttagtagagacgaggtttcaccatgttgatcaggctggtctcctgacctcaggtgatccgcctgcctcagcctcccaaagtgctgagattataggcgtgagccaccatgcccggccaacgagtactaacgcttaaaaatcaaaaagagccagtattgtctgggcatgtacactcacgcctataatcctagcactttgggaggctgaggcatgcggatcacatgaggtcaggagttcgagaccagcctggccaacatggtgaaaccccatctctactaaaaatagaaaaattagtcaggtgtggtgacgggctcctgtaatcccagctactcaggaggctgaggcaggagaattgcttgaacccaggaggcgaaggttgcagtgagccgagatggtgccactgcactctggcctgagtgacagagggagactctgtctcaaaaaaataataataataaaaattaaaaaaataaaaagagctaatatttaaaaagaaggcaggaaggaaggaatgaagaaagaaaaccaagatattaccagctatgtagtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccgtctctactaaaaatacaaaaattagccgggtatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctgaggcccagttttgtgttacaagtgtgatggttgggttaaccaaggctggaattcttaaataagtaactttctcagtgtttataaaatgttattttgccccaggatttttttgttttgttttgttttgtttttgagatggagtctcattctgtctcccaggctggagtgcaatggcaggatctcagctcactgcaagctctgcctcctgggttcaagcaattctcctgcctcagcctcccgagtagctgggattacaggtatgtgccaccatccccggctaattttgtatttttagtagagacaggttttctccatgttggtcaggctggtctcaaacttctgaccttaggtgatccgcccacctcagcctcccaaagtgctgggattacaggcgtgagccactgcacccgacctagttttgattttctcattaaaactgtttgttggctggttgtggtggctcatacctgtaatcccagcactttgggaggcatgggcgggtagatcacctgaggtcgggagtttgagaccagcctgaccaacatgatgaaaccccatctactaaaaatacaaaaaattagctgggcatggtggcatctgcctgtagtcccagctactggggaggctgaggcaggagaattgcttaaacccaggaggcagaggttgcagtgagctgagattataccactgcactccagcctgggcaacagagcaagactccgtctcagtacaaaaaacaaaaaacaggacagtgtttgtcttgattattgagtttttggcaccccttcaaattttatgcctaaggtcagtgcctcacatgccttcctctacttctgacagtggtcagaatagtggttactgctaggagaaggggaagagggttatcaggaaaggacaccctttgggcatctggagtgctaccagtgttctatttcttggctgaacggtgatagagatgttcattttacaacaatttaataagttgaacatttatatttcatgggcttttctatgtgcttgaaaaatttaataatgagaggaaaaatataaaggtagatatggaaatattatgaaaagagagtctttactacttaaaaaagctttttttctaaatctctagaagcattttatatatatataattttttttttttttttttttgagatgaagtctctctctgtcacccaggctggagtgcagtggcacaatctcggctcactgcaatctctgcctcccaggttcaagcgattctcctgcctcagcctccagagtagctgggactacaggtgtgccccactatgcccggctaatatttgtatttttagtagagactggatttcatcatgttgtccaggctggtctcgaactcttgacctcaagtgatccacctgcctcagcctcccaaagtgctgggattacaggtgtgagccaccacgcttggcctaaaagtataatttttaagcttttgaatgtatttggcataacttcttaaatgggaagagcataaatgatttttctcatgagaaggataatttttctattgattatgtaatctgatttctccgtcaaagtttactcaatgtaaggaaggttaacaagaataaccaagcccaaaatttcccagagccaaatttacatgactggcaagaaatcctggttataagagaacaattccattcttatgatttgcagacaatggaatattatttagtcataaaatagtagaataaatagtaacagtgtatctagatagcttcagtgtatccagacctgaatgcggggttccagttatctccatactcccaatttacatttcttcaggtatttgattgagtataatctatatccactagctttttctccttgtagaatgtgaaatatgggaccagaaggtaatctaaacctcatgtactatatggtcatctatttatagtcataaataataaaagaagactatttctgtggaagcctaattgttagttattgttttaatatcgctgttctccatgaatttcaaaagatcaagactggccaggcgcagtggcttacacctgtactcccagcagtttgggaggcagaggcaggcagatcacctgtcaggagcttgagactagcctggccaacatggtaaaaccccgcctctactaaaaatgcaaaaattagccaggtgtggtggtgggtgctggtaaccccatctgagaagctgaggcaggagaatcgcttgaacctgggaggcagaagttgcagtgagctgagaccatgccattgcactccagcctgggcaacaagagcaatgcttcatttcaaaacaaaaacaaaacaaaaacctcaaaagcaccagttagtactcgcaagaagctaaaatctgcctggtttcagatgtctgagtggagctatcaagcaggatgctgtagttgttgaaaaagaagcttattaatcttttagacaaagatctaagggtattaggtaaaggccatcaagaaatgaaaagggcctgattttaaggccatttccacatatgtagacaaagccttgtgtcttttagcagcctttgcttttgctgcccgctcagaccttttccctttgagacctcagtgaaacagacaacccaagactttgaaattttacagaagaggcacagcttgccatccagttatctaatgctatgtaacaatctactccaaaacttaatgacttaaaacaattgtcatttctttggctcactactcggcatgttaggcaggtctcatgaagaaggctcatttctcctctctcaatgtggcattagatggggtagctcagctagggggctgatgggttcatcttgcaagatagctcaccctactagctgatcaggtggtcctggctgtcagtggttgcttgggcttcctcacaggttggtagctgagttccaagacagcaaggtacaagtccatggcatttttgtgttctggccttagaagtcacatagcatcactcctaccgtactctttcagttgagacagtccaaaagatccaccttaattgaaggggaggggacaaagaccccaccactcaataggagcagcgtcaaggtcagtcgcattgtaaggagagcagctgagataggagagaccatttgaggccacctttttttttttttttttttgagacagagtctcttgtcgcccaggctggagtgcagtggctcgatcttggctcactgaaacctctgcctcccggattcaagcaactctcctgcctcagcctcccgagtggctgggaccacaggagtgtgccaccaagccaggctaattttgcatttttagtagagacggggcttcaccatgttggccaggctggtctaaaactcctgacctcaggtgatccacctgcctcgaactccaaaagtgctgggattacaggtgtgagccaccacgcccagccagagaggccatctttggaaaatacaatctgccccacccaattgcacagctttacctcaagcttggccattttcttcagcccccacaaaaggacttcctttcttccttccttactctcacccttccttcctgtcttccttcctttcttcctttctgtttttccttctttccctttctttttttgagaagtgaatcctgtatgtttggcaagcttctgaataagtgtacctttgaaaaagagggtttgattcttagtaagtgaaggcaaaatctagacactcggaactagtgaccagacagtggattggagatgtgtgtgctgggtcttttcttgggctaaagtgctttgaaacagttctataactgcaacctcttctctagcagacaaagaatcctctgaacaaggttctgaagtcagtgaagcacaaactaccgacagtgatgatgtcatagtgccacccatgtctcagaaatatcctaaggcagtaagtacactggagtaatcattgcatacgagataagacgataaataatgacagtggccagtcatgggggctcacgcctgtaatcccagcaccttgggaggccgaggcaggcagatcacctaaggtcgggagttcgagaccagcctgaccaacatggagaaaccccatctctactaaaaatacaaaaaaaattagccaggcatggtggagcgtccttgtaatcccagctactcaggaggctgaggcaggagaattgcttgaacccgggaggcagaggttgcagtgagccaagatcacgccattgcactccggcctgggcaacaagagcaaaactctgtctcaaaaaaaaaaaaaaaaaaaaaaaaagcaataatgacagtgtgcttagtggccacacaagtgaagggcaatccagttttaatgaagctgatggaaaatgcaaattgtttagttaaatttatgtttcgtgtgaatgaaggtcggctggtacagtcagataaaaggatcattttcttgagatagtgtaaatgatgacttgcttcaatacttctgtcctatctggatcctttgcctcttactcccatatcctccattgtgtcctgtaattcatgcccagcctgaatggtacccctgcctttaagtccatctaaggagaacgggtttgctttgggagatggagtctggaagagaggacaggattcttcatgggagggctcatggagatcattccatttctgctgttttttactcaacctgtaattatctattaaacagttcagcctcaaagctctttcagaactgatttaagagacacgcatcaaaaaaatataaaaaagaaaaaaaagccggttgcggtggctcacgcctgtaatcccagcgctttgggaggccgagacgggtggatcacgaggtcaggagatcgagaccatcctggctaacacggtgaaaccccgtctctactaaaaatacaaaaaaattagccgggcgtggtggctggcacctgtagtcccagctactcgggaggctgaggcaggagaatggcgtgaacccaggaggcagagcttgcactccagcctgggcgacagagcgagactacgtctcaaaaaaaagagacacacatatattaataaatatccacacatatattcagtaatcattgtgttctaaccttgtgggttacacatgaggtagaaaacaattactcttaagtcgctgctgcctgacacatttgtaggtcctcaatatttgttgagtgagtgactgaataatagattcagagtgaattgatgattatgaacttcattagaaacattaaataagaatgtaggatgacctaaaaccaaggaggtagattgtgtaatataaagtctgttgtaagaaatcagaaaagggaatttatggtttcttttgtagaggttggaaaactcttccttgaaagctggaacatgtgcttgagaactgcaggaaaatgaaggatattggagtgaggagaaaaaactcaaagtcagtagacttaaacactgaatataacacatagttcaatttcagctgaggtgtggtggctcacacttgtaatcccagcactttgggaaactgaggcaggcagattgcttgaggccaggaatcaagaccagcctgagcaacacagcaagacaactgtctctacataaaatttaaaaactagctaggcgtgttggctcacatctgaagtcctaagtatttgggaggctgaggtgagaggattgcttgagcctgagagtttgaggctgcagtgagccatgatcttgccactgcactctagcttaggtgacagagagagaccctgtctcaaaaacaacagcaacgacaaaaccagttaagtttctctttgtctgaacttttatctatcatatctttttttagatattatgtagttatctgacaagtgtttgtaagacagactggagccacagaatgttggaattagataacacttctatattaccaaggtaaagaagattaaatgatgtgtacaggattattgagttagtgaaagagctgaaactccagttgaggtttttaaactgcgcaacctctcaagtaaccaaaaaaagcagccagctgatcagcaaactcatcttgaactgtaacaagccagccagatttcattaaaaacattacctaaattaaaggctcctaagtaagatatccttttagaaaacttccttgtgtgccccaaagtgttacttgagaaattaaatatgagaaaggagcctatctaagcaaaaaattagtgttattatcaagttaaacgtacaacacaggcacatatatattaaattattgttatattccaaaatgtccaggcatgaaaggtagagggggttgaaagctcagagtcaaaacttgagttctgtcactcttctgcctggggtcagctgggataaatggaaatgcagtagagtgtaatgtttaagagcatggagatttggttgagacagtgatttagatcccagctctgctacttaactagatatacagctttgagagagttttttaacctctattaggccttgtctccttatctgtaaaatggtagtattaagtatacccatctgatactgatgtggcaagattaaaataagggtttaatacagtgcccgagacaaattaagccctaaatgatagtgaggatgagtgtgatgataatagtagtctcatttctctgacctactggagttctcaatgttaagctttttttttttttttttgagaaagagtcttgttctgttgcccaggctggagtgcgtgcagtggcgcaatctcggcttactgcaacctctgcctcccaggttcaagagattctcctgccacaggctcccgagtagctgggaccacaggtgtgtgtcaccacgaccagctaatttttgtatttttagtagagacggagtttcactatgttggccaggctggtctcaaactcctgacctcaggtgatccacccacctcggcctcccaaagtgctggaatttacaggtatgagccactgcgcccggcctaggttaagcatttttttttttttttttttttttttagagtctcgctctgtcacccaggctggagtgcagtggcaccatcttggctaactgcaacctccgcctcccgggttcaagcgactctcctgcctcagcttcccaagtagctgggactacagacacacgctgtcacgtccagctaatttttttgttttgagacctagtcttgctctgtcacccaggctagagtgcagtggtgcgatatcggctcactgcaacctccgccccccaggttcaagcaattctcctgtctcaccctcccgagtagctgggactacaggcgcacgccaccatgcctggctaattttttgtatttttagtagagatggggtttcaccgtgttagccaggatggtctcaatctcctgacctcgtgatctgcccgcctcggcctcccaaagtgccgggattacaggcgtgagccaccgctcctggcctccctcttcttaacagttactaatgaggagggagcaatcattttcatttgctctatggtcccagattactgtttctttagcaatagtgaatatcgagaacctcaaaattttttctcttatcgtgtcaatttcaggtgtcaggaatttcctgacccttatgtatgccaggtagtaagttttggcagccctgccccccagccaaattaggtggcacatctgagctaataagccaaagggtgttatctggcactaatccttgcagggtttctgccagcaagttcaaatgagttgatatatatttcaatggttaatattactaattgcatactttctttgctgttcagccccaataaaattacataatggaattagctcatgtaaagaaagtattctgaatccaacaaaaaatattagattgaaccatatattgtcatactcatagataaaaaatggttgacaattgtcagttctgtatagtccaacctaatatgaatgaataaaacatctgtgtgtacttggatcaaattttaatcttattcatcctcccatttcaccattgttaccagaataaacttgatgtagtctgcatgaatatggacttctgattattgtcccaggattattagcaagtttaaaaaatttgctgggtgtggtggctcacgcctgtaatcccagcactttgggaggtcgaggcgggcggatcacctgaggtcaggagttcgagacaagcctggccaacatggtgaaaccctgtctacaaaaatacaaaaattagccgggcgtgatgacgggtgcctgtaatcccagctactcaggaggttgaggcaggagaatcgcttgagcccaggaggtggaggttgcagtgagccaagattgcaccactgcactccagcctgggcgacagagcaagactctatctcaaaaaattgttttgttttgtttttttaactaggcaggtgtggtggctcacgcctgtaattctagcactttgggaggccgaggtgggctgatcatgaggtcaggagatcgagtccatcctggccaacatggtgaaaccccgtctctactaaaaatacaaaaattagctgggcgtggtggcgcgtgcttgtaatcctggctactcgaaaggcggagaaaggagaatggtttgaaccaaggagtcggaggttgcagtgagccgagatggttcccctgcactccagcctggtgacagagcgaaactcggtctcaaaaagaaaaaaaagaaaaataattttagatgtacaggaaggtgctatgtaatgtttatttagttttactcttttttcttcttttttggtaatgttatgaaacatgtatttttcaatcaataatgttttggggttctatccatgtcgatatatttagctttttatagttccttcgtcttaactgctgatcgatattgcattaaaataatacatgacctttcgtttagacagaactctaatgggtaatgattgagatttcatactgtgtgccaagtgcttgatattcatgactctctcgggcttcacagcagccttatgagttattctttccttcaagtaattatgaagtgcctgttttagtaactgccgggctctgtgggcacaaaatggtggataagacagacttggtctcttctctcttgaatcttacatactactgagggaaaatatgtacatcagtgagcaaataagtaaagcagatagctctgagattctaagtactatgaaggaaataaatagggcgatataatagcaatgcgaggagttgaactaggataggtgttgaggaaagatttctctgaggaggggacgtttgaactgaaatctgaagaacgagaagggaagagctacccatgtactgggtagactgtactcatctcaggcaaaggaattggtaagtgtaaaggccctgaggtaggaaagagtttgatttacctgaggagtgggaaatcaaaagaaaattaaagtttctcttgcacacatgtatattattattcccccaccccctttcaaaggaggacagtgaagtctagggagaagagcttgctcaagggaatatttaatacagttttactgagtgtatactgtgtgccagacattatgccaggcattgtgccaggcactagatactcggtagagactttaatggggccgggcgcaatggctcacgcctgtagtcccaacactttgggaggccgaggtgggtggatcacttgaggccaggagttcgagaccagcctgggcaacatggtgaaaccccgtctctactgaaaatataaaaattagtcgggcatggtggcacatgcctgtagtcccagctactcaggaggctggggcaggagaatcgcttgaacctgggagtcagaggttgcagtgagccgacgtcgcaccgttgcactccagcctgggcaacagtgctagactccatctctaaataaataaatacagattcccaggagccactctagacagtctgatataacacagaggcttttatacattttttatagcaatcactatgagaaatacatttctgcagtatccaatactcttataaaagaacaagtttcaagaaaccaggcttactattaacatttgccatgcattctcctattccactagatagtgtcttatcctgtctatcctatcctattgtttcttttttaaaaagctagtgaaacccgctaatctgacccatcaaagtgtcaaaaaaaaaccagatttttcaaaacactgtatagtcaatagttttcttgatgtttgggagagttggatgttatgggagggttattaagagaaaaacatcaaatatcgtttttttgtttgtttgtttgttttttgagacccagtctcactctgttgcccaggctggagtgcagtggcactgcaacctccacctcctaggttcaagtgattctcatgtcagcctcccgagtagctgggattacaggcatgagccaccatgcctggctaatttttgtatttttaatagagatgcggtttcaccatgttggccaggctggttttgaactcctgacctcaggtcaactgcccgcctcggcctcccaaaatgctggtattacaggtgtgagcctctgcaccccgccaaatatcttcatttttaagaagcaccccagatgattctgatgcagaatcattgagagatcttgcctgctgaatttcttaggggcaggcacaggagctccacttgctttctaagagaagaaaagatggggtaagagccggtctttggagaagtaagggcattggcctggccagctagtgaaaagaagcatacaggagggcactcacagatagaggggagagcgctatggctggtagggaaccatcctggattgactcattactggtgtcacgatactgacttgcctgccacactgtggaaggaggagacttctgttggccttggtgtacttctggaaacttcctcctggtatccctgatgccaacatggacacagggacaattaaaagaaaggacagggtgatggcagcgactgtgaagtgggattgaaaatattggagttcctggccaggcgcggcggctcacgactgtaatcccagcactttgggaggccgaggcgggtggatcacgaggtcaggagatcgagaccatcctggctaactaaaccccgtctctactaaaaatacaaaaaattagccgggtgtggtggcgggtgcctgtagtcccagctactcgggaggctgaggcaggagaatggcgggaacccgggaagaagagcttgctgtgagccgagatcgtgccactgcactccagcctgggcgacagagggagacactgtctcaaaaaaaaaaaaaaagactggagttcctgtgggagggcagggtggtctggtggcctcctcagtggcatgcacttgagtgggcatgggaagccctgggcagctctttgctatagtggctgaagcagctactgaatctccagtatcagtcaggaggtcttttaggtcctaacctcaggaaaatactagcttggttttcatgaagaacactgtggccagttgcagtggttcatgcctctcatctcagccactttgggaggctgaggtggacagattgcttgagtccaggagttctagaccatcgtgggcaacatagcaagaccatatctctattaaaaaaataaaaataattgtccctatgtggtggtgtacctgtggtcctagctacttgggtgactaaggtgggaagactgcttgagatcaggatgtcaaagctgcagtgaaccatgatcacacaactgccctccagcctgggcaacaaagcaagactctgtctcaaaaaaaaaaaaaaaagttgagaaatagctgtttagaaatttatttatttgtatataatcatcgggtacaagcacagttttgctgcatttatatattccactgtggtgaagcctggagcgacgcacattgttcccaccaagcaacctcccatcatccaccctccccgccgctccgaatcagacatttttttttattctttctatatgtggagatgactgagaaaggctgtcctggagaaatgatccactggactgtgagagagaagagctgggttctctttataaatttcctatcaattaactatggcaattaagtcaagttgtcttttgatgccagttttacctataaaaggattctcagggaataatatagtagatagattatacctatggttgatttctagagagtaccgtaatgggttaattggatggcgtataagcacttggagcctcactaacctttaggaactaaataaacattttccttatcaggattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaagggtgaggcatcctgtgtggttactggggtgaggaagtctgatgaacattgagactgagggtcagaattactctggatttttgtggggtgaatccagccatttcactttattattttattgttcaaagtgttgtgtgcatgtggtttaaaaacatcgaatggggctaaacattttacatgaagcaggcctttgtcccagctcttcacagatcacttcgcctgttcccacccttcctcaatccacggcttcccacatttcagctatatttatttttactttttgaggtggagtctcgctctgttgcccaggctagaatgcagtggtgtgatcttggctcactgccacctctgactccgagattcaagcgattcacgtgactcagcctcccaagtagctgggattgcaggtgtgcgccaccgtgcctggctagttttttgtgtttttagtagaggcggggtttcaccattttggccaggctggtctcaaactcctgacctcaagtgatctgcctgccttggcctcccaaagtgctgggattataggcgtgagccaccaagcccatcctatctcagccatttcttctgttatttacttccatcatatttctgagtattgatttttgttcttcctcttttcctgtttttttttttttttttttttttttttttttttttttttttgagatggagtctgaacatgttgctcaggctggtttcaaactcctggactcaaatgattctcctgcctcagcctcctgagtagctggaattacaggcgtgagccaccatacctggcttctgagtaacatttctattgcaatctcctgattcaccggctttagacttcctatctcggaccttaaaagttagctcttttgcactacactcatgtccctttccttcccatcgtaattgtatcataatttttatttaaatccatttaaattggttctgttattatggatatgtaaatattaattcttgcagaaccaagtagtatgcaatgattatatttctttacacgtattttttgcagcaatttttcattcgccttattttcattatacatattgtaattattttcgtgtccttcaacagtcttcccaaattttgaaataatcaaacctgtcaaattatctactcatctatttttttcctgaagacctctctccatcctcttgttctgctctagcccactgtttcattattactgctgctcatggagaatacgatcaaattctctcctataccagatttcttatctcctggttatcctctaatttattttcttattttaatggatcatattttcagtagtttttaaagaaagggcatatcacaagtgaaaatttgagaaagtcgtgcatgaaatctttttttcctaccctcatatttgattcaagtgtggaaatctttttcattcagaatttcgaaggagcctgggtgcagtggctcatgcctgtaatcccagcactttgggaagccaaggcgggcagattacttgaggtcagaagttggagaccagcctggccaacgtggcaaaaccctgtctctactaaaaatacaaaaattagccgggcatggtggggtgcacctgtaatcccaactactcgggaggctgaggcaggagaatcgcttgaacttgggagatggagactgcggtgaaccaagatcacgccactgcactctagcctgacacagtaagaatctgtcacacacacacacacacaaatgattttcaaagcagttggtccatgttattctagatccaggcaaggagtctaatctttttatgaaaactaccatgaataccactaatgaaagtcttggggctcacactgcaacagtatatgattctttgcttttttctcttacccttaatacagtaatagacctggacccacaggagcagcaaggccgaaggcggtttctgttcgacatgctgaatggacaagatcctgatcaaggacagtaagcatctgctttccactttgaaacaaaggagatattgagacagaaattcaaaagtttgagtttggttttgtgctgatgctgaatattttaataacttttttgagttaatttactcttaatgaatttcctatgtacttgagtataatttatatttgtgactacctaatccattacctaatcttataggttatttatttatttatttatttatttattttcgagacagggtctcactctgtcgtccaggctagagtgcagtggtgcgatcttggctcactgcaacctccacctccccaggctcaagggattcttgtgcctctgcctcccaagtagctagggttataggcatgtgccaccatgcctggctaattttttgtgtttgtagtagagatagggttttgccgtgttgctcatgtctggtcttgaactcctgcgctcaagcgatctgccctcctcggcctcccagagtgctgggattacaggcgtgagccaccgtgtccagcccatagtcttataggtttagttcatttctcacccatgccagcctgatgggccctttttttgtagcagcagtttacttgaatattgacaatgcccaaatggaataacaaaaagtgttgacattcttcttttttttgagacagtgtctcactctgttgtccaggctggagtgcagtggtacaatcttggctcactgcaacctccacctcctgggttcaagcgattcttctgcctgagcctcccaagtagctgggatgacaggtgcacgccacttgcctggctaatttttgtatttttagtagagacagggttttgccatgttggccaggctgatcccaaccccaggtgatccttctgcctcagactcccaaagtgttgggattacaggcgtgagtgaccacacctggtcaacaggaattttttgatgttgacataactaagtgaattttagatctcctttaaagttttaggaaagctggttgtccttattattccaataatctgaagaaggcctcctttcagagtttccagataaaatgtgggacatacccaaaaaaaaattatttggtcgggtgcagtggctcacatctgtaatcccagcactttgggaggctgaggcgggcagatcacttgaggccaggagtttgagaccagcctggccgacatggtgaaaccccatctctactaaaaacacaaaaaaatcagctaggcatggtggcacatgctggtaattctagctactcaggaggctgaggcatgagaatcatttgaatttgggaggcggaggttgcagtgagctaagattgtgccactgcactccaacctgggtgacaaagcagactctgcctctaaggaaaaaaaaaagttatttgttgtttagctgaaattcaaatttaaataggcatatggtttttgtttttgaaatctgttatccataccgcctgtgcatgtgtgtgcataagaaataatatggggctggtgttttatcttatttttaatttttttgtttgtttgttttagagacaggatctcactatgttgcccagctggtctttcagctcctgggctgaagcagtcctcctgccctgcctcccaaagtgctgggattataggcatgagccactgtgcccgacctggtgttttaattactttttgaaaggcccaatacttttgtttcatctgcttttactttgtctttggttagtcatagaaagaactgaaaaaggagccagatgaaataaacagtgactctgacttcagcatcactgtgggcttaaacagatgtaagcttacagagaacttttggacatggaaagtgatttggttctttcctttctgtgctaatgttaaatttagctttcacttttttttccccagcatttccagaactctctcttcctttattcccttacagtgataatcattttctactcaattttagattcgattggtattacctttggctttctttttgccagtatggtctagcagacagagcaggctttgtaatcagaccaaccttgtttttattccagactctttgacttactagctctttgatctttttgatattacttaatttgaaggctcttgtgagaataaaattgagctaatatagtttacataaagcacttggtattgtgcccggcacattgtaatgctagttatcatccctttcctatgcaaattgggatgagggagtcagcattatcacttcgcattgttgaagttctcaataatgacatagaaacatagttacaaatgaatattgcctaatgggctgagaatggatccctttaaagtaattcctttgtttcagtttaatcatatttagctgtgcttttaaaagcttgaatttttagtcctattcctggcactctgtattagctaccaatatttgcttttaaaaattaataaaaatatgaaaaatcaagaataggcaaatccagagagatagaaagtagattagtggttcaggagctagggaaggagaatggggagtgactgcttaatcagtacagggtttctttttcttttttcttttagagactgggtctcgttctgtcacccaggttgaagtgcagtggcatgaacacagcccactgcatcctcgacctcctgggctcaagtgatctcacctcagccttccaagtagctgggactataggtgtgtgccaccatgcccggctaattttttattttttttgtagagacggggtgttcctatgttacccaggctggtcttgaactcatgggcacatcccatgatgttccctcttctaaaaggactgttactgcttaaattataccaattcctgacttttttgcttattgtcattttgtaaaatggaggcaagggaaaagtgattcagagaagacgttgtattgtttatgattacttttatccttattttatttttgaagcattaagagtatcaacagtgctgaattaaatgcaatttctttttagtttaaagtttacagtggtaagtgatcctctggatgaagaaaagaaagaatgtgaagaagtgggatatgcatatcttcaactgtggcagatcctggagtcaggaagagatattctagagcaagagctagacagtgagtcatttttttttcagttctaattatttccaaggaaatcatcctaatagtgaatatattttatcttcaatacataattattactatgaagttgataagacacaaagtggattgaaatcttatccctacaactgtatttatttctggatccaacattaaagtagtcagttgtgtatttttacccccatatacctgattacaactagaattgattttgaatctacaatgtttgaaaaggagatttttaaaaagacaagttattttcatttcaaatttatacatcagaattttggacctctcttgagcattttcgtataggcagctgatgcccattctttatgttatcatgcatccagtctttttttttttttttttttgagatggagcctcactctgtcgcccaggctggagtgcagtggtgtgatctcagctcactgcaacctctgcctcccaggttccagctgttctcctgcctcagcttcctgcctcagcttccatggtgtgccaccatgcctggctaatttttgtatttttagtagagaccgtgttttaccatgttggccagactggtctcgaactcctgacctcaagtgatctgcttgccttggcctcccaaagtgctgggattgcaggtgtgagccactgcacctggcccatcttgtctcttaaaaagacattaactgtctcctctttcctcacattcactggtcattaagtcttatccattctacttgtgaattgactatgctctccttactacaattttttttttttttttttttgagacagagtctctctctgttgcccaggctggagtgcagtggtgtgatctcggctcactgcaacctccacctcccaggttaaagcgattctcctgcctcaacctcctgggtagctgggactacaggcacctgccaccacgccagctaatttttgtatttttagtagagacgggctttcaccatgttgcccaggctggtctcgaactcttggactcaagcaatccaccctcttttgcctcccaaagtgttggcattacaggcataaaccactgcgcccggcctccttaaatataattactataatttctttcttttttttttttttttttgagatggagtcttgctcttgttgcccaggctggagtgcaatggaccgatctcagctcaccacaacctctgcctctttcttaatcaagcgattttcctgcctcagcctccctagtagctgggattacaggcatgaaccaccacgcccagctaattttgtatttttagtagagatggggtttcttcatgttggtcaggctggtctcgaactcccaacctcatgtgattcgccctccactcagcctcccaaagtgctgggattacaggcgtgagccaccgcgcccggccatataatttctaaactggtcttcctgccaccggtttcttctaccccatttccatctactatagtaaatacataatacatttgatcactgccttcttcttaaatccttttacagtttgctatagatcagcatgttttaaaaacatttgtatttgagtacctttagttgggactgcgctgtccagtcttcactgttcccattaccttacatagctgggatgtcacctatcttatctgctaggaccttcagacacttaagattatccactagatcaatgtttttcaaacttccagacacacaccccattagtggatgtgaaactgaattagtaaatcacaaggaaatttgaaaaatgcaaaccaaaactgtgggaaagaaaacaggaattaaaggccaggcgaggtggctcatgcctgtaatcccagcactttgggatgccgagatgggcggatcacctgaggtcaggagttcgagaccagcctggccaatatggtgaaaccccatctctactaaaaatacaaaaaaaattagccaggcatggcggcggacacctgtaatcccagctactcggaaggatgaggcagaattgcttgaacccgggaggcggaggttgcagtgagctgagatcaagtcaccgcactccagcctgggtgacagaacaagactctgtctccaaaaaaaaaaaaaaacaaacaaaaagaaaacaggaattaagagtacatagcacatattgtcttgtgaaacttgttttatgtattgtttaatgaatcatggtataaaattattcttactgatcattataaacattttttgaggaatactcctcagaccctaaggtttacaaagttcaaatgttagataagattctaattatattcctctagtatctttccaactgtgatccttagtctttttcctcatctataaaacgggaataacagcagtctctatcttactgagttgtgaagattaaggaagcacttaaataagggattaaggggcttagggtagtgcctggcataaggcaagtgacgttatctttgtgggctattttccaactcactcctatccccattcctaaacatgctatgttcttcctgacctccatgccatttgtatgtgcacagggaaaatccacttaagacttttctggtgatttctccagaaatcctttccaatttgtccattctggtgcagatgcctctttatgtccccaaagcaacttgtgcttccatttattatatagcacctatacactataccattttcctttctccttcactagattgagtcctcttatgaaatgggtaatttcattcatttagcatccccagtacctaacctgacaaataccaagtatcaaagtgttcaactgagtgatgctgtttttttccctttcccaacagttgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaatttggtttactgtgatgtctagtgtctctcaatctaatgatgaaagtttagaatgatgaaagtttcatttgtaaaactagctagctaaaggcatttttctccagtaccttagcactttaccaggcaggaagcaggcttgctttcaagaactgaaaatgaacggtcacaggtgaatttacaaaaacaaacaacaaaaaaaacccagtttattcatcttttagttcttccaaaattgaaaatatcaagtcctactgctaaggagaaaaaacaaacaaacataaaatccgggacccctccccccttcttctcttaaagtcacagagcacggaaggaactgcagtgggacaggtgggtgcagagaaccagaaggggaggatggcaagataaactccccaaatacttgaaaagctgttcaacagaaactgtgataaatacaggacaatgcaagacaaagttaaaataaggagcagcagtgccgagaggctgtgttgtagatatggcctcccttcctcttctcttttctcatcagggtattctaggcccaaggcatgacttgtcccttccagatctaaatgttgactcctttgagccttcctctacatttcactagaagcggtacatgaggcacaacctgatatatcttccttagatatatgagaaaaaaaagaagacagtggcaattttgccttctatcattgtaccatgtgtgcattgtatggagaaaataaccgagccagggagtatcactgcttcttatgtcttccaaggcagcagatatacctcagaatctgcacgaggcaggaaagcaggaaaactcagacgaaggcaccagcccaatctgcctcactggctcaagctgtatggtttatcacaaccattagcaaatttccgagaaccttgagtattgcaaagataaaacttagagatgtgcggaaggtcatggcagtagggtaggttggaggattgaatgtgctggtcaagaaccatgatacgggtaattaagggtcaccttgtaccactgtcttggaaatacagctttgagacaccaaataagatgtcagaagccatcaatgtcttggcagaaggtgacaggaagagagaagaatgaaacaatatttattaacagcgggagcctcctcctgtcttcaagaacacctcctcccttgccatctgaatggggccattggcacgtgtcctggtgggcctggaattccccgagtagattggtccacacaaatggccccctaaacccataaacacaaatggcaaaacttcaaatgaaaacgaaaggaaaaatacagtttctatgtcatgtaaaattttcaggggttggctggaggaagaatggagctcagggccaaagttcagaagttacttcctctttttcttggggggtgcagagctgtgtctggaaccacggttagagccacggcccgaactgtgcacagatgccttcctcttccggctcatacttcgactttgttcttcttcttcctcgtaacgactttctcggtccgctaaatagaagaggcattattagttagcaataggtaagctttaggtacctaatattactggatagcatgagatagtacagagaatacactttggaatcagacccaagttttaatattgggcaagtactttctgaaccttggtttatttacaaaagggagaattatttaagggttaaataaggtaacctatgaaaactacctattcccaatgcttggaacacagcagttaatatttatttccttttaagctttaaaacgtttgtttggggtttggcttcagagtaactagattagcattataaagacatgcctaacctggaagaagcctagaaaattaaagtattataggatttaggtttggaaactgagtaggctaattcttgagtattacatgaatatgtggctatcatggctataggaaagatgggggcttgcgcagatgaaaacagcatccagtttggcagagcactgcccactgg

SEQ ID NO: 12833 - DNA, 20168 bp, Human
ggtggtaggtagagcagtgactctggaaccaaactgcctaggttccaaccttggttttccaacttactagctttgtaatctggggcaaattgcttttctcctttttccgtaactaaaaatgcaggttaaaaaagtactgttaatatttgccaggggctgggtgtagagggaggaaactgagaacaaaaagccactagaaaacttttggaatgagggaaatattccatatcttgatcatagcagatgatcaagatatgtttttcaaaactcataaaaagaaaagggacaaatttttctttatatgaataacttaacaaggttaaaaatagaaagcagcagtgacaaacaaaggaataatgcacatcaaaaatttagtacactacctgcctatataaatactaaatactattagcgatcattgtaaaaacaatagggaaaagttaggaggtataaggaaaagcagaaagagctaatgaaccaagattctaatctggctctttctttttggggtgttgggggtggggggggtggtctcactctgtcagccaggttggagtacagtggccggatctcggctcactgcagtctccacctcccaggctcaagtgatcctcccacctcaacctccctagtagctgggaccacaggtgcacagcaccatgcccagctaagttttcgtatttttggtagagacggggtttcacgatgctgcccaggctgatctcgaactcctgagctcagggaacccacctgcctcagcctcccaacgtgctgggattacaggcatgagccactgctgtaatggctcctttgtatattagctagaggctgaattcagtacatgagagggcagtaacttattgcgaaagttaaattggacctgtttgaaagatatgtgtaaactgtagagtcatacaggaatgtgagatatgggattattcatgagacagcaataggaaatcaaagttaccacataaatgcgggtgtgggatgggaaataatttcctagatcacctccccaagataggatactgcggtaggttgcgaaatgaaactgtgaagggggagcacatctcttttaagaacctttctatggcagtctacaagctctaggtcaattttgaagaccatccaagcgttctaatgtgccagggttaaaccccaaactctaaggaatgccaatgccaggaggaaagaatggatgagtcggcagaacacctctctggacccacaatgccgtaggagtcagacacccttcgcctccacaacttcccaacagcctttggtgtgagaagtgggttaattcatttcactgctggcttgttagctggcggacgcttcgggagttcccaccccagggagcagtgctgactctacaggggcatccggcggcagtcgctgccaaaaatctcaccaaggggtgaatggggggtcctcaggacctgcggtgccgagctgggtaataaaatactgcacctgaattcttctttaaggaccaggaggaggttcgaaccccaagaaaggctgcaagctgaaccagaagctcgaacccaaagttcgcttcacagccagccacactggcactcgctgaatctgcgcgcctcgcgagttctgacgatcgtcatgtgataactgccacgcacctgatggcaggggccattgggtgctttgcttggttcccattaaagtcgactgcgacccgaacgcaacaaacctaagagttggaaggcgcaagttcctctgccagcgagctcaccctcggcaaccagactgctgaaagtgcgctccacgccggaagtgcactaatccgcagcacgtggggttgccagggcgctcttcacgtgactgggcggagcctcgggaatctggtagccaatggtagcccgagagggcggtgcctgtgacgctccggggcctatcccggaaatagggctgagtgggggcgggtaagggcggggaggctggggtgtggaaagtgtggcggccccgccccgtctcttggaactgccgcggccgccaccgccgctgccggcgccgctgctgtaggggaccagcgcgggtgcgcagacgaaaggcgctctttgccagctgaaaggtgaagacctggggaaaagctggtggggaaaagctggtggggatggggccagagtgaggcagggccggggaaggcgcccagaactgagcgctgaccgagagaaagaaggagaatggatgggggaacagaggcgagcgcgggacccgccggggctcaggccctagtggggccgggccgggccgagctgagccctggatgccggcagaacagggggcgcctgtgcggccgcggcggcgacgttgaagggtggagggcggggtgcgcgccagctagcagagggccgggtgctgctggccaggttctgttaccccgcatccttcgcggggacctgcggcctgggctgggtcccccgcagtagggttcggggcggcggccgagggctgggcggcgggggaaggtcgccggcttctgcggtggggcgatgggggccgcaacctgctgtttccagcacggaggagcgcccagggcgggtgtccccaccctcagcgagctcctctgcgacttctcatcccacctccccaagcagtagctggaaaagtttgtagaggccagagttagaaagtggccactagtctagggtgggtgttccttacatgcagaaataacgggcccatgatgcttggcacataacttgtccgaaatgagacgtttccctgcctacatacccgttgttaaaaagcaaacacaaactttttgtgtagttcccacggaaaaactaccatctcccctgcccaccatggcagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggtaagtacccttgcagatcaggctttggcttcggcgttgggactttgatcatttgtattccgttacagatcatgagatttctatacttaaaattttgtaataagcactattttttccttcccacaattactgggtaatcagttattacgttgaatacttaaaggtagcattcccttcttgggcccttacaatgttcattaactgggaactgaaactttcctgaatcctagtgacctataagatctatttagtttacagatgagaaaacctgttctagcaattctaagaaatctacactttatttttcttgtgtaatctcataattgaatcactggtctatattgggtcttgacatgtcgtgatactgtttagttgtttactgcctcttaattgtaagaccactacatttttttttaagtaaaattagatgaccttggaaggaggagaaaaagaatctgttgtaatcagcattggtattgtgctcttgtgtgtgtaatgagtgatatacttggcagagattaaacaggtttcctgttctcctctgttaggttcaccttgttggaattgatattttcacgggcaaaaaatatgaagatatttgtccttctactcacaacatggatgttccaaatattaagagaaatgattatcaagtaagcactgattttctttagaatgttgcttgtttcttcaaggtgcaaatactttgtactatcagtaataatttgacaaaacccaagagtagttttgtaggtttttctaaccaattattaggcaccagctatcttagaaattggagaaatagtgatgtttaacacatgtacttttctaggattattgctagtttgctatttttttcacattcttgcattttttaaaaagtcaaatacttattagtgttctcaggccaagtgactgcatattgcaattaagtccaatgtttagtaaaagtactattctctctgttgtaaaatatttcttgttctaatttaaaacatccctcctggatgttttgtttcttttcactgatcagacctgagacattcaagaaactactgaaattcatgttcctaccaagtttttgcattaatgaatgttagtcagaacttgacattcttaagtagagaaataagttgaaagccataaatataaaggataaagtacctggtcactgagtatggtgaagaaaacacaaaaactatataattggttaaattatacttagtgaccatgctatgaccttttgctaaattatgtatgtaaatttcaagttttagttccagttatacatttgggtaggtcatatttaatgatagcattttgttgtttgaagtattgatgataacaaaataattgaccttataggatgtggaagctcagattacttataactaaagcttttcttgaaagtcttcaatttctgtatcaagcataccatatatcaaactcatttctgctcattttacatagtgaaaaatacaaagttgacactggtatttgttttatccgacttaaactgatttttttctgtaccctttgttgtattgtataaatttcttttaatgttgctatcaactgcacttacgcaatgatttccttttgctgtttgtccacatgcaaacatacttttttgtggttttaatctagtaaacacttttatattttcactttcctacttgtcataaatgttttctaggttgctttgaagtctttgtagaaatttgaattgtcttgcaagtgggtttttttaaccaggtagatctgggtttggatctagttctgtcactttctagttggatgattttggacaagttatacacctttctgagcctgttttctcatctacaaaatagtgataataggaggattaaatgagaaaatgtaccccattaagaactccataagtagatacgtaccaaaaagtgctgttctgtttcccccttttcctatgtaaaaattctacttaatcatttcattattgttggagcaccaactttgatgtggtacatagtaggtgctcgaaaaatatttgttaaatgtatatgtgattactgaatgtggtagagatagtacagcaggctaaagttgagcgtagaatgttgtcaaaattgggtttctcttttcgtcttaaagtatgaaagctttgactattcaatattaattatattcagtaatattcattcaatatagaatgcttttgcctgttgcatgtttcagaaagatggtatcagcagttcagataattactattatactatgataaggttagccagtcattgattggagctcaagacttaaaggaaaaatttggtttgggtcctagactaggatgaggcaaatgaagtgagggaggctcttgcctcaggcacaaaattttaaataaagacagaactagtaacaatgacaagccatataggagctcaaggcgcaaagaaaattaattctgatcccatctttatttagaattttggtattttatcataggatttttgcattaattctaattttttaaaatattgcattaaaatgcctatctgatcactgaggtttttttggtgccttctttaattttgcacccaagacaagtgtcttacttcacccttgtcccaacccttggtatgtactccgcactgcaaagtggataagaggatgatttaagccaggcaggcctggtcctagtcttactttggcacttaatagctgtgtgaccttggttgacaagttacttaacctgttttgcttccatttctttctttataaagcagagacataaataataacgcctcatgggatcattttgaggtttaattagttaatacaacaacgcctggcatagaaagtattcagtatttctctgctcttcattttcaagtcagcatagaaaaataacttatttctgttaattgtttaaaaaactagttctccaacctgggcaatgtggtgagacgccatctttacaaaatacagaaaaaaaaaaattagcgaggcatggtggtgtacacagctgtagtcccagcagacccagaggctgaggtgggaggatcacttgagccttgggaggtcaaggctgcactaagctgtgatcactccactgcactctagcctgggcgacagagtgggaccctgtctcaaaaacaaaagttctgtgggcctttctatttatatttattgtgctatggtggtcttcacttacctaaccaagtgccttgattaaatatctactcattatttggcgtgtgtaatcctttatgtttgctgaattcaatattttgagtgccagttcggcagttggctaaagagaaatatgtattctgttcattatgataattaaaaagtaaacaggaaacaaaacgtattaatatttatagttttaattttatgtgttttaaaataagttcagaatgaaagaaaaattgtctcctaacttctctttcaagattagcttggattagaattgctcatttacattacttctcccaaaagtagttatagatgtccgggactgagtgatgttgaaaattataaatgcatccagatagacctttgggaatccccaaattcatacagaaatgcttattcagactttagcactctctggaatcatatttctttagaaagttctgtgttgatatgaacttcaccacaagttaaatgccgtttctgcatttactacagttttacctgtcatttgaaaaccattttccagaaggaagactaattactatagacacataaagtatatattgtagacctttggattattagtgaattgccaaaactgtgactattaaattctagtatattcttcaaataagtagtatattatttgaatgtttagatatgttaattgaattcaaataagtagtatatcatttgaatgctgagatatgttaattgaattcaaataagtagtatattatttgaatgtttagatatgttcattgaattccttgagcttaaagtctttttataatttttacctgtttcatgggaatccttgtgttctcagatggaagcagtctttctttggaaatagaaaacctctaaagcaatagggcccaatgttgcgaggactagaagcaaatatttgttacaggatcattaagggtaatcatgagaagagccactaactttagttcctagacctgtgtattctacctataggaaaaatagcatcatatattgaaatatattgtaacctgcaaaaaacagcactccaggccaacaaagtaccattcagcaggtgccatatttgagtcttcactaggctgatccacagaggcaagctgttttggaatgatagggtacgtgagccagcgaattatctgggtgttgcactgccttgttactttgcctgtaaaattagttttctagtcagaagtgatgcagtgtgagatactatgacaggaacgaggcattctgtaaattgagatgagattttagcagaagcactgcaggcaagaaaggcaaatccatatgcagagtaaaactattgcaataagaaaaaattgctgcctgtttcatgatggaaggggtacagtcaggtggccagctgttctgggaaacatattaagacttcttgttcttctgttctgtgttcttcttctgccatatcaagactgacctgtttctgtgaggttttcagtagtggctgtagtcagatcagtcttggtgagagaaagcccgtgtcattgatcccactgagcaaagatgagagaagctacaaaaagaagctgaggccgggcacagtggctcacacctgtaatcccagcactttgggaggccaaggcgggcagatcacgaggtcaagagatcgagaccatcctggccaacatggtgaaaccccgtctctaataaatacataaattagtcaggcgtggtggtgcatgcctgtaatcccagctactcaggaggctaaggcaggagaatcacttgaacctgggaggcggaggttgcagtgagctaagatcccgccattgcactccagcctgggcaacagagcaagactccatctcaaaaaaaaaaaaaaaaaaaggaaggcttctgtacatctctacaaaaaatacaaaaattagccgggtgtggtggcaggcacctgtaaccccagctacttgggaggctgaggcaggagaatcgattgaacctgggaggtggaagttgcagtgagccaagatcacaccactgcactgtagcctggtgacagagcaagactcggtctcaaaaaaaaaaaaaaaaaaaaaaaaggctgaatggcattcacacattagctcataatcagtgcaaatccacacttctggttctgtcttctttcaggtccagtgcttgaagttcttcccaaacccactttcaggttgacccctgaatggtgtcatcatataatgcataaccatctagaaaccattgtgaatattttcctttctcagtcagctggtcataggcaactgtccatctagtcattggtatcagttgaaggagaagtgtcagtgtggtaagacaaagtgttttctgagtctgagccacttcttatacaacttgtttgtacctttaggtccttctcaagctgatctcatatatgctacttccactcaatgatggagagctgctgtgcgttcccagttgtgtggcttgatgggtcagatgatgggtcaggttatggtggtgttatttgcttaggctgtacaataatagtgataaagcattcagtctctcagatcactgtataataatagtgatcaagcattcagggaccagcaactctaaggaagtagcacaagagtgctacactctgggggaaaagaaggaagaaataaaaaggaataggtgttacctaaacaagtctggttgttttgaaatagattgagaaacaaaattaaattcagaaattagaactaagaaggcacctgtccaggcactgtggctcacgccggtaatcccagcactttgggaggccgaggcaggcggatcacgagatcaggagttcgagaccaccagggaggtggaggttgcagtgagccaagattgcgccactgcactccagcctggcgacagagccagactccatctcaaaaaaaaaaaaaaagaaggcacctgtagggataatataccttctccagccttctgttgtatatcagtagtacaaatgcaggcaaaatagtttcccaataattcccccttttcagtgttctttcctattctgactacatctaagacagaatctgcagtcattaactctccccacactcccttttagatcatgttttgcttccttagcttactgtgcctcccagcacttagtggttacagtgcttattctagaattcatatatactatagcattttttgtttcactttttattgtggaaattttcaaagtatagtataatgaatcctgtgtacctgtcactcagcttcaacaattaccagtgtgattaattctgtctctgcaattttttgacaaagacactggatcatttcttctgtagactttcccactgtatggattttgctaattgcatttccttgttttttaacatgttcctctgtcccttgtgtttcctgaaacttggtagtaagatatagagtcttaatcagattcagttcagatttttattttcttcctttctttcctttagcaggactactccataatgttctatgcaatcattagataaataagtctgattgtttctccttttgtgatattatcagatatgtgaatactgcctcaacatattaattggaggagaaaaaatttatgatctgtcattccttcatttgtttctcttagccagaatacttctataaaaagaaacttcccttcatcaatttttgtttgtttgtttgccttaagagacagtaccagtgtctgtgcgtgtagcgggggtgggtgtatttgactctttccctttaaggtacagtttataaaataaattggttcctagcatccactaaagatgatgaaatacatatttttttcattataaactcgagcatttaaacatatttgtgtttcaatccattgttgttagtgtccttatttattctcacattgttccatcttggccagtgggagcttattcaagttagctcttgagtccctttgacatgggcctaattttaattctccttgatagctccttgctttttagtacaacagcttctccaggttcatcttacacacttcctgatctggacctggaattatgcaaggagccctagaatattttagtaggaaataaaaaataccccattctttttttttttttttttttttttgagatggagtcgtgctctgccacccaggctggagtgcagcggcgtgatctcagctcactacaacctctgcttcctgggttcaagtgatgctcctgcctcagcctcccaagtagctgggactccaggtgccatcacatctggctaatttttgtatttttagtagagacgaggttttgccatattggccaggttggtctcggactcctgacctcaaatgatccgcctgccttggcctcccgaagtgctaggattacaggtgtgagccactgcacccagccaaaaataccacattctgatagccttataaccttatatactgctcaggagcttggtacgcctccacatgcctaacatctctaaagttttttgaccctcacctctgctgtctccctgcttgctactaacaataattactttctaccaaaaaaaaaaatgttcaaaaacatctaaaagtgatcaaatcagtaggtttgtttaaaggtaaaggaccagaagaagatacttacaacaatttccttaccatccccaccttccaactctatggagtcagagaggcctttgagagaagatagaaacatttgcacaaaaatatgcttggggacttgacgatgacactgttggctttttttttttcttaaagcttgcaaattacaaagggggaaagtgtaactttggagtggaaaaatctggcagataactaccttagtcagcatatcaaagttggcatcacttgtaatgggacaaattgacatttgcctcctgataggatactctgaggacacatcatttgtatagtattcctttcaaaaatgcattacctttatcatgaggaaacagtgagacaaacacaaactgaggaatattctataaaacagtgaacccccaggagtttgagaccagcctgggcaacacaggaagaccctgtatctacaaaaaataaaaattaaaaaaataaaaaataaaaaaaatcccaacaggcatagtggttgtatgcctatggtcccagtaactcgggaggctgagttgggtggatcacttgagccctggaggttgaggctgcagtgagtcatgatcatgccaccacactcctgcctgcatgaaagagcaagacctggtctcagaaaaaccaaaccccccaaaaaacaaaaagataccatgaaagttaaagggtggaggaaactgttagaattaagagactaaactgacatgatagccagataaatacaaggtatgaccctggagttagggaaataagttgctatccaggacaatactaggacaattggcaaatttaaatatgtactatatattgaataataggttatcaatattaaattccctgattttgaaaaataaattgttgttatctaagagtatatccttgttcttgagaaaaatacactgaagttttaattgctgaaaagtcatggctgttgcactgaagtatttattgctgaagaatcatgatctttggaacttactctcaatagttctgtaaaaataataagaatatatatgatatatatatatattggatgtatacatagagaaaatagtgcacatgtgattaaatgtgaacaatggatgtatctaggtaaaggatatgggatttcattgcattattgcaacttttctatagaacttaagattttttaataaataattcaatttaaaagattgtattagtccattttcacactgctataaagaactacctgaaactgagtaacttataagaaaagagatttaactgattcacagttccacatggctggggaggcctcaggaaacttacaatcatggaggaaggtgaaagggaagcaaggcatgttttatatggcagcaggagagacagcaagcaggggggatctgtcaaacacttttaagccatcagatctcatgagaactcacttactatcatgagaacagcatgagggaaactgcccccatgatccaatcacctcctaccaggttcctcccttgacatgtggggattataattcaagatgagatttgggtgaggacacagagccaaatcatattattctgtccctggccccttccaaatctcatgttctcactttcaaaacacaatcatgccttctcaacagtccctgaaagtcttaactcattccagcattaacccaaaagtccaagtccaaagtctcatctgaaacaagggaagtcccttccgcctatgagcctgtaaaatgaaaagcaagtcagttacttcctagaaacaatgaggatacaggcattgggtaaatactgttatttcaaatgggagaaattggccaaaacaaaggagctacaggtcccatacaagtccgaaacctagcagggtagccattcagtcttaaagctccaaaataatctcctttgcctccatgtcttacatccagggcacactgatccaaaaggtaggctcccaaggtcttgggcagctccacccctgtggctctacagggtacagcctctgcagctgctttcactggttggtattgagtgcctgtggcttttccaggcacatggtacaccattctggaatctagaagatggtgaccccccttctcacagctccactaggcagtgtcccagtggggactctgtgtgggggatctaacctgacatttcccttccacactgccctagcagaggttctccatgagggctctgcccctgcagcagacttctgcttggacctccaggcatttcatacatcctctgaaatctaggcggaggctcccaaacctcaactcttgccttctgtgtacctgcaggcccaacaccacatggaagccaccaaggattagggcttacactctctgaagcaacagcccaagctgtaccttgaccccttttagccacagctggagctggagtggctgggacacagggcaccaagtcccgaggctatacagagcagcagggctctgggcctggcccatgaaaccatttttccctcctaggcctctggacctgtgttgggaggggatgccatgaagatatctggaatgccctggagacattttccccattgtcttggctattaatattcagctccttgtaacttatgcaaatttctgcagctggcttgaatttcttcccagaaaatgggtttttcttttctactacatggtcaggatgtacatttttcaaacttctatgctatgcttcccttttaaacatgagctccagtttcagatcatctcttcatgaatgcatatgactgtacactttcaaaaaaagccaggttacctcttgcacactttgctgcttagaaatttcttatgccaggtaacctaaatcatctctctcaagttcatagttccacagatctctagggcagggcaaaatgctgccagtctctttgctaaagcacggcaggagtgacctttgttccagttcccagtgagttcctcatctccatctgaaaccacctcagcctggacttcactgtccatatcattgtcagcattttgttcaaatccattcaacaagtctctaggaagtttcaaattctccctcatctttctttcttctgagccctctaaactgttgcagtctctgcctgttacccagttccaaagttgtttccttattttcaggcatctttatagcagtggcccaaactcctggtaccaattttctgtattagtcctttttcacactgctataaagaactacctgagactgggtaatttataaagaaaagaaatttaattgagtcacagttccacatggctatggaggcctcaggaaccacggcagaaggcgaaggggaagcaaggcacatcttacatggcagcaggagatacagcaagtgaggggggaactgctaaacactttgaagagaactcactcactatcatgacaacagcattgcggagactgaccccatgatccaattgcgtcccaccagctccctccctcgacatgtggggattacaattcaagatgagatttgggtggggacacagagccaaaccatatcaaagattaaataattcattctcattatttttgtttttcgtagcttagttttatttttgaaaactaattgtatttaatatagcaatttatcttaatgtttaatgtttgtaaatgcattgttttactagatgttttatatatttgtacatctgaaatgctttatatatttcattccacagtttatgattcttaactcttaaaaaataaaatagctccattacatacatcattttcaaaatatcagtattattatttggcttctgtgtttcagtcactagtggcacagtacgaacatttaactcttgaaatagacaagctgtgctttagggaattactaaaagaacagaaatcagaaagatttgtcttggaatgttgtggttgtttaaaaattacacttcaagctaggtgcattggtgcacacctatagtcccagctccttggaaggctaaagcagaggctcacttgaccccaggagttcgaggccagcctaggcaatataatgagacgcccatctttaaaaatatatatattttttaaaaagttacacttctacctcaacctccttgctcccacttctctaccagccacctcacaaatatttgagggtctaagaggttagttaaaagtctttgttgtagctctgtaggatttcttatttttgagatttctagacatataaaaactcaaatttcctgtgatagatggagtttctgtggagagccataggcagttttggtagatggtgtatgtggaggagagcaatcccaacgatatgcctgggttatatcatagtggttacaggggttcaaggaccattgtctttgactccttttgtagatattagtagctggtattctggatggtagccttttataaaacatgttaggattcgaggcatactaatagtgtacatgcttttattaatagaataaatgagtggaggttggttgtttactcattcctgtagtaaaagaagttcagtggtatcaaaaccgtgcttttttgcaggttgggttgacaactgggtttttttttttcactaatgttatccatacactagtggattttgttgttgttgttgttgttgactgaagaccaaaagttttccacttaattttgttcatactcaaattagaaaatgcattgtttgtaatagcaaaaataacttttatgcccagtaatgtgaaattggttaaatcagtaatagtatgtccatgcagatatgtggtagttaactaaggtaggtttacattttctgcttagaaagtatttataagacatattattaagtcaaaacagctcactgtaaagtacttataatatctcttttttttttttttttttttttgagacagagtctcgctctgtcgcccaggctggagtgcaggggcacgatcttggctcaccgcaagctccacctcctgggttcacgccattctcctgcctcagcctcccaagtagatgggactacaggtgtctgccaccacacctggctaattttttgtatttttagtagagatggggtttcaccgtgttagccaggatggtctcaatctcctgacctcatgatccgcccgcctcggcctcccaaagtgctgggattacaggcgtgagccaccgcacttggcccaatatcccattttgattaaaaaaaaaaacaaaacagcaactatatttattttgtgaacataaatggaatacactataaagaaacctaaactgtttaacaaggcagagattgggtatgggaagtaccgggaggagtaaacttatatttccattctgtacatattttatattttttatatttttagcattttaaataccaagaatattaatatattactgtatacttatatgaattaatatcaattgcaatttaactatgtaagcattacacagaagtggatataatctaatcagcacaaatgatataatttcttctaatagctgatatgcattcaagatggttacctttccctgctgacagaaactggtgaagttcgtgaggatcttaaactgccagaaggtgaactaggcaaagaaatagagggaaaatacaatgcaggtgaagatgtacaggtaaagacttagagaaggattatttttgaaaaccattttataaaaactttgacctcaactagttaacataaaatactacatatggaatgtggtttaaaaatactgctaaaatgttgaaaatgatctctcaggcaggttttccataaaacccttagagactcattatcaaagaaagtatcaaagttcatttttgctacatcagcattactctcaaacccaaatttgttttgaagctctgcacctgactttttttttttttttgagacggagtctccctctgtcacccaggctggagtgcagtggcgtgatctcggctcattgcaacctccgcgtcccaggttcaagcgattctcccctcagcctcctgagtagctgggattgcaggcgcgtgccaccacatctggctaatttttgtatttttagtaaagattgggtttcagcatgttggccaagctggttttgaactcctgacctcaggtgatcccccaaccttggcctcccaaaagtgctgggattacaggcctgagcaaggcgcccagccctgagctattcttacaggtaagaaatgatgctagtggaatgttaaagagtgaaggagatttactgtcttcgttacaactttcagaaatgtaacgggtagtaagtgttcaaacatttatagttatttttcctgttccctggaagttgtcttacaaaccactctgagaaattctgctttagaaaactgtaaagaaagtagcttgttttggaatacccctttcagaagtccatatgtacaaaatatccacaaatatacaatatatgaggaactaattatatcttctatatgtattgtcttctgaataacgttttgcctgcttttttccttctaggtgtctgtcatgtgtgcaatgagtgaagaatatgctgtagccataaaaccctgcaaataaacggaaacatcaggcatgaacactgtttatgtctgaatcaactgcagatctaatttggttctaagttgtcaccaaagctatagccttcataagcaacctcatttctttttttaattgttttcagattgtgctgggttagttttgcaagcaattgataatttttaaaaaattatcaatatgtataattttttttgaattttgtagatatgtttcctataatattcctgtggttttcagtatgtcagtccaagaaacaaacaagatagcttcagcagatgtgatttgtctgagcaaatcattcctgtgttttagttagatgataaaccagggttttaaatcaaacaatgtagcataaagtggtattgaagtaccatatttaagttgaactgctctgcattaattacagatttaatataaaatgaactgattatatattggaattgttgcactttcagcctgtgtagggcaaacacaaatccttaaacaaaaatcatgttatcaaaaactgtcagttattttggtggccacatgcaaccatgtgattactttggtcatactatttaccaaattgttggcaaacttgatgtaaccttatatggtggttttagtcccttcttatggttggcagaagggcactgaactgttgggtgaaagttagttagcaagtaagattataaggaagacacaaaagacagtggcaaagagggttgattaaatctataagtttttatgtgaggactttgtaagtcagcataaaaatgaaaagttgtttctcagttgtttttgcttttaactttgcccccaacgtttaaagggagtgatctgctttacatgatactatgcaatgcttgttttccaactatgttgaataaatagtaatatttatcagtaaatactcctttccaacttccttttttttttttttttttttgagactgagtctcactccatcagccaggctggagtgcagtggtgcaatctcggctcactgcaacctctgcctcccgagttcaagcaattctcctgcctcagcctcccaagtagctgggactacaggtgcatgccaccacgcccagctacttttttgtgtattttagtagagatggggtttcaccatgttgtctaggctggtcttgaactcctgacctcaggtgatccacctgcctcagcctcccaaagtgctgggattacaggcatgagccaccacacccagcccctttccaaccatttctaagtagattttttgacattaatgtatttattaaacaaaaactgagaattccttaaattgatttggaatttttgttaattttatgtcctttttttcctaaagtgaattaaagtgaatcatggaagcagcattactttatatgaatattattatttaagttaagttattttaagtatatgcattttttctgattgttgtgtgacttaattcagttgctggtgtgaactataactagcaaataattctataaactgaattattttaaaaggtattttaggtgacaccactgcatttctatttcatcttttgagtcatatgtatattatttccagaattttagacattattacagggtttgtgaggacctttgactcagtgacaatcatcatattggagcaaaacatagaacaaaatcactatctcagaaataccttaattctctaagactggctcttagacctctcccatcatgccttgacctctaaaaagccctttgttcctatcttctaaaggaaagtatatcatatatgatgatgtaactgatctaatcagtgactggaaatagcattagtaacagaagatcccaagttttagttgcttaatttgtacacacttttaaatattgtcttagcctcggcaaaccaatttggggaagaagcaagatactttaagagaaatacaaaggaaatttctaaagcacaagaaatagtgaggtagtagttagtcgtctttcctacaacattttagcttttgcccatctaaagcacaattaaaattaggctacattctttccagtattctatttaagtacctactacatactgctctagtttcttagtactctgtaatgtgtatcttaattgctactggttggcattgtaactcataggaattccagaaaattattaatccgtgctgcttgcagttcattcatatggcccctcttaaccatgctggtgttatgattcagtattaactctcaattagcatgcccctgttcttcctaacttgtaaaatttcacataaatatattttcaattgtgtacaaattaagggtgtacaaattataataatgcatctctatcttcatactttgaatggcaaacgctatttatgcataaatattttcattttaagtaatatatgaagtgtaaatactcgatatataagtatagattttaaagatatgggactttattttcacataagtcaatagatgtttctctagaacaaaatatttagtaaagctttataaattatattaaaaggaagcggggaacatgtattttttaacatagaacagaagtgacttcattctttttagacatcagaaatgttaaagttgattcccaatatttgttgtacttttttgtagcaaatgttaaaaatcacgagttaccatgtatagaatgtggactgtcatgttgatatcattgtacagtgataagccatttttatctgtatacatttcaccaatttattaacaggttgaatatttgtttctttttagaacattttatttatactgtgaagactttgttataccttatttgctacaacatagatcatatcattgctactttgacttagcatttgcatcataaacataattatgatgtttttttcatgctcccttccaggggctcagtcacttgaaga

SEQ ID NO: 12834 - DNA, 6538 bp, Human
tggattttgaaaggatccctctggcaggatggagagggcaagagagacaccacgggagaggctgttggggaaatctagattggcgttgctagccacctgggccgggggtgggtggcaaagaaggtgtccaggagtggtcagattctggatctcttttgaaagtgaagccaacaggatttgctgagagactggatgtgggctgtgggagaaagagaggagtcaagcatgacctcaaggtttggggcctgagccaacagaaggatgaactcctccatcttgacttttgtctcctgagaaggggagtcattctgtgtgcttcacatgtatagaccttgtaagaaggaacttccaggcatatggcaagaacttcctaagccctggttctcgaggggctggctgggtctgcagggccagcctaggcactgtaaggtggtttgcaaaaacgcaccctggtctccacccaccacatatgctcagaagacaggaacatttgcttcaggctccacagctgacaaagcacatttgcaaacactgagcgctgtgacgcaatatctcagccctgctgagctaaaaatcctggactcattgccctcatgttgcaactgagaaaaaaggagacccagagagggccagtgactcccctgcagtcacaaagtcgatccatctgtggcagagggggaagctgcatcagggcagtttactgaagggcggaacctctcccccacctccccacactgtttctaacttctgctaagagtgcagcgggtgtgcatgggttaatccgccagccagctccccagaggccatcctggatgatgggctcagtgcacatgcctccagaggcctccaggaagggcgggaagaggaccctggccaggccgaaacagcaggccccgggggcagggagggctccacacacgtgatgcctgtgtcacatatacacatatatgtcactgtgtgccccatgcccatacatggccttgcatgggtcccctcacagccttccacatcctgcgtgcagcccagcccccacccagccccctaaaccacgcaccctgccttcctgacgcaggagcccagagaggcatttcctgtttaggggctgcctcctccccctctaagcccaggttcccagggccccaggctgagctggggtgaggggagggcagcccctggccccctcactcccccaacacccccacacgctggcccagctggaaccagaaagcttgagtatagggggagaggctgacgcaggggctcagtaaataaatgagaggctgaggatgcctgtgcctgggtgaccaagctgtttccattcaggccgaatcggaggtcttcatatgtcaggccatgtagaatgccacaccatttttgtatgtgcacctagggtctcagcatgtcagaatgtgtgtacgtgtggcaagggagtcatctgcaagccagcataggtccacggtgaggtgaagggacaaacagcttggcagagagtgcactcttgcatggggttgggggtgggggaggcgcatgcgcgcgtctgtggggcaagaaaggagtgggcatgagggtgttcccgtgcatggcgagcagctgggctgagactgctcccgggtgtgatggggctgctgtgtccagatttgggtctctgagtctctgggaagcgacctcaccccacagccccgagccccaacttgagggtcacagagctcggcaggcaggcttttcccaccccctgactctcagccccatggggcctggggcagccgtcaactgcgccttctcccctcctccgcccccaaccttagagccccccaccccactgcttcctgctctagcggcccccggggaagagggagcagggagctggcagccgccccagcccactccttacaaggcctgagcccggccccaggcccgcccccggcccgcccgcaggaggccccaggccctccccctgtcaagagctgccgccagcccggggccggaccagtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttacccaaggcttctgacccccactggtgcttaagggaggttctgggaggactcagcaaaaaggaggggatcttccttcagtttgtctgagtcctcaaagagataaggtaagatccctttaagggagggtatgcctcagagattctcagggaagcaggagcccagagagggcagagccttgcccaaggtcacacagttgagcccagcagtgggaggtttggcatggggagaatttcatatttattccttattttaccaaagctccaagaaggtggggctgaatctgggggacggttgtggaattagggcatctgctgaaccggactggggtttaggggtcaaagtaggctctggggctggtgattcagaggagtgaaggaggggtctagtgggtgagttgctcctttcttcagacacttcccttcccatccctgtaagcttcgcggaagttgggggctggggctcagggtaactcaaggggactgccaacccctggtttgtgggtgctcttggaggcattcctccgcttgctccggggaggaggctgggatgggaaaggccgggaacctgggagagatcccatgctaactgcttggacagccgcaggagcaaggcctccttttgccagggccgcacgttgctcttgtccatgttggctgggggtggtgggggacagacagagctcagcagacctgagcttgagcgagggctccggctgctcaggactgaagtgtcccaggaactggagggcctggtcaaagatcacagcctggtgggagtgacctccctcatttcgggctcactgccttggggggcgggggtgagacctggggaggggaggcgccagttcccaccgcctctgtaatttttcagttacagcctcttgggggcctctaattaggacggggcagagccgccacgaccacccgggcaggcgaggaggagtggcccagcgcccccttcgggcctggacctgagctggaaggctgagctgggccccagggaaccaggaaaggaggggccggagctggggatgaaccagggggtcgcggagggggcggagggaacgctacgcaccgcccccggtccccgctctcacgttcccctaactcaaaccagacgtccccgccagatcctgcacagctttaacctcggagacgccgtcgggcaggtttgctggatgccaatgagggttgcgaggcggcccagacggctgagtctgggaaggaggtgaggaagcctggggagcgacaaggcctgcagagacgggatggtctggagtcccctccgtgacctcgggtagggatctagagcgcctcgagggcaggaaacagttaaatacactgcagtcggaggcgggggatgggagtggggaagggggcccagagccggctctttgtcatctggtaatgagcaccagatgcggagctgcgtgcgggcctaaacagacggcctcccagggcagagccccggcctgcgcccagcccgggctcagcccacttactcgcaggccccgcctcattcgggcgcggcggcgaactgcatactccagcggtatcagcccggacctgggagctacgagccacgcctactcgctgcagaacagaagagagcccccgggagctctccagaggccccgcccacaaagccacaagccccgcccctgccaactcaaagattccagcagcgattgtgcccgccccctgccctcttggccccgcccagtcccccgcccacaacctacaagccccacctcctccgctcggcgcgcgcagattggcggaactattagtctcggcttctaggaggtatgaacttcgccccgagtttacacattctcttcacgcggcgctacaggccccgcccaacacaactgcaagcttcgcctcacagagccctggacactgcagggaatccctcagaggtcttaactctgtcgggggatgatgtaaactccgccctccagggaaacgtgtgaagttcccctcaacctcctcttcag

SEQ ID NO: 12835 - DNA, 148405 bp, Human; identical to SEQ ID NO: 11747

SEQ ID NO: 12836 - DNA, 148405 bp, Human; identical to SEQ ID NO: 11747

SEQ ID NO: 12837 - DNA, 148405 bp, Human; identical to SEQ ID NO: 11747

SEQ ID NO: 12838 - DNA, 57178 bp, Human
aaactagaacctacagaaggtggacaatgatggggatggtggaggataaatgaggaaagggaatactctaacataaggggtggatgattgtgccattccctgaagtaggaaatacagcaaactaacaagtttggaatggggagaagacaataaggatatttgggactgttgagtttgagatggctggggacccctagacaaggttttctaatagatagcgggatacaggtctggaaccttgaagagtggtatcagatgaaagtacacatttgggagtcatgttgtataaaattgttcattgttttgatgaagaacgtgatggaaagtctgcagagaagcatactgaacagaagataaagctctagggaagagtgaggtgaatagagagaaagtgagggtgctaagagcaaacagaaaatcagaagggtgtaacatagcaaaaccaagggaagataatttcagaaagaaatagacatggccagagatgagaatttttcggtaagactgaagaccatactctttgggttgctaatcaaggttgtatatgatcttaatgaagcttttttggagcggttcaagtgaaagacagattgcaataagttgggagggagaagaaggctcagaatgtagtaggtttggaatgacttggtggatgtagattaccctctcaggaagcatgggagcaaataaagagggtgatggtcccaggcacttttacatctcaaggactgctttccttgcccataaaacaaggaaaatacaggcagtacctgtttagcaatggtgtcctaaggattaaaatctattactaatgaaatatacttgtgtccttttgctgaatccaaatttattgttgttagtcgccatatgttcattttcataatgtcttaatcattaaagtcaagtgaataacaaaacatacagttaactggctctgcatttctctagctcaagttctttgactgtatatacccgagtttgaccttagaagatattaacatttcattcctttagcagttagaacaaggacagtttaagtttggtctgggattaaggcagaatttcttctctcatcctgccttccaaactgaagaaatggcctcaaatggagattctaagagaaaatgtcacttgccttatgaatcagtgtgccccactgaggatacctattatggattggtttaatatccaaaaatttcttcagatccaactcttgacatctctgtccactttttgtgttttgaagatttcaaaagactcaatgagtttatgctttatgaagtcatagagccatggatgtgatgtcacaattgtggccagctcaccaggaagcaggcagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcaggtaagagcatgggacctcatccctttccagatggcctcaaaaggagattctaagagacaatgtccaaaagaaaagctcagcggttcagacatttctaacctaaaagaagggttctgatcaccaccagaaaacaaagaaaacaaagccaaaaacagattgaggaaacagaaaatacatcatccttttagagtattatttttataaatatgcccttaatttagcctagttagtggaaatttctcaagtgtgtatgcgtctgtgtgaacattgtgtattttaaactttttggagcttagccagatacttcgaatgctaatcctggcagaatttccctttaaggatgtcctgcagagaatttgttactcatagttttaagtaaaaattgacaaatagtgctttttcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagtgagttctttcccccaaatatttcctttgttttgttttgtggtattttgacttctctaatttttttttaaggatgagaaatttttataaactttccagtaactacttaagagaaaacttttgcttggcaaaagtgtatgccttttgaagtttcttagccattttagctaaaggttatcaaattttatatgctgagcttttcagatttctcattcttataacttgcatgtggaggtaacataggggccagataactccttggaattgcctcttgagtttttctaatggtcttaatgtggggtatagctttattgttgtaaaaagaggaagaagaggagggctcttgagattttatttggcttaatttatttgaatgaataacattatcactgagcatattttatgactagatttatatttcaagagcacattttgaagtcacttacaggttttaagtaaaaggagttaatgagattcctgctattttcaagaaaaatctgcctactttccagaagtgggcatacaaaaattcataatctttaattttctaaggttaaattaaaatatctgtgtttccagcccacagaaatatataatagactatatcaatctaaagtgctacttcttgaaacagaggtagtgttattcaggcaaaaagcatacatcccatatgtgttaatgctttctctctcactattttagtcatatcctctttggtacctatcattcatttgaaaaccaaatgcagctcctcagctgtcatttcagactttagaaaattggaaactaaaaagaattattaacaaaatgcatagctctcatacataaaatgtaaggaaatccttgagccattttagccctcattttatatccacaataccatcatgtgtaaatactagcatttttattagcaaagcatatggattaaaatttaacataggtattgcaaacatatgtatcatacaagatatttcttaacatatgtgttatgatatatgctttaagccataatccaaattgctttaaggggaaggtaaactctagtgtctgttttctacacttgttctatttattctcacattattattagttgccaaatctgggactgttctacctaagcaagagtagtagatttgtgttttaatataacaccacctcactgacaaatttacctcttatttttattacacttaccaacattttgagtaaagctgaattaatctgtgtttcttacataagactgggtacttttctactataatattacaaataagagtttagaaaatttagagatttagagaatatttagagacagatatttaatttgtctgtttttattttttcaatcgagggaacatgatctctttagaaatgaaagctgaatacttgggttcgcatgggaagctctgaatcagatattagttaaaccagcttgcatttccttgttcttgtaattatctttttcctctccaattaccataatttttcttggttactttttggtaccctgaaagctcattgaaggagaggaagagaagaaagaggtagaggaagaggaggagaaggaggactcctttttgcccaacatgcctcaaatccctgcaaaataatcagcttgaggccaggcacggtggctcacttctgtaatcctagctttgggaggccaaggtcgtggggatcacttgagcccagggttcaagaccagctggggcaatatagggagactctatttaaaataaaaataaataatcagcttattgatgacataccctagtattttatatgaactagtaaaacattcttatgggtttgggtttaccttatcctcaccatatgtctaaactttcacatgggctaattaccctgattagaacatactaggatatgtcaacagcaaggtttacattcattaaataaataaagctagagagtctctttgaaaacaatagtgtgatgtggagaacagagtcaaggttttgaagtgtcattcatactgagttttctatgaatgagggcaagtgagtttgcctccctaccttaaagatataattaaaacagctgtgttatagaattttatattagaataataataacagtagtcatttttattttttgtcttctcaaattcttcggttatacttccagcaccaatggaccttaaatttatctcacttgatttttagcaaagctttgagcgattcctttgcatattcattttgccaaaggaatactcaccaaatggatcctgagtagattattttgatatattcaggttgtctcctcccatttaaaaatatacctttttgtatttttccaatatcattgcaattataatgctctaaagatggtggtgtggaagtggagtggagaaatatgcttcttgggcttgttctccagcttgattttgtttaactatctcttacaattattcataaaacaatttaagtaacatgtcataagtcacatgacttctaagatttttttcttcttaaattttttcttttttgcttttattagtattactatagacatgtaactgtacatatccatcaggtacaatgtgatatttgtatacatgtatacgacaaattatcaaatcagggtaaatagcatatttattaccttatttttcatttctttgtgttgggaacatttacaatccactcttctagctatttgaaaatatacaataaattgctaattatagttaccctatagtgctatagaacactcaaacttattcctcctatctagctgtattttgtatttcttaacctacctttggctatctctttcttccccctacccttttctgcttccagtaagcactattctgctctctccttctatgagattgacttttttagcttcttcatattcatgaggacatgcagtatttatctttctgtgtctagcttatttcacttaaaataatgtcctccaagctcattcatgttgccgtgaatgacagaaatttgttcttttttacaactaaataatacttcattgggatatatagcactttttttaatccattcgcctattgatggaaacttaggtaatttcatatcttggctatgtgttgtgagtagtgctgcaataaacatgggaatacagatatctctttaacatactgatttcctttcctttggatatatacccagtagtgggattgttggatcatacggtagttctatttttaattttttgaggaaccttcaaactgttttccataatgggcatatatatgcatatattccaaataacatataagagtttgtgtttcaccaaatccttgtcagcattttttttttgtctccttggtaatagccattctaactggggtgagattatatcttcttgcggttttgatttgcattaccctgatgattaatgacattgaccattttttgtacctacctgttggccatttgtatgtcttctttagagagatgtctattcagcttatttgtctgctttctaatgtgattttttatttgctattgagctcattttatattatgaatattaaactcttgtcagatgaatagtttgcaaatactttctcctgtcctgcaggttgtcttttttctctgttgactgtttcctttgctgtgcagaagctttttagtttgacataatttcatttgtctatttttgctttggttgtctgtgctattgaggtcttatccatgaaatttttgctcacaccaataccctgaagtatttcccctatgtttgcttctagttgcttcatagattcaggtcttatatttaagtttttaatccattttgagttgatttttacatgttatgtgaggtagaaatacagtttcatttttctgcatatgaatattcagttttcccagcatcatttttcaaagagactgttccttccccattaaatgttcttggcagctttgttgaaaatcatttggctgtaaatatgtgaatttatttctgggttctctattatgctccattgttctatgtctctattcatatgccaatatcatgctatccgggttactatagttttgaaatatattttgaagttcaaaatgtgatttctccggctttgttcattttgctcaggattgctttggctattcagggtcttttgtggtttcatataaattgtaggagtttttttctgtttctgtgaagaacatcactggtattttgataacattgcattgaattggtagatcacttttagtagtattgtattaatttttacaatattaatgtctacaattcatgaacatgagatatctttccattttttgtgtcttcttcaattttttttatcagtgttttgcagtttttattgtagagatctttcacctccttggttaaatatattcctacatggctttttttgtagctattataaatgcaatttgtttcttgatttttttccactagtttgtttttggtgtatagaaaagctactggtttttgtattctttttttttttttttttgtatcctccaactttactgaatctgtttatcagttctgagatttttggtggagcttttatgattttctatatagaagctcttgttatttgcaaatgaggacaatttgacctccttttcaatttagatgctccttatctctttctctagcctaagtgctctgcctagggcttccagtactcttttgaataaaagtgagatgattgtcttccaaatcttagaagaaaagctttaaacttttctccattcagtgtgatattggctgtgggtttgtcatacatggctttaattatgtggaagtacattccttctatacctaacttgttgagaatttttatcatgaggggatgttgaatttttctcaaatacattttctctatctcttgagatgatcaaattgtttttgcccttcattttgttgatgtaatgtatcacatttattcatttgtatattacatccctgaggtaaatcttacctacatggtgaataatctctttaatgtgctgccagattggttcacaagtattttgttgaggatttttgcatctatgctcatcatgttcattggcttatagttttctttttttgttgttgcatccttgactagttttggtatcaaggtaacactggcctcatagaatgagttttaaagaattcccttatcttcaatttctggaagaatttgaggagaatttgtattagttcttctataaatctttggtagaattccagagtgaagctgtcatattctgagcttctttttgataagagactttttattacagacttaatgccattacttgtaattggtctgttcaggtgttctctttcttgttggttcacttctgatagattgtttgtgtccaggaatttacctatttctgtcaggtcttctaaagtttttggtatatagctgtttataatagtctctgataattttttgtatttctatggtattagttgtaatgtctccttttcattcctgattttattgggacctttacgtttttcttgggtagtcaagccaatggaatgttgattttgtttatcttttcaaaaaaattcagctttccattttgttgatattttgtattttttagtcttaattttatttatgtatgcttttctttctttccttctaattttgggcttggtttactctgcttttctagtttcttgaagtgcatcatgagcttgtttatttgatatctttctacttttttgatataggtgtttgttgctgcacacttaccttctaatactgcttttgctataccccagatgttttggtattttgtgtttctattttcatttgtttgaagatattttaaaatcttcctcttaatttcttcattgactaatttgttattcaggaacatgttgtataatttctatgtatttgtacaatttttaaagttcctcgttattttgatttctagttttattatattgtggtcaaaaattgatatgatttctattaaatttgttaagatttgttttgtggtctaacgtggtctatgctaaagaatgtttcattttctaatgaaaagaatatgtattttgcagctgttgaatgaaatgttctgtaaatgtctggtaggttcatttggtctaaagtgcagtttaaattaaatgtttctttgttaattttctgcctgaatgatctgtccaatgctgaggggtgttgaagtccccagctataattgtactgaaatctatttctcctttgggtttaattatttgctttataaatctggatgttgtggtattggatgtgtgtatgtttacaattgttacatcttcttgctgaagtgaaaataaccttgtctctttttgtttaaagtctgctttacctgatataagtatagctattctcccttgcttttggtttccatttgtatggattttttttccatcccttatttttattctatatgtgtctttttaggtgaagtgagtttcttttaggcagcatatacttaggtcttttttttttttaattcattcagctagtctatatcttttcagttgggaatttagtctgtttacagccaaggttattattgataagtgaggacttaacatccaccattttgttgttttcctgttgtcttgtatatcttttgttcctttctttttctcttatagttaatcattgtggtttggtggttttctgtagtgacaaggtttgattcttttctctttctcctcatatatctgctctaccaatgagctttatacttttggtgtgttttcatgacagtgattttcacttccagatgtaagtgaaaatcacttaagcatttctggtaaggccaggtgagtggtgacaaattccttcagtttttgcttacctcgagaaggctttatttcttcctaatttctgaaggataactttgctgggtatagtattcttagctagcaattttttttcttctttcaccattttgagtttataactctattctctcctcgcctgtgaggtttctgtagcaaaatttactagtctaatgcagttctcttatgtgacttgacaattttctcttgctgtttttagaactctctgtctttgacttgtgacaatttgcctataatgtacctctaagaggacctttttggggttgaatctatttggggaattttgagtttcctggagctggatgttcaaatatccctcctccacaacccccaccactaaattgggaagttttcagttattattttattaaacaggctttctatactttttccttatcttctccttctggaaattccataatacaaatatctgtttgtttaatgttttccaataagtcttataggaattcttcactcattttcattcttatttcttttttcttttctctgactgggtaacttcaaaagacctagctttaagttcagagattcttttttctgcttgatcaagtctgctgctgaagctctctattgtattttatattttattcattgaattcttcaactgcaggattcttgttttgttctttttatgatttttatctctttattgaatttttcatttatattgtgaatttttttcttattttatttaattgtgtatctgtgtttccttgtatctaattgagtttccttacaatcattattttacatttttttggcaattaattgatttccttttaattggagtctgttactagagagttattatattcctttgttggtctcttatttccttgctttttcatgtttcttgtgtccctgcattgatgtctgtgtatctagtgaaataatcacctttttcaaactttctggagtgattttcataaagaaagtctttcatcctgcagttgagttttactgtgcagttagaaaaggtgtagtgactctgtttccagataggtatagagatagagtctctgtgcagcttcttcagttgtattcaaggtcaggaataactgtgggtgcctcatagcctacgcttagaggtttgtggcaatggcactggcaacataagtttttaatgttctttgtgttaagggcttctggggtcctcctattctggttttctctaaaataaggagacttagctgagcgcatcccttttggtgtcaagtctgacatggcctacaagcagctgcagtggcatgggttctacgtgcagtgatcaggattctacatgcagtaggagttttcagctcagtatctcataaagctattgaggcaactgggcttggggtgcagcttcaccccttgtggcagggttggatgtaggttacccatagagccaggatctatgattctgagggaccccctagcagctcaggctcagggtgccaggttgtagctgtgattctacccctggggggcagggcacagcactggcctgactccagggaataaggagtgctctggaactttggccttgggagcagggtatggctgcaattcagaaacctgagtcaatagggctcagtgtcaactcaggttccaagggatgaggcactgggtagtagtgattgtagaccctgggatagtggtgctcagcagtatcccagaatgtgtggggccaagtgtatttgctttcagtactccagaatggtggaggacagctgttgtttgttccctgggtgacaggtgggtaggaaaaaacacagcaatgactccactccctagatagaggggtacttctgcatctgagactctagagagctaggccagtgctggggaatcgaagtctaaaattgttcagtttatagagcaaggtgtctcagctcagtttctgctcagctcagccagagcactaattccccaagggacaatgtgccacttcagctcaggcttgaaggatgtgactgttctgggctgcacaagcactgttttcttgggatgcggggcatcagttcagcttaagtaatggagtgcatgactgctctggatggccaaggcacaatttcctaggatgcagggcaccacttcaacttagacaccagggagacatgactgctctgaatagccaaggtactgttttcccaagagacaggatgctgcttcagcaggggcagggggaggagttggtagagcaattccacctccacttgaccccacaggaaaaagtgttaacagctgttaacagcacatattggggatgtggggctctggggatggggtggttcaggggtggtttagtctcagggatgaaggggagccatgactacttactccttgagtaaggctcagtctagctgtagttcctgttccaagatgccatagccaatagtcacatgggccacagcaggtggggcacagtgtcaactccttctctggctaagcacagctatatagactccaggcagcttcaccatgtgggcttggtgcctaagaagactgcagagaacaccagtgggaaggtctgttggtgtccagggtgttgatggagattgttggagtcatcctgcttacctcctcaccataagaagttcctcctggcttccagctgatcccacttgggggatgggatggtgaaggcctggcatttccttattctctatgtagccatcctgagtttttgtgctcacccaagtttctattagttttaaaatgcagctgcttttccattgttctggctgtctttgacagaggcataagcactaggggcttctagttggctatcttgctgctatctctctgacctttaatacttttagaaagaagattaaccgttctcctgatcaaggtatcaaactatttattatctttgacagtaccaaaaagtcatacatacatgtaattcattcattcatattttcattcatttattgatcagttagatcaagccaatataaacctactgaaaaagtcaaggtgttcaattttctttatatcatgaaactctctattgtgctaatgaacactaaagaggctcctattgacaaggaactgtctatcatcaattttgaccaaatgcctcttagtatagaattaaaatgcttccaattttctttaagcttttttgtcacataaagatcaacacttccttagattcatgggtataatttgcatttgaaaaaaatccgacaccaagctgtcatgctatctaaattaagatttcatttataaaaatgatttctagtcttgtaattacattcagtctattcatttgttcccttgaacattttgatagtcacactatcacaaaatattctaattttttttttttttttttttttttgagacggaggcccaggctggagtgcagtggcgcaatctcggctcactgcaagctccacctcccgggttcacgccattctcctgcctcagcctccctagtagctgggactacaggtgcccgccaacacgcccagctaactttttgtatttttagtagagacggggtttcaccatgttagccaagttggtctcgatctcctgacctcatgatccgcccacatcagcctcccagagtgttgggattacaggcatgaaccaccgcgtctggcccaaaatattctaatttttgacctataattgttttttaaattaaacaattatactcccatttttttcaatatttttcttatgtttccttattaccaaagtgatagattacagtatacaatttgaaaggtactgaaaagtaaaattttaaatactccttaacttcaattaagagccttaacatttcagcatattttcttctaaacttgtttctacttaaaaaaaaaattatataattgaggtcatactgattattctatttcacactttttttcccacttagagaattataagcatttcaccatgccattaaatactcttccgaataccatgttaatgacttctagtattatttttaaaaccatttagtaaatatatattctttaaagtagtgtacagaaagttcttttcaaatcctaattaaacttaagcatactttaacaaacacccagcaaaatacaattaaaagcagaaaatgtacttttaaacttgagattagggatcagcaaaatgttttctacaaagagccagataatactttagtcttcaaaattactcagctctactgttgtacctggaaataagccatagatagtatgataatgaatgagtgtggctgtgttccaataaaactttacttatgaacaccaatatttaaatttcatatgtcaaaaatattcctcttttggtatttatcatttaaaaatgtaaaagcgatgcttaggtttcagaccatacaaaaacaggcagtggctagatttggcccttgagctacatatagtggcagatctctactgtagagcctgattccaagaaccctgccttcccagggtttgagaaatttctgtgaacatatgcattcatatatatttttaagaagaggtaaatagcttttattatatgctaaatagttattaaatataaaatggttaagagtcactattccaaataatatatataaagtcactttataaaccataatttcttattaaaatatatactggtacttcacttataatattcttcacttagataccaaatgatctgaaaaagattgattagtagaaataaatttatgttattatcagaattccacctgggaaaataatatccagaatccaaaaagctaataaactttaaagagaaaataggtgacaagttaaattttcgaaaacacttaaaataacaagtaatggttatttcagtgaaggtagttggcatatttattgcttttgattttttaggtgagccaagagattattttcatttaaactataataactagcatcatcagagaataggtcctgctgcctaatttaacatccggttaacaaaagttaatatatgtatgtctctctcattcctctcctctccccgtctctcaatacacatacacatacatacaacaaacagaccaagaataaaactagctttattgtaacatttgtttagattggaaagttccacttaatcatgtatatctcctttcagaattctaaagcaaatgagaaatagatacataaatcacgtatggatcaatttattatcaacctcattattgttaatgcgggagtagaaaacaaaacgtgcatgagagaccaagcccttcccttcccagcctgaactgagcttcttcccagaaggagtagagagcctggatcttacagtgctccctcatgagctgggactgagcagttggagtgaactcactgcagagagggaacacaggcccatgctttggcaacttccaatggagtaagggaaacaatgtggctccacatgaagtgccttttgcccagttacttaccagttaagtcactcctcaagtggcatagaatgagtgaatactttcaaaagagagaaactcctttaaagggcaagcacagaaaccagggggaatgagaagttctctcttacgatctttaactcaaaaaaaaattcttgatctgttttaaatttaggatgtcagtgaaaattgttgaaataccaagagagacttttagttaacagaatacgtcatagatctaccttttcagtatggtgtttagttggccaaaaagaaaacagtgggccaaataaatccatagcaatgtgtagttaagtttttaaagctctgacatgtaaaaagaactagttttatatgtgacctttttgttatccaagtatggataccaccctccagttctagtggtgcttgtgagcttgcagaccactcccctgctcatgctaagtcactacctccacaactgtgtggacggccctcagcttaggaacctccacctactttgtcttcgagactaccttttattcaaccttcaaggcacagctctaaaagaagctttacctgaagttttccagaaacttcctaaaatacccagagtagcctgtgcataccttcacacttttccacaggacctctctcattcttctctcactctcttccatctgcaaatatttactgagccttcagcgtatgctggtaataaactagacaccaggagtctgctggcaaacatagtatcttccctgtcttttctgttgatcaggaaacacaattagccagagataaagcatactgtgggtggtaaagtaccaagaaccacacgaacatgcagccaggtccttatcttgcagaagagtgacggagtgaagagaatatttgaatgtccctctcccaggctaccacgtaagcttttcataggtaaagacctttactttactgccaagcaccatggatggcccagagttggccctcaagagctttttatgaaacctacagaactaaagtgtatatattcagggagctgtttgataacatatatattcagggagctgtttaaagtgaaaaagacagacaggattctagaaccaaacatctgacttcttcctttctgcattcattcagcatgtatttgtgccaggctgtcttgtaggtgccacggacacaaccctaaacaggacaagaaaggtctctgctctgtgtgatgcattggcatgccttaagaattcacatattaagtgatgtttagaatgaagattaacactaaattgtaaccatatttagctactaatactgtgaacactttggtttccaagggaatggtaacagattttccccatttccttatatacagaattagcataaaaacctgagatcaacatgttgtgtttccaaagcctcaaacatacaactgctgagtgaaagctccaagtattttggctatgatcattttcctttgatggatgctgagaatcaactttgcctaaatttctgagagggaaaacagataaaaattaaattaaattaaattaaagctggctttaaatatcaaatggccaactcccaccaccaacatcatcaacaaattttaaactgtcaaaagaatagcttgtaattattgattagtgttatcaccaaagcacaggatacagctttgccttgtaccttttaaaatcacattctggcaagaggcagattattttgcttcaggtatagatactggaaaaactagttaacatcaatctccaccattcaaccccaactcaaacacccccccaacacacatacacacagtacacattctcacaaatacatacacacagacacacacatcccacacaacacacattctcacaaatacacacccatacaccacacatgtacacacatcactaacctcattttatcagatgagaatgcagaaaataaagccaaatatgattttgggcttatctttccaactttcacagtaatccaatagtaacttgagttgccccaaatgttacaggggatttgtacttccttttgaagatagctatttcattttgtacagctagaagcagcttggttttaggcatggaatgaacctctctgctcatgcttatgaagctgttacttggtcaacaattaaaacttagaaggatagatgcaaataaggagagaaagttttcatctttttctatgttttgaaaaattacagcctaactaaagctgtcattttaaacaagctttttacctttttaccaacttctacgtggaaaacaaaacaaatggcttctgtgagaagcctggaaacctgaattctggttgaggcttttttactagtttgtcagcttcttctttcaaaaaaaaaaaaaaaaagtcagttcgcctctctgaactcagtttttgtcatttgttagattagaattataaatgaaactagagaatttcaaaaatccctcccagcttttagatttggtggttctgtgaaaatggacttggatcagaagtgtaggaagtataacaaaatgactgcagcattaagaggctttatctctaaatatcttacaccatactaatgagagatttcttttttctgagttttcctacaattctcctctctgctcttcccctcctttcctctttctccttctcattattcttattccaatgattgagatttgatttatagtaaactattacagaaaagactcactgattgcacaattaatttactgcaaagtagaagttaattttttttcttcttaagaaaacaaggtcataaagagcaaagctgagagacaaattgtacaaaataaccaaaacgagaaatgtaagttgtctttaaatgagtcactaaactggcatctaattttggctgatcttctcttttacttctgttaacaacgtggtcctaaataagtcaatcattgcaaactggcaatctagtctaaaaagaagcttgttaaaattgatttggcaccacgcacagtggctcacgcctgtaatcccagcactttgggaggtcgaggtgggagaatcacttgaggtcaggagttcgagactaccctggccaacgtgtcgaaaccccatctctacaaaaaatacaaaaataagccaggtatagtggcatgcgcctgtagtcccagctactccggaggctgagacacaagaatcgcttgaacctgggaggcggaagctgcagtgagccgagattgtgccactgcacttcagcctcagccacagagtgagaccctgtctcaaaaaaaaataaataaataaaaataaaataaaaattgatttggattagttatgtgggtattttctactaagtatttgcgaaatttcattttgtagatgtatttcattttttctaatttttctgaaaagagagactggctgtattagtactttctttggagcttagttttcaaatctgtaaaatgaggacttgaaactaaccttttcttctagttcttgaattctatgataaagaacgggagactcaagtggaataagttcagtcttcttatgaagattttaattaatatttgaaataggcaactcattcatttggtacaaaattccaaaggtacaaattctgcatcatgaaaaaatgaattttgctaccttccttaattgtctctttatcatactgtttcatacagtttcttcaagaatgtctcttggtatttttacttttgatgtcagttgataggaaggcacgtttgattttgatcagtaccaaatgttacagtaccattataacaaattatatatacaacaaatttaataaaatatttttgtatatgctagctatcattatttcctatacattgtgtcaataatgttggcatttgtataattcacaatagttttaaagacatttcaatatgtactatactattgtattagatagtacaacagatagtacatattgctctaaggtaccatgtatggatataatttccaacatacgaacttgcaaggtagattataaatgtcatgattttgccatgtaccatgtgtgtattttgatattgtcataatgcctaatacaatgctaataatggagtggttttataaactgttactgtgacctatgcccaaaaagtcatgaaaattgtcaactggtagttaagaattgggaggtaaatttgaaacttcatgtatatgacaagggatacattatgctttatgacaaactcttagtgacaggctgctgggctctacagaagtgtctggggttgaggtctccccaggtctgtaaaaggacagataggactcctgttatcaaagtctagcccttccctccccagccttctgcagactcagtaagagtctaaagtctgtagggaccactatttctgaaaaaggaataaaaaggtttaaagagacatccaccagtaaaactgctggtagacttgcaaagagataggatacttgtatccttcaacttggcccaccagttcaaaggaaaagaaaccgaatatatctggagacttctccctgtaaatcaaagaaaggatgcttaccacacccttacctagactgcttgtagttactatggaatcataatgatgtctcccaaaagaaagttctacctcgtgctgcagcatgttttcttggccttgagccatcatcactttcaattaagtagaaatcctttacaagttgtcatcagttttatccaagacctttttagagatcacccagtatacaatggctattgcttggctctaattgaagtatagaaatgagtaagatataatggttgctctcaatgagtttacaattcagttagaagggatacaacaagctccataacatttatatgagaaggtagaatataaaaagtatctaatagaaacacaaagggctttcattaaacatatcataataatacaacttataaatgtgcccttatggacctcagaattgaaaaaggtttaagccagaagtagaacagaacatgttgacaggctgttctttaaaaagacccagaaatgaactctccttttatcactatgttttatgcattttaaggaggtcataaaccaacagaatctataatacacattaatgccaggataaatgaaagccaatatattatatggttagtcttggcataatctcagaaaagaattatgtgattgattttgaaatcttatttattgctcttagttgaatagctgaaagttcttcctaactaatttgtttaactggagttgctatttaggtaaatcatagattttttaaaactgctttataggctctattagataaagaatatataaccacatctatcattttgtattggccaccttccaaataaagtacactcttcattttactggacagcttccaatactatccatgtactactagaagagaaactgtttattgcttatatttgaaaacatatttgttttaaagaaaatcatagaaaataatttcttgattctcccatattttagggagtataaatttttcaacattatatagggtcaagatgaactgactagctgtggtgactggagcactctgcagagttcctctaaattcctggatccagggttattaactgaactttccctgaagccattgaattaaattcaatatatttgtcctccatttaaggtgacttaattgaataaggatttatttttctcatcactcattattgacagaaattaaaatttgtaacatctaggaaaataaaatagccatcttggcttcatagtaaccaatttacaatcttttcataaatcatgatactaaacacatgaatggaaaatgaaagacacaaaagccattgttttttctttctgataaaacacacacttccagaccatggcaaaatgtttatgttatcttatgccacctaaatacctggccctgtgggagttattcagctgatcaatgtgtgttacagatggggcctgtgttacaggtttcatccttcctcaggagacttagtttctgcaatggcagattatacttcttactagataagcttgcacttgccatttcatgcaacaggaagaacttccccatcaaatggcaagtgaaagctggtagaaacggtgttaagtaggtgaatcaatgaggggcctctctgcactgctgaaaacagctaccagaattcagaggataatgaaggtgatctccaaatagaaaagcaaatgaaagtaaaacattttttaaaaaccctggcacaattaatagtcttaaaaaaatgttatagaatacttgttgaattttccaaggagcatgaagaggtggaggggaatacttgctgatttatattagatctatagcatccatctacagactcaatctccaggaaacagtgttgatttgaggattcatatacaagaaacaccctgccccaaccatgtgctgagcctatgctaaatacttttagataaattgtatttttagtcttgtccttacctatactaaaccttgtcactaaatcagatcctcaaacaagcctttgaggagaccctgaggcaacccagcaactatattggctcttccagaacatctttaaaatgaataacagagcaggtttgaagggagtagaagggcagacttatatctgctgaaatgattgcggtttctttggaattaacattgcagaagcaagactaatggtagatttaaaagcagaaggttgggctctggttagacagagtcctagataatccaattttatcttcaaaggcaatactctcatggtcttgaaaattttcttatatcccagtgagaaaaaaaaaggatgatattaaacctacgtattttttaaaagcccttcttttttatttcttaaagaatgtttgataaaatattgttatatgctattatatactgtattttacttctatttcagtaatagctgccataattacatgattctaaatgtaaactctccaagaaaaccatatgaagcacttttttttttcttcgttagtgtccagagaagaaattagccaaatggaaagctctagtcagctgttttgtttcatgggagagtagttcatcagctctctggagaatttgtgttcaacctttccacacaagacattcagcttccaacaaactgtgcttgcaaatatgtccctagagactaatatcaaacattccaccacaattctatgatgcttgttttaggttatttttgattgatggcctgaagttatggcttaagttatttttaagattgtttgttgagttttttttaagtagcatttgggagggggaatggaaagagcctccttcttcaaaatgcaaattacagttataatttaattgcacattttccatcaagccaagtacacctacaactgacttacccatgacttttccattcttacatctcacttgatccttgagtgggatcataagcaattaatataattctcatttcagaggtaaagaaagggccagaaaagttacatggctttcataactgtggacaaactatacgctagggctaaaacaaccagcacgagaatctgtagcttttgatttttaacccaatgctcttcttggtatttatgtctttggtttcaagcaaaaaacaaataaggaagtacacacagatctgttcaacttgaccctcagaaccaagtggaaaaaaagaaaatgaaattctaaaagtagagcctatttactaattattctaactttttcgtagttttaaaatacgtgaattttaaatttttctactgtagaatgtgcatgtatcccatctggcctagtttacagactaataataaatgtggaggatttaattttctcatataactaatttaactcccctaaattttgtcaaattcagccactcattgcaccaacatttcagttaacatcatagatatcaatggacaatgacttcgcagtcctgtcacgatacggtagcctccaaagttttatgcatagaccagaaaggctcatgcagctcccaacagagaactgaagtatctgatcgaacagtttaaactgttagtggaagctcattggtgcccgaagtttagagaaaagccctttaatcttgtcaacagattaaccacctacttttgctgtttctttgatatcttccttggctgatattcaaagggcaattgaatatcaaaggctgccttcttcagtcaccctcacagaaaaagtaaaaaactctccctgccatggcaggaccttagggctttaacttttattccctagctgttatgctccgtcctttgacatatttgctatacgtgtaacagatatgaattaattcaccattcaagtaaatacataacatgcaaattcttaactgttttatattcaagtttttatcctttattctattcatagaattcttttcgtatatgtgttttcattagtgcttgttttggattccaagttcttaaagaacaagaagtttctatttgttcaattattcagtcctaaaacatttactgagatcatgctacgcctcctgagatacagagataaagtaagcagcatccttagccttgaggagctaatagtggtgtgagaaagacatacataggacaaaacaactgttacaaaatgtggcaaaagaaagacagacataaatatgaactaatgagaacaaccactctgccctgaaatatatgaaaatgctacagagagaaggatttttcactggaccttgaccgatgaggataatcatcaggttggatggatgaggtagatggggagcaaagagaagtacattagaaatagaagaggagtcatgtgtgacaactgaaacgcataatggaacagagtgtatttgaggaatagggagacactggaagtggctgaagcacaggtgggatatgtgtgtgtgtgtgtgtgtgtgtgtttgtgtgtgtgtgtgtgtgtgtgtgtgttggaaagtctggggtggggaaagggctggagatagtgagacaagtagaaatgagaagataatcaaagatctctatgctaagtagttgagtttagattttatagtcgaagaagagctgttggaagtttttcaccagagaaagatgatcagatgaggctgagtgagatttttatcaagcatcatggaggatgttctggaattctccaggaaaattgaatttatcattagagaacaaagtcatgtagtagacatgtgcttagttcctctaaataaagaaatatgtaatattttcagttcaatgtaagccaatatggtccaccagatatgtgaggaaagcctaattaaactaatatttaaataatgcttctaaggtagaattaataggatgtggtaacccataaatgtgtggggagtgtagggaggaaaagagaatgaaacatttgccttaggagactaggtgtattgtctaactatgcactgcagatgttttcagcaaccctttgtagagaatagagcagtataccttgctcagtcaggcttcgaaaatcctactgactgtccatcagtcaccttttgcccttaagagcaatgattcaaattaaaaccctgaacaagaaaatgaccacaggtaaatccagttaattgtagattaaacctagattcttcatccagtttctgtctctattcaagttttgtatgtcaatcacacaagtttcaaagacttcaacagtttgcattaggtcttcccaagagcattttaatattctttacaccatttaaatttaaattcttccaagtacttccctaaagaaaaaagaaaaaatctactttacagaatcaaataaagacctgaataggcaattgggatagccatgcggcaatcccagctgagcatagatatatttatacaggtaaaactactttgaataaccagatgaaaattaaaccagaaagcccagcagactttacattaaagggcagtgcacttttgcttatatgcaaaagtaataattatggtgctatttgcatttatttagtaaaatttacagatcatatattagagaaaaaagtaatcttaaaaaaaaaccctactctatatcctgtattttaagacacatatcaatgtgattattttatatggtgttacctatctccatggggaacaaaaagctgcaatcaaatcaatgcagtaacttataattggtatttagaataagaatatatggtaattcacctccctgaaattatagcacaaaagtaaaattcctcaaaaacacatgaacagagagtcattattggaaaccagaagaccgtaattatatcctagtgcacttcaactttaccataagaaagtaaaagccctctttaaaaacatgtaatctatagcaggaaagtaataagacacatataagtagcgtatttatttgcacaatgctgtgttaactgaaacttgtgcatattgtaaacatattcttgccttgcacagttccatggtagctgagtattgagaacgggaagagaaacgagaggggagagggaagaaaggaaaaaaaagaaataacttcattgtcttcctcttccctctgttgcatctacaatggtcttcctcacaattcactcatctgctcaattcacaagcatcccagctcttcgtgagcacaacttccatgaccactatgagcacacaaagccctttcttgttttattaaaaataatccaaatggatgtagaaatataaaggctggtttaatacatactattacttattcatgatccacttgttttttaaaaaacattgaatctgtgagaggacttcaaatagttcatggaaaatacacattatttaaaaactaagcatgtgtttaaaaattttttacactgaaataaactcatactaatttgttataacatgtctgaaaaggatctagtttgaggcaacaagaaggataagacatcagtttgaggagtctctatcagagcaacataaattcttctaaaattgaagcatgagcaaacatcaaatttacagtgaagcttgggaggaagaaaggtgaactaatttatactttatgtaaagataatagggacaatgccccaaagaaattagcagtttacaaatggataacttgtctcaagaagggatgagatgatgttaaaatgaagcctgcagcagcaaaccattcacataaatttgcaaggaaaaaattaatcctttgtgccctaattggagaggactgacaattgacagcagaaacaatagccaacaccatagacatctcaattggttcagcttacacaattctgactaaaaaaaaataagatgagcaaacttaacacttgtgtgccaaaacgattgcacagatcagctgcagacaagagtagagctttcaatggaaattttagacaagtgagatcaagatcttgaagcatttatttgaagaactgtgataagagatgaaacacggctttgccagtccgatcctgaagacaaagcacaatcaaaggaatggcctccaagagacggaagtggtccagtcaaagccaaaggagaacattcaagagcaaaggtcatggcaacagctttttgggatgctcagggcattttgcttgttgactttctggagggccaaagaacaataacatctgtttattatcagagtgtttggagaaagttagccaaagctttagctgaaaaacgcacaagaaatcttcaccagagagttcttcacaatgcccctgctcatttctctcatcaaacaagagcaattttgtgagaatttctatggaaaattattaggcaaccattttatggtcccgacttggttccttctgacttccttttgtttcctaatcttaaaaaagtccttaaagggcacctatttttcttcagttacttatgtaaaaagactacatttacatggttaaattcccaggatcctcagttctttaggaatggattatatggctgatatcatcacttacaaaagtgtcaaacttgatggagcttatgttgagaaataaatttatatttttaatttttatctcttaattccacttctattaactttttgaagtctccttatatagaaaagagtattcataacatatacacaaactgtaagaaataacaaattggcttaacaaagaaaacatcccctttatatttgaaacccgttgtgcaacatcccaatttattttaataactatgaaaattagataatcttatattgcatcctgaattttttgttaatcatcactatgctttttaaaaataaaagcacatattcataattcctaataataaactttggctgttctaaactttatataaatgtcattctggtatatttactctctacaacttgcttgtttactcaatattgtaaagttcttctgcattaaggagggtacctgtaagtcatctgtttttgtggccatatgacaatatgttgtgtgaccacacatctacttatttatccatttttcccttgatggacattcagacttttttgctatggctagtataaactccgtggctgtgagcattgttccacatcatcgctgaaagtttctctcaaatttacacacttaggggtgaaattgttgagtcacatgaaaggtatatgttcaattttacaatgtaatgaaaaattgtttttcaaagtgattttatccattcatttttgcatacttattttcaacacgtaagagttcctgttatttctttctttctttttttttgagacgaagtctcactctattgcccaggctggagtgcgatggcacaatctcggctcactgcaacctccacctcccaggttcaagcaattctcctgcttcagcctcccaactggctgggattacaggcatgcaccaccatgcctggctaattttgtattttcagtagagacggggtttcaccatgttggtcaggctggtcctgacctcaggtgatccacctgcctcaacctcccaagtgctgggattacaggcatcagccactgcgcctggcctcctgttatttctttgtcctcaccaacatttgatattgtcagcattcttttcatattttgtgagtataaatgcagttcattttggtttgttgaacagatctatttaaatttcactgattaagagtaggttgtgctttctttaaaataaatattttccagttacaaaagaaaatatttgcttattatgagtgaattaaaaacaagctaatggaaaaacagtctccattagcttgtttttaattcacttattgattcacaggaatgttttatatattttgttttctaactctctttcagttacttgtgtggcaaatatcatctgttatattgtggcttgtcttttcattctttaaatagtgtctcttaatgagcaattcttttaaaaaaaaagtaacaaccttttcatttacagtttgtgtttttcatattttttaaaaaaattttcctaacatatgatcataagatcatagaaatttacttccatattttaaagacttgcctttcatattgatgatggaattgttttgagtatggtatgaagtatggattcaatttaatttttcccatgtaaataaccaattatttctgtatcatttcttaaataattatttccccctctaaactaccatttttgacatatcacattttcatatatgcatagatctgatttgattctctcttctcctccattggtctttggtttatcctgtttcaatactacactgccttaatgatgacaagttcttatattgtttacaacaaattcttccactatattaaagtttcagatacatcttgttacatttaagacaagtacaatttccattgcttttgaatattgtatttttttaacattgtatttctgatgtgtaggaattttgctgatatttttatattgaccttgtatcaaggaacttgctaaattatctttcagtggttgttaatgaagttgagaacattttcatgtttattagccagctggttatcctcctctgtgtatctgttcaagtcttttgtacttttattgggtggtccattttttttcttattgattcgtaggacttcttcacatgttttggatatgacttctttgttaattaatgaattgcaatacattctttggctctctctttactcttatttgtgttttttgagaaacagaagttcttaagtttaatttagtctagtgtattaaattttctctacatggccagcatattttctggcttatttctgaaacctttcacattacaagtttataatgacattctcttatattctcaaaggattattgctttgtcctaacactgagatctatggttcacctggaaataatctttatatgtcatgtgaagtagtaatctagtttcattctttttcatatggaaataaatacaattgacccaacaccatttactaaaaagaccattcctattcttcgttattcctcactgtcctttaggtcatgtgttatatatgtatagacttgcttttgagctctctattctgttctggtgatctaagtatttaatcctgtgtttataccataccatccactatagtagctttataatgtcttgatatctgacttagcaagtcttccaatcttgttcttgttcaaaggtgattacactattcctggccctctgcatttctttataagttatggaattagcttgtaaaaaaataacctgatggaattttattttgcatctatagggcaaatgaaggggaaataataccttcacaatagtaagtcttcaagtctaagagcatggtattttccttccatgtatttattttggttttctgtttattctttcaaagtcttataattttctatgtagagagctcatacattcttattaggtttctcagggaatttaaatatcataaatgattttttttcatttcactgtttgttattgttaaataggaatacaattgatttttatatatagacattttactgagcaactctaataactaacttgtaaattctaatcaggtattatagaatttttttgattttctccacaattagaacatcagcaaataatgagtttgtttccttttaactcttgtacttttttccctcaccttactgcaaaatctatggcttccagtataaagctgaatagaagtggtgattgtgggtattcttttcctatttataatccgagtaaaagctatcaacatttaccattaagtatagtgttcgctataggtttttttaaaccacattgaagaagtttctttcatttttagtttgttaagagtttttaatcataaattgaagtaagattttatcaaatgccttttctgcagctgctgaggtaattttacagctttcacttttacttggtaaaattattgaaacacagtgattctcttgaattttaaactgaacttggcattcctaaaatgaaatcaacttgatcatgatatactaatctcttcatatatcactggatttagttgcttgttatttgggtttgggttttgtatttattgtcagaagtattatggacctatagttttcctttctcataatgattttagattttgataccaaagtgttaatgagttcaaaatttaccagagcatgttctctgtttgtacttacttgatttggtttgtgtgagattgctgttatttcttctttaaagcttggcaaaattcactggtaaagccactttggctttatttccctctgtatgtagcctttttaattacaaattcaacttatctaatagttgtcataattttttatttcttcttgtgtcaattttaatagttttatttattttagatttttccattttacctaaattttctaattctttgacacagggttgttgtacatagtcagatttacatagattcatctacatgtttacggttttcattttttccctactcttttccgcacctgtgatctccaatgtgtacttttgcccaaagaacactgtttggtattattttaacgtgggtggatgattaataaatttagtttctgatggcctgaaaatgcttttaccttcattgtcaaaagatcttttacctgggcatagacttctaggttggctgctaatttttttcagcaatttgaatatatctctccattgtctagcttccttttttttctgttgagaagtaggtatcctcaatttgttattaatctgaaagtaatattttattatcaggggaaattcagccagatatcggggggaaattcacccccccgatatttcatgtaggtgcttttctattttccctaagtgtcagccagtttgagaaataaagggacagagaacaaaagagagaaattttaaagctgggcatctgggggacacatcacatgtcgataggttccgtgatgtcccctgagctgtaaaaccagcaagtttttattagggattttcaatggggagggagtgtacgaatagggtgtgggtcacagagatcaggtacttcacaagataatagaatatcacaaggcaaatggaggcagggcgagatcacaggaccataggaccggggcaaaattaaaattgctaatgaagtttcgggcaccactgtcattgataacatcttatcaggagacagggtttgagagcaacctgtctgaccaaaatttattaggtgggaattttctcgtcctaataagcctgggagcactatgggagactggggcttatttcatccctacagtcttgaccatagaagatggccacacccaagggggccattgtagaggcccaccctcaggggcacattctctttctcagggatgttccttgctgagaaaaagaattcagtgatacttctcccatttgcttttgaaagaagagaaatacggctctgttccgcccagctcactggcggtcagagtttaaggttatctctcttattcccttgaacattgctgttatcctgttcttatttcaaggtgcccagatttcatattgttcaaacacacatgctctacaatttgtgcagttaatgcaatcatcacagggtcctgaggcaacatacatcctcctcagcttacgagatgacaggattaagagattaaagtgaaaacaggcataggaaatcacaggggtattgactggggaagtggtaagtgtccaagaaatcttcacaatttatgtttagagattgcagtaaagacaggcataagaaattataaaagtattaatttggggatctaataaatgtccatgaaatcttcacaatttatgttcttccaccatggcttcagccagtccctccgttcagggtccctgacttcccgcaacattttataatctacttttgatatgttatttgtctttcgtttttagtagttgtaccctgatgtgtccaagtgtgtttttcaggtcagttgaggttcatgttttcttggtttttaaaatttggggcatgtattttgtcagttttggaagatgggccattgtttcttcaaatacaacttgtatatttttctcttttctcattctcattctatcatctatgtttcttactttcttaattgtactttttataccttttatcatcatgcttaattttattttctattttatcatctttttcatttcatacaatcttttctaaaatttcccattatgtccctaatttaaatcattgtatatttctgtactataatttacatttcattctttttcattgtttttaattctctgcaaaatttttgctccttattttatttacccccttgaacatattaaggatagttttatgttctgtcttataactccaaaatctatggcttcctgcatgtatgtttctattctttatattcccttgtcttcttctgaacatggtcatttttgtttagtgctagacattggtgtagaagtaattgaggcctaagatgatgttttcttccttcagacaggatgtgtatttattctggtgttcacctagggataccagaattccaaggttatcttaatataattttagaaactgaggtaattcaaagctgggcttccatctctgaaatactagtttacttctaatttacgttactccaagggcatagctctttggaaatatcacctacacaatgataagcttaccaggcctgctacatggaaggtccattgacctcaatctttgtccccttagcctttctaggctgtcagaagtgccatacagcttctcagactattcattttatctttttggatgtacatattcttctgtggaaagcaaataccaagctcatctacgcttttctccttcctttggactttgcctattcttcactgtaatattaattctctgatgcctccaagctacactttttaagtacactttttaagtactagcttctctagtggttcacagcagcctcatggtttgaattatacagagtaccattattggactggaagtctttcaacaattttattttggggaaaaattatttctattatcttcatttagtgaattttctctttatgcattagtttgtttcatttcaaggttgctgatttttacttttgcttttttcagtctgctgataatcttatccattgaattctctattacaaatatttttaaacataagcccccacagggactttattatacttatgttaaatatttggaaggaaatgaacagaatgagtgaatgtataaatgatttcagcagaaaaatgaaagaactggaaaaggatccaataaatattagaatttatatatatatatatatatatatatatatatatatatatatatatatgtatgtatgtatttacttcttgaggtgtcttataattttttgcctgccaaacattggaacaaaatacacatgtacaatttttgtttcattttgttttacccccagaggatgcactcctttcttgtcacatggctaggtcaaggggcagaacttttagtttctgtcaagtgttgtgctgagttacagttaacaaaaatattaaattaggccgacctctgggttcaaatagtattaaagaaaactatatttccctttcatctaatctttggttgaagctgacaagaatttgttgggatttgaactcagattggttgcagatgttgacagttacttttggatcatctttggaatattttggttttcaaccaagaaagtttaaccactcatttggtttgatttgggtttaaaatgtatcatatatcttcttcttttgtgatgtctcagttttctagttttctttttcctacgtactttctatgaaataattttgttttacttatttctatttctatgtttagagttttccattaaaatttaacaaatctaatgacttattattaaaattttaacatgagaatgcttaatcttaatgtaattcagttaatgtattcttttccagcaatacaaggattaacaatcaactctttcctcacttaaatgctattttccccagtacattagtattattatgtgtttttgaaccccacaaattattattgttttttcatacagtcaatgtttatttttgtgtaactgcatgttagtcgaggtctttgctccttattctttctttttgtcttcagttttcctaaaccttccgttagagagtttcctttttttctttcttttttttcaaaccacattctttagaattcccttcagtgaaggttttttggtagtaaacatagcttttgtcaacttaaatatgtttttatgtcatcctattctttaaattaagcttcactgagtatacaggtctagagtttacttattttctcttagcattatttcagtttcttctggtttctattgttgctgtttagaagttatctgcatatctaattgttggtgttttagacatttttttttctctttgaatgtctttaagatcatctttgtctctggaatatgacatctttactatgatgtgtttgtttttatgatgcctgaaatttgttttactttctgcatctgtatattaatgtcattaattcttggaaattcaattctatctccaacctttgcatatttctcattttctctattatcttcttttgaaattctgtaaagacttaggtcaaattcttttactctatcttctactttctttttaactgatatattttctatctctttttctttcttcattgtattttatagtatatctttagttctatttccaagtttattaattttcccttcaactgattctaatctgcattttaatctgttttaattttaatgataagtttttatctcttttatttctatcagttctgttgcaaatctgcctagtcatttttattctcctgaatttttctatataatgctctctgttatgtctttaaatatgttaaacattattttccattttgtatctgttatttctcatgtgaaattgttttgttggtgatccaagtattttctttgctggatttttacttatactgcttgttttcattgcttattcttattttaaatattttaattgtgaattcatgctcaatgaaaatttatatgtatgattttttttaggcctaggatgatgggacattctttcatagaggattttcttgtgtttcattttaaactaagccttttaaactaaaacctaagagttttagaccttacagttagtataagttcaggctgtaaatacttggataacaaggtcatcatggctcagaagacatcctcaggacaaatggctcctttagagagtgttaacctttctagtttcctgctttctttttagttttagcctctgagattttcccttactttcttgccagttcggcaacacattttattttgttcgttttttattccttaggcgtgtgtttttgaacatgcaattttctaagctgtcagcaatgagcatcttgtcactcacattttaactctgaaatctgacatcagacaatttagtgtctccaaactattcttttgaagacatcatttaccttcttgttgacactttccttaattgttattaatatatattctcttcttgtagttctcatttcttttgtctttgaaaacactgtgaccttcacgatatctgcttcatctctttcccatcacataacatgcatttatccgtgagtttgtattttatctttttttttcacttttctacactagggtttctttgatggtctcattcagtctcataacttcagttaccattgtagctcctcaactaccaattagctcatccaggaaaatagtctaaacttcttaatctaacatgacattttgatgcctagtattttgaacatacagcttgatggctatctagtttagttcctcaaattcaatataactaaacctgagttaatcttgtcttccaactagtttctcttcctgtactcccgtcttctattagtggcatactaattctaccaggaaccgtatatgaaatttcagaatgactctctctctctctcccagatgcattcactttttaagtcctactgcatcttgctcccacacatgatctcaatactcttttctaaatcaagccatcattacctccaacatgaataccccaaatgcttccatcctttcctcatttccacttcatactcacccttaaacaagactcagtctttggcttctcagaattccaagacttcatacatggttgtattcttctatcacttgatctcacagtctctgcaactctctctttatatatataatatataccaatataatttaatatgtatacatgtgtttaacattatacattatatataattacttgttcatgtaaattgattaatatattttatttttatgatttgtttatttaatgaattttcccttaaggggaatagctcattgattctctgtattcccctccaacacaaaaaaaatcacattttgtacagaaggcatgacatttgttgattaggccacatgttgaaaaatgagtttcgaattgatttcctgtttatggtatatctatctttaatcccttctatcactgtttctaaattaattctcataagtctcagctcaaaacatggcacttacctgttctaagtcatcaatgattatattttttctatagaaaaaagttcaaatctagcatgaaacttaagccattgatgaccttgccctagtcttccttttcaaatttatcttccaatatttaccctctcatgctctgcaagccatttagaatacagtacttactgttttccatgcaagtgtcatatacaagtgttcacatatacaagtgtcactgcccttcccagttctgctgctgcatctaaatgcccttctccacatctcaaggaaaggggaggtttacactggctaagatcctgggcttcagtttctaaaaggtatagacttgcacactagacctagcatttttatcagccaagtgatcttggcctcctaagttttggtttgctcatccatcaaatgagcataataataatagacctcctcaggaaaccattgcaaagatttaaaaagatccacatacagtagttgacacaggactcagcctatatgttcaggaaacataaaggagtattaaatattatggttagtctttctaaaattaccccaaatgtggtagagactgccctttgcctgcttccacacccattctgctggtgacctagaggtcaactcgctgctgccaccacgagtactgccacaactgtttctcacagccaaaacactagttaggaaaactgaaccctggcattctgaatggatagaaaccactcacatctcagccagccaatctgccaccatcaacagcagcaggaacatgtctttcatttcatattcacctgcagattttcacatgtgtttgtagccgagccaaatctgcatcctgaacacacactgtaagaggatccaggaaatgcctttagctccttgatccctccaacttgaagaaggataaaaccaagtttgggaaggccaatccataatatccattacaaaattcattgagatgccactgcttcaagttgttcctgaatttttcctagctgaaagtaattgtccttcctccttctttaagggggtggctttcaacccacactggacattagaactacttgagaactgaaaaatacttatttttagtgcactcccaaaaagtctaatttatttggtttgaggcaggggtgcaccttggatattttttaaattctaatgtgtacccaatgtttagaactactgctctaaaacttataacctttcatttattctcatcactttctaacttttgtttagtgatttatgaaatgtccttactcttcctgctagatcataagctctctgcagacagtgtgtctatttttatatcctttacaacttgtagcaaattactttgcaaatgacatgtattttacatgtttttcaaacgcattaataaatagatggtgtgtgatgccttgcaaacaatagtatattaaagataccagggatggcacctagtccttgcctctctcccacatgaaatgttctcaactacacttcttgtgagtctattcattctgcatagcatagtaaaaatgttaagaatgttaagtggatatattactcatagcattaggcttttcatcaataactcactataaaatacaaaaatagctatttaaaaaatagcacctaagaaataacattctcagctacagaaactattaccagtgaacttacatctttttttttttttttttttttgagatggagtctcactcttgttccccagactagagtgcaatggtgcgatctaggctcactgcaaccttcacctcctgggttcaagtgattctcctgcctcagcctccctcgtagctgaaattacaggcatgcaccaccacacccagctaattttatatttttagtagagcaggggtttctccatgttggtcaggctgctctcaaactcacgacgtcaggtgatctgcccaccttggcctcccaaagtgctgggattacgggcgtgagccacagcacagccaaacttacatctttttagggagaaatctaaaatttaaaggagcaaactagaaaaacaaagccaagtctattcacgccattgaatttctgaactactcatctgtcttctactcattgtcttcattatgttctttgatatatcagtgcacctctaaataaaccttctaaaatcccaatatgcaaagataaaaattccgggcttaaatgttgtgttagttgctgaataactttgaaagaagtttgacaagaatgtctaagtgatatattgcaagtgaatgactagcactgctgagttcacacctagaaaagttgaatgctaaccaattggggtacatgtttatattaatagttcttacagctcataaataagaacagctttgctcaagaatttttaatctttgaaagcaaaaattttccaatatctttgaaaattagccctcaggtgcggattcctgagacaaaaatcacatagtcctcatcctctttcctacagctctacctgttagggaatggttaaaacaagctatttggcttgctcttctggacacagagttattccctgagaattttaatctattaatgttagtgacaaagaggaggaaaaagtaaagaataatgtttagaaaattgtaagatagtaaaaagtggtcagattggaaaaattcatactcttaccttctgcctgctccatcccagttagaactacttgcattcaaagttcaaatcaaaagcttgttactcaattctgttttgtaaaagcaacatcagggagttgggtagggtgagaacagaaaaagctttaaagttaaaaagcttaaaagtttcaagatccttcttcatccttaatgtacccaggtgaaaatttattctcacgactcaacatttcccatcttcaaatgagctcctatgccattctctcacttctcttttcccttcctcaataaacagtttgatctttccttccttgtttctttctttccttgcttcttttcttcattcctttattccaaccttccttccttcctaacagatttccaacagcttaacttccttaagatcttcctaggaaggtctctcctcactctcctttctattataatagttctctaagaattctatatggttctaatagagtgtgtatcatttatatagttataatacctctatttttaagaaacactatttggatgtattcaaagatcaatagttaaatgatagacttcatgaaaatgaggaatgaatttcttagtgtattttttctaaccaagaagaagaggataaacattcagtttgctcacttacctcaaattacattaactattactaagatacgagctataagataatccagactccttgagtgggcagggagttcaaatcactaagtaaatattcaagaaatgttgacctgaaccaaatgcttcctcccactgtatagtcctacaagtataaaatcacaaggttttgagatattagactgattctgttctcaccctacccaactccctgatgttgcttttacaaaacagaattgaataagaagtgaatttcttctttccagaggccaggcgcggtggctcacgcctgtaatcccagcacttcgggaggccgaggcgagcggatcttgaggtcaggagattgagaccatcctggccaacacggtaaaatcccatatctactaaaaatacaaaaattagccaggcacggtggcatgagcctgtagtcccagctactcaggaggctgaggcaggagaatggcttgaacccgggaagtagaggttgcagtgagccgagatcacaccacagcactccagcctgggcaatagagcaggactctgtctcaaaaaacaaaacaaaacaaaaaattaagaaatatggtctatattgtaaggcattttctgtggatccaggcctgttatgtaattaggactggggtgggagaaggaccgtcttgtcttatatttagacttctgatctgatcactaaataagttacaggtattttgatgttgtcatgtttaaagtgtcatttaaaataaacaattgaaatattatcaatttggtaatcccttttgtggttttatatgttttatatattcattttataatacactaaaagcctcacaaaatggcagtagactgcagttcctaacccctgaggggccgtgtttcatgatgctattatacacatctaaaactaaaataaatattaatgaaaacgacgttttccatattaagtgaagagagttaaaggtacatattttatttctataaagtgacaaacacttgatcgctgtaaatgtgaatacaacttttatttttaaacctttcaagggaattagatctattttcctgctgtttccaagccttcggtaaccctctgagtgtgtttgtattcactaggaaggaacatttctgtggaattaatcaaatggagaattcaatgttccttttagataattttggccatgttccattgcgaactttctagtctgcatttcatctctttcctgggaaaagacccacatattcaaaatcctctgccttttctctacttgttagtgaagaacaatatagcaaaactgctatgtacagaattaataatcatgtgcattcagcaaggctctctgctgggaatttcatcactagaataaggcaaaacgcatgagaataagagttcaaatgtagtcagtacaaactagtatcaaaaactctgttgtattatcgttaattgctcctctgattttgctaaaattaaaagaaaaattatgtggggggagaattagaaaatattcaaagctcctaatatattccagtaaaccctgagatgacaaatctcattttccaaggaaaagcagtgctaatttttttttgtaacaacaaagaattcatgttcaacgcctaattaaaacctggaaatctatatgcgttgtttcttttttttttttttttttttttttttttttttttttttgagacggagtctggctctgtcgcccaggctggagtgcagtggcacaatctcggctcactgcaagctccgcctcccgggttcacgccattcttctgcctcagcctcccgagtagctgggactacaggctgtgcattgtttcttaatggctttccaaatttacaaaacaatcagagtccttatctatcactggctttatgtttcatatcagcttttttattcatcttacagaatgcattttgccttgcagatgaattctagctattttatccatagctataatggaatagctgctgctattatttatgctctatacatgttactttggccctaaagcctgaaggaacccattgttgttttctaccactgatgattttatctgcacttctgcatctgggcaattgttcacaatagtcacaaagacctagcacttggtctgagaatcctacctgctgaggagttttatttggccagtttggtaaaggacatttaaatgaagatatctaaagctagcagaaaacagagattttggagtcatcagcacatttgggatggtggaagccacagccaaggaggggatgtagtacacgaagacctcagggtaaatgtgcagagcccttattaggtattcagtaaagacttgaggagtaaaagaatgaactagaaaatgacaatgtactgattattaatttatatttgagtaaaaaagactgttatttccatcaaaatctgcctctagaattttccagcaagaaagtaagtgatgatagttattaaaagccctagcaacagtttatatccttgaggtaaaaccatcctgtttcaacagataccatattctcattgaattccacattagcttatgataaacacaagatgtttttcataatctagatgcaggttttatgcatttttttttagcaaaacatacagggaactgccaagatgggagagtaatctttcctaaatcactccaaatgtcaccatgactataagcatactttcctaaattgggggatttttgcttaagaaaatataagttcattcaaatgcttcactcacattatattaaggtttcatcatttatcctataaacaaaattctgcttttatatacattaatcactttgtcattcataggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggtaagtctcacctcaatttacagaattactgcctatgaacagcaaacaagtgggttggagtgcctcttttcatttagtgttgactttcaacactatttctctgctactggatatataaggatcttaaaagttaccagcagtcaagctccagccactacacttagcactatgaaatacaacatatgcttaatcctcacatgatcttctaaggtagctgagaatgctaaagattaaaggggttaagctatttgtccaaagttacacagctagaattttcctgctgtttccaagctctcagtaaccttctgggtgtgtttgttatttctggaatgacaagggtataaataaatgcataaagaattgaagttgaaaggattcaaaatctgttttctgatgtaaaatcagcttcatttcttactaaaccctattgatacctctcacacctaccaccccttcctccgacatgcttattctttctttctttctttctttcttcttttcttccttccatcctccgattattttcctctctctttctctctctctctctctctctctctgtctctttcttccctctttctgcctttgttttacttaggtgatgttattttttgtctgtttagttacatctcaaagagtaatagaacattgcaccctaaaatttttaaaaatcattccatgaaaaacctctattatagtttataaaaagaatataggcaaattttgaagacacagcagagaatgtatttgttttttcccagctgccttaagtgacccaccaagaaagccctgggctctagctcttaattaccccagagagtctcctctctatgggtaacagtttcagtaacaactttccctcacgctactagcacaacctactgacatgagagtcccaggagtgttcagttttgtttcataaaatggcctgtattgtcacaaccacatttaattaacttttatttactgtctcaaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggtagggtctcaagggggctcctgtctctaactgaagctgtgatgcttttcattaagtcccagcacatgaggagtgcagcagctcccaaaaccctggttttgagaaagatatctttcttactctctcaatcttcttccgtgtactttagaaataaaaagattattcattcattatccttgaacaggtaaattacagtgttctgtgtattttcatatagtctaattcatagaaacatttcaaaccagaatcttacccataaaataaagacaaaatgtataccaataacactacattaaacacagtgccctaggcacaatcaatggcatcagaaagagtgattcatcataggcgattggggccaactgccattttgtagcttgacacaaactgttttgaggatcggttattgttattctctcttagggaagacagggttcatgtatatcattccacttttggcaaggactaattctttatattttgatcttctcaatctctatggtcagcagcataagaacataattcattctctgccactcttgctctctcattttcttattatggattcagagaatttctagaaggccataactgcacagtatagtctcagtagttgtgctctgggcatttttaatacccttgtaatgattattatggcccaatttatccaaaccatgtgaaaccattaggagtctccattaaaagtacttttacatctccagattataggttatgcagagcttgaaaaagttttcagtctaagagtgattctccatcatcatggctaaactttattaaccatttttttttctccagatgaatgggtttttttgaacctgaaaaaatactatttttctaaaaggacaattcatttatcatcttaacttaaaacgtttttaagtaatttgatctgtatttgcttaaaaaataaaattatgcttgacttatactaacatggccttacttttggagtacaggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtaattttctaaagagggtgaagcttgtggaaactcagactatttctttttagctgtatcatatatttagaatgaactgatactattatgttatatctgtaatcaacacacccatggtagtttggactttcaacatgtccaaaccactagttgtcacgatgagcatgaccatcttttttttttttattaaccataaaattccagccacaacaagaatttaatattccaaacagctcaagtgatttggtattccagttcatttcactgttttttgttgttgttgttgttttatttttttgggatggaatctcgctctgtcacccaggctggagtgcagtggtacaatctcggctcactgcaacctctgccttccaggttcaagagattctcatgtctcagccttccaagtagctgggattacaggtgcgtgccactgtgtccagctaatttttgtatttttagtagagacagggtttcaccatgttggctagtctggtctcgaactcctgacctcaggtgatccacctgccttggccttccaaagtactgggattacaggcatgagccaccacactcggcccattcactgcttttatacaagatctcacgtattctgggagaaagcacaggtctctctttgaatacagatgtttcttaaaaaataatgtttgatctattcagtattaactgtttcagagaaatatggatttgcctcacaaagtgactaagggaaccaagttaaacaggatgtttaacttctcacattctttctcagcaatgcaaatgtcttcttgacttgaagcttttgtatttcctatgagtagggcaatcggctcaagagagtgccaagatcatgggggaagttcagtagacaaaagacagaaagaagactaagagcagcaagttccttcactccagttccaggatcatgtagggccttctgacttggcttcccactcaaaaaaaacattttctaagagaaaaaaaaagtaatatttttgaagtaaacttcatccaattctttttttatcctctaagcttttatgtgaaaaagtagctctaacaccttgatgaagcctgtctgcattccataaaatatatatggaggttctcaaagaaatccttgacctgcgaggcatcataagtttaaaatgacaccataaattgtcatgagaaagctgaatcatgaaaatacattggattagtatagtggtttcaaagtattttttatctgtgggttactttggcagaactcttaagcccatttgtatatctggacagctggaagtcacactaccactttctatgcacacatatgtgaacacacatgcacatacacacacacacacacacacgcagttaactgtttaacatacataaccaataccactactgcatttaaagaggcagcaatacactatgctaagttatcattattaaattacactatgttgatggctgagaattacaattgatcacatgacataaaataatcttatgactgagaccttcattactctaccaaaacactggcttagaaggtgactttacaagcagcaatcaagccatatgacatatgaagctccaaagaattaccagggtcaatgacggcatttaaaaacatgctggagctgggcatggtggctcacgtctgtaatcccaacactttggaaagccaaggtgggaagattgcctgaggccaggagttcaagaccagcctgggcaacatagtgacaccctgtctgtataaaaaaaaaaaaaagtttaaaaattagccaagtatggtgacacgtgcctgtagtcccagctacttgggtggctgaggcaggaggatcacttgggcccagaaattcaaggctgcagtgagctatgattgagccactgtactccagcctgggtgacaatgagatcctatctctaaaaaatatacaaaacttaaaaactaaagaaaataaaatcttgctggaaataaaatgaataggtttatctcactgttttgagagacaactgagttggccaattttaggctgcatttcttaaagacagactaaaacagtaatgatatttgtgagaattatcctaaaatcatttatcagacacaataatgaagactctttcaatgctataacaattcaagagtgaaacttctttagtacatccatgctgagcactgtctgggccaagtgctgatgtttcccaggttattggagcctgtaactatatttaggatatgatttgaagtcatcaaaaatttacaaaatatttatattgggtagtagacagattatgacatgccagattattttttatttagtttttaaaaccacaagtccttttctaaaaagctagatttgtttttgatcaagatgatccaatctaaacaatttttttcaacccaaaccaaagaccaaatattttcttaaaaaaaggaaaaactacttgacaaccaggctgttagaacttttaagctttaaaatccatagattttattttgttaaactaagatttattttctgccagaaagcaaatgattttaaactacaagtgcttcaaattcaaactcctcaaggttcaaaaggagttaaacgtcttcttcgatttttcatctgtcacataatgagtgcaaaatcattattgcccccactttttcacagaacaaacttgttctaaatcctgagatcaatcagtggtgaaaaccaagcttagatattagactttatcttaccttcctacctcttcaaaaggaatataatcacaagcaaactatttttgatgttccagaatttcttctctctaattaaacagtctttggtgtatatatcaagttttattttgctgtgaatacatttttcaagtttcagatcttttaagcattgcctgctaatcatcagaccaaacaaatcaaaggaatcatgaattctgctgtgtctgctgtaaggcattggaagtcagtaggaggtattttaaattgctttacttccatcacaacattatgcttcccatttacttattcagaatagtatgcttttttccctctaggaaaatatctttcatatcaaatatctttaatttctaagatatttgttataagattaaaaatacctttagaataattttttcacaagtctatgtaacagacaaataacatttttgagttcgtaaacaacgaggcggcttaaaataggctctaagtttttactacctagttaatttgatacaaaggttataggaaccacctcagataccccattgcttcagtcattataaaacacttacaaaaacacattccagtatctacagcaattctaagagctcattagctgtgaattcaaaaggtgatgtggcttaaaaatagttacatgagaaaaaatgcccaagatttatccatctgattctaactaaagatttctcagccttttaaaaagtagaattcatggattaaattggtttagaaagaaaatattatcttatgcagaactaattacatctcaggcaaaacactgcacatcacaccttaaggctcaatgtacaaccagggcttattccattgagttctaattcccacagcaccccactgctagatacaatattggaattgctttccaactattttttcctttggcatttattcattcattcaacaaggattttcaactgcttatctgtgtaaggtaaccttgactcagtatggcactgatggtgatgcacacaggctgtggaatcagaccatgcaggtttgaatcctagctcactatggccatggcaagtaacttaatgactgtaaccctcactagttgctcatctgaaaagagggaaagataatagtctgtagtatgtagaggtgttgagaatattcagaagagatcatccttagcacggtggtaaggactgaaaaaacacttaagaaatggtagttgttattagcaaataatggtgcttaccaattccattcagaattactgctgttggatattcttggacctggtgtaaagcattcaggaaaaagaagaattcttttaagcatccctaaagttagacaggtagttataagaacatagtatagaaaatagctctaacggcagatctttaaaaaccaaaattaagaaaattcagagaagtatgaggaagtgaaaaaagaacctgtgtggtttttctcccccatcttcctgagtccaatatggccctgcctctgttctatttcattgtaggagaaaaatatacaataatttccatttctttctacttctaattaattcctatagcctttggcttctcatattattaatttttaatgactttttgaggaaaagaacatcctaacataaggtgaaaatagagtagccaaaagcaccagttgtggcatagaagacatgaaatgatcttttttttttctttttgcttccttttctccccagagatactaggatctcaaaagaatcatgaaatgatctgaattgtaatggctcccatggtcattgccttttctgtggtctttggcaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtgagttcttcagttcaatatgatcatgccatgagacagttatgactttatgaaacactatctagttaatttaggaaaagcaattaaaaaatgggaagctttcctttatatttccttttgagataaacacaagtgggtgcatatatatgagtataaatattacatggattcctcaaggaaagtacaagagtataatttgggtgactatactctgtgaaggtaactacatactaaacctaatggtactgactctaacattcaaggaaggaggagaacaggatgagctgagaggttagtgcaggccttcacgaggagatctgcttgcagcctcattaagttttgagtgggaggagaagagtactaataaatcaaaatcctgcttaattctaaaataggaccaagcatcctttagttaggaaggttttaattaaattccactattgtatagaacatctgaagctgtaataattaaggtagcataggtcagtaattaattaaacttcattttaagatgcttctaacaaatgtattactctcttttctctattcacttgcaattatgaagtgtgtttatgagtagatgaaagaaaacaagatagcattttactgaaaaaaaaatgtgacatgatttgaaaataacataatgataaatcaatccatgttaaagaggttttcaaggtaaaaagaaatacatcttttcctcagagacacttttaaaatgctaatcctataataaaggaactgaaactagcatgacacttgagaaactcagcagctattctttctggcaatttataatcacttaataatgtgtcagaactgtatatctactttctattcctagtattcttagaacatatttcaatttttagttgttcatataccatagaattaaagatcattttatccctttcctccttcttcatcttcaaatatgtggcaaaataaaagttgagtcttcatgcactttccaaccaaaagaaaaagtttcacagcaaaccccaccttggcaggctttcactgacttgcaaagggagggagggtgtcaccagaaaaaaacagcatggtcttatttgtctatatggagcaccatctgtgtcaggatctcacactggctcacgggctacatctggcaagcaggctgttgatgtttggcctgaacatgtttggaaataactaatgtaaaatccatctctgcagctaaaagtagaggaagagcctgccattgggtgagcagactgcctccacattccccagcagggtcaccatcatatggaactcgtggctgtccaattgcatggggcatgccctctctgtcccttgcaccctgtctgcatcactcagctagatcacctccctggcccttgcaagaacttgccttagcaatcccacaccactcggctccagggtccatgcttttaattaccctgctctcctgccttctacaaatttgacaattcctatagccaagagatctccactgattttagttagaaaatgggactttcagatatccaacaatacctggagctccagaatctcccaagtaaaatctgcaatcacagtccatttattttataacaacacttatcttgaattgggacagaaaaaaaaaggggacttcaatgagaaaataaggaaattaacaactcaaaataagtttcaaaattctctggagatccagatggctaatactgatctgcaaaaagcctacacaagccctgaacttgagtttcaattctggtatatcacagattcatgtgcctaagtgatttttttcatagattgttccagatcaatcactgggcccagctttttaaagttgagatggaaaaacaacgttgttctgcacaaaaacatgaggatgatcaaaagtaaataatctgacccaaaagtaatctaaattttacccaaaagtaatctaaatattatatatttaatttagactcatcagtccacaggaaatgtctaataactatcttaatcttttttttaactttgtgattgagacaccagaggctgaaatgcctgcaaaaacttacaactcactttactatttcttcatctaattgttaaatatctataggccctgaagtactgcttctttaaaattgagctatttgaactgatgtaccattgggaattctgatattgtcacacgtcttcggaaaattggcattaatctgattattatgtcactttaaaagctaggtattcttggtcaaaggatacacaatttcagttaaacaggggaaataatttcaagatctattgtacaacatagtgactatagttaacaactatgtattatatacttgaaaattgctaagagaatagatttttaaatgttctcaccacacacacaaaaaagcatatgataaggtaatagatatgttaattgccttgatttagccattccacaatgcatacatatacaaaaacatgttatataatatatgtacaatttttatttgtcaattaagattaatcaattatttttttaaaaagctctgagaaatctacccataaatcaccaagtgtaatttttaaaacccatcacattgaactgcttcatttgaacaaactccagatatagctaccatattttctcctcctttgagataggattaacctcttaaactatcagggataaatgaagctgcttgatgcagtgaaaggtgctctggactgaggagcaaaagacttggtcctccctgcccccactgctgtgtcaccatgggtgactaactcacctcaggggtggggggccttcatttgccttatttataaaacaagcagttgagcaggttggctttcttccatctctgtttatttcaaggaaaaggaatttcaaatgttgtggcttcttcagagagtgatgctgatgttcctgatcatattctttaccaaagataaactcaaacttagtttcatgaggttaaaagcagagactctaaagacagatggccctggcctgtgcttaaatcttagatctgctgcttactagctgggtgacctggggcaagcggttaaacttctcacttctcagtttttgtctgcaaagtggggctgatgctaatatctgaccccatgaaggtaaggtgagggctgtatacggtaacacacataaaggacttagaatagtaattggcacacagtcaagcactcaacaaatgccagctcttattctactgacttgtcagaaacctatgaaaccagataacacaggtgtcaaagacctgcttcatgaatggctttcttactgcaaacaaccctcatgacctaagggagtaaacatattccttttggaacagtttacatacatctcacatgttggttcagccctttcttaaagttgccagatgcttctactttttcttatttgtaaaattccggaagaattgcttttatatttgccacttgtacaaggcttactaataaaattaagaaaaactcatgagcatcaaaatgctagacatgtaataattagttttatgaacagcataatttatgtatatacagaacattactcttgcagtcagcttattaatgttttgaataacattaagggaattaagtagtacataattaatttacatttattaggaagtaatgttgatagcatcatagataagcaagctataaatttaatcaaggaaagtagagaaatttgatgcaattttctgtatgaactactaaattatatatgaagacatcaaataagtttgttaggatggaaacaaaagttcattatcctatttaagaagaatgtatctgaaatagaatgctattcaccctttcacttcaccattccaaatggagtatttggaaattacatatgaattacataactcttttagcctcactccatggatgataagcaaataatagcactaagattactgggagaaaacatgaaataaataaagacccaagcctagggcatctcaacctcttcccaaaccctaacattttctcctttaatgtaacttctcaaaatcaatttcttgaactataccctggaatcacattaaggagacagagatcagaccctcaccgaagattcaaattcgactactttttaaagaaacagtatggttcaagtgaggcccaagttaaagtggaggaggctgacaaagctcttagaaaccaatcacgggataacgtggcttcattggccagattcaacaaaagctgaagctggctctgagcaaggtaataaggccatcacgttaggatggctgaatgattagacaaaatcctctatttggttatgctttctagaaatagtgtcccaaaccgtataaccccaggacatattctaagtacaactaagcacagaaaaatgaggggaaagaagaaaactaaaactcattacaacattggacatcaaactaggaagcatacatttatttccttttatcttcattttgcagctaagaaaacttaaagtcatatagagaaaaaggggaaatgtattcatacttagatatctctgacttcacaacctataccttctttccactatgctacactgtattgtcttatctggcttagacaaccttatctgtttccaaaaatacctgacttgcatattagcattctgccttcttctgttgattatggcagaatttggctgtgaatctggttgggtggcataggtgtaactttcctacagtggatagttccagatggacacagggccaggaagcagcattcttttttgggttatttgcctctgcgttgttttgctcatagctctatctccagttcctagaggagcatctgctagaatgctcaatctgttccttgaaaggatagattaatctttttctccaattcctttacaggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatcttcacttgtggaaatgagttttagggaagggattgagtcttggaacatgactttcatccagatatctaacgacataatagaatgcataattagctctgtgcctcatgcattattgccttctaaaattacataaatgattaatgggcagacataaaagtgggctttaaagaaatctagtaataataaaagctgaaaaagaataattcactgctgataattcagaacctgcaaagcagcacaatagagtaatgtgggctgtaggcgagccctccccactcttcccccacacctgtgccacaccccccttaccccaagccagttgtgcccccagtttcaatctcctgcataaccaggaggtgcactcctaaccctaagcaactgtcctataagtcagtcagtgtttattgatcacacaggaagtaaagagccttagtgagaagtccatcaccaggtttatctttataccagactttaactgatcatgaccctatcttgctacccctggatattttccacattacttgggacaaatggaaagcaacctctgctctccatgatctgttttcacattggttatagcatctcttggatggagtagagggaggtcaggagaagaagcccacatagatatataactgtcttctctcagattacacattatagcattaaaggttttgattaaaatctaattgtaagatactgctgattacaattaccaaaatagcatcacaggagattcaattaaaattgttatggaaataatttttgaaatagtttaaaatgcaagaatattcagcgatgttaataatttagagatactaataagtgttctgctagatagactatttgaaaactataaatgtatttttggattaacaatgccaaggtattttttcatattcacattgaaaaatacaggcaaaactatcaatattttttctgcattatatgaaatttcacaggtagaactaaatctatgatatagaaaataatagcacattacacatagagaaaaccaagccacttaggtttagatagatatataacatgtaacatcttctctgttaaccaattatagatacatatacaacatgtaatgttttcttagttaaacaattggaaatgtttaggcattttactgtgtgggggcggtgagtatgcacatgatcagacttgtattctagctttacaattaaaattcacagaatcatttcctaaagattttattatcctttcataaatataaatatatatacttttacatataaatagttctgcatttagaaggtatcctacacatcaaacatccattaaacatgtactatgccaaaagttagagcttatactgttgtgggtctggagttgtaggaggatggatcatggtatggaaatgcagaagtgcctgatgcaaagatccttgcctgcaggttaaacaaagcaccacatatgtagacatagcacacatatgcaaaacaactaagaaaaagacctccttaggtctttgcgtaacacacacaaagataaatgtaaaaattatatagttgatttatatggtttatgtaacaaagagaaaaactccttaatggacttatccaaagatgaaatggactgactcaggaaacagtgggctcccagtaattcaaaggtgacatctgcatgggcaggaaagaagttaaaagcaaatcccatgtgccaataacaaccagatggcttggaagtagcagagactgccgaagagcaggagaaaataagattgctaaaaga

SEQ ID NO: 12839 - DNA, 43414 bp, Human
gattcttccatctgatgagccttgaagcacagcccggaggcctgtgggctacggccaccctactcacaggtctgcctacactatggtgttattaaaatgtttacattagctgccaaccttaaaaatcaagacgtaacacaaataagttccagatagacaactttttcttgaaaatgcagaaaactggacacacatctccaccagcaatgttggctggatctgggtacactctcctagcaggctctgtaagggtgcctgcctatctcatgtaggcatttgagtttgccactctgggtctagtccaatctgctttgtactcacctgccctcttacagcatctctgaacaatttctagctagtatctgcttaaatgcctctggtcacaggagtctcactacatcagtgaggcagtccacctgagctgcgaggaaggggctcctatggaactgtcttccccctttctgtagcaaaaaaaaagacacagaggaaagaaacgggcgttggagccaagcagctgtggatctgagtacctctctagcattcaaccagctgtgtgatctaaggcaaatgatggcctttctgagcttctgtttccttaggtgtgccagccctgcaaggctgtgtgaggcttaaactggagcgagtttataaagcccctagagcagggtctgactcagggcacatgttccccaaatggcctttctcatcctatgtaacttccagccatggctccaattctcctcaccccccagtgaccatgagagctgggaacgaaggaagaggggactggacgatggtctgtgccaggcggcagtgggaagcaatcaggcacttgctcccgtgggcatccaccctctcaggaggctgcaggtctcttgcctgcttctcggactgcttggcccaccaggtgtgtgagggacttgagggtggcagagcaggccccaggatgcagccctatatccctgtcctcccctcacagcccaaagccatccctggatgagacccctagtcctgggggatggaactggagacagggaaggtcaggggagggaaaagcagggaatgatagtccccctcactggataacagctcccatgaccggccacctggctgtgtgcccggccgtctgccaggagttccacctgggccctttcacgccaccctaggatatcgatactggtattcttgttttacagacatgaagttttagactcagagagcttaagaaacttgcctaaggccacacagcaggacacttgtcttcctggtccctgagcctgccctcctgaccactgcaatctaaggcctccttaaaatcccgtggtccctaaatgccaagttgttggggtggggaaagggagagagttttggttttggtgtttttttggtttttcacctaaaagtgcctctgagtttgccgctgagcccatctctgagcctctgcccatgaactagtgtgtatccatcggagtgtgtcaccacgcgaagcactcggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctgagccctgagtccaagtgcgcagcgcggggcgcgcccccgaaggtgcccgccgggggagtgtgggcgtgcgcacgtgcggcggcggtggccgcgggccgggtggccgcggtgcaggctccgtgtcccccaccccccccgcctcggtgctgattggctcggcgccgtgacgggccggcccccgcccggggcggcggcggcggcggcgggcgcgggtgcccgcgtgtgcgctgggagccgcgtgtgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaacccgcgagcttgaggaagacggacaggtaccggggactgggggacagtgggaaaggacaggagacaggactgagggatgtgcagctggggacagaatactgagggtcggacgccggggacaaggggacaggactggacagaagacaagagaagaggtaaggaggagagggtacagtgaggtagggcaaggaacagggttggggacagaggacaggggggtaggcactggggttggagggacaggagaatgggggaggaggttcagagggcagaaggcaaagggggtggggacagcattgagagataggagccaggcgctgagaaacgggaccccggagagcaggactggctttgaggggaggcaggaaggaggggtgcggaatgagagtctgggagaggggtcagggcccgagggccacagtctggcgacgggctggggagaagaagggagggcaggggagttccagctggaggagaggcagcttcgtgggcagcgggagcggcttggggaggagagggctgggggatggggaggccacagagagattgaggcaggcaggccccggagagcaaagtcttgtcagagaaggctgggatggcagggtcactctggggccctgtgtgggaggaaggattggggtggggaggtgcactgagtcgttgggaccaaaaaggtctgggaaatgacttctggtggtgggggcacaagaagagctgagagggagcacctaagcctgccacccacacacccgttagctccctggagaccccagctccatccagctcaggaggtttccctgggtcccactccccacaccccaacccctgccctgaccctcctctgttcccacagctctgccccaaggaagccagagcgtctctgtgcaggctcccagggctgatgtccagggaccagagctgggtcctcaccctgccaagatgaacttccaggtgtaagcgaactccggagctggtgctgctcttccacgcccagacagaccacacatctgcccttcacacacagctcaccgagggcccaccctacacacaagcacacacacaggctacttgggattcacacttgtgacccaggcctgtagagactgacatgtgcggtcagtctccccaccccacataacatccacagccacacacacagaaatgaagccagtatgcatgagcacaaacacacatgtacatgcacgtacagatgcatgcacatgaaaatacgcaactctgtgtctacatatatacatcacaccacatatgtaaggagcccgtcgtttgcatccatgcccacggaaatgcatgtgcaccaacaaacacacacagacacagataaaatcatagtctcccatgagcccagggcccagcatggaggagaggcacggcagggtggccgagaagtgagatgccggcagagcagggccgggtgggtgtaacaaggcacaggttcccggggcaccaggagaggtctggggttggggggtgctggggagtaggaaagggggcaagattggaatctaagaggccttggggccctgggagctgcacctgagaagacggctttctgagggtgggtggagggaaggggacagttcgtttgcccagcaggctctgaggcccctccatcgaggcgctgggagtcaggtggtgcacccccaaccccctgcctcaactctcttctctgggaaggagccagcaccctctggaatcacaggctggtagccccagagcccctcgaagagggggcttggaccaggctcatgtgctgaggacaaagcatgggtctggggaggggacctgtgcagtgggtgggggccagcagctgaggaagaggcaaggtctagagagagaggcaggtggggaagtctgtgtccatggtgaagggaggcatagcccaagggcgagagtccacgccctctccgatcaatgcagcagggtacccacagccaggcacaggttacccacacgagtcagacagccatggggtggagacctgggacctgagttccatgtggcgcatctgggagtcctccccagcactgtccctgggctggtctagagcaaccagagccagctgaggggactgttggaactcagggaggggcctgtgctcccagctgggtctagcaaaggtaacaggaccttagcctggccaaacaacagtccactcaacagtcccctacaacaggccactctcagagcttttgctggggcacccgtgggcccaggaagggccctgcacctgcagagacgccccccggacccctgccaggcccaaggctgcttattgctctctggtgtggcttatcctccactttgaggtgatctccaaggcattcagaatcctggctgacgtcccctggccaccccgaattctccagcctcaccatcatgcgctgcgtcctcagggaatgtaaatcaatttaagtattagtctcagcgaaatggaatgggggaaggcgacggtgctggagaaaaaaagaaatcgcataatgccttccacagtcgaacaggaacggcttaggagttatctgtgcttcccagagcaggagagggacccgtttgatccccccagaacagcccgggcagataggcctaggagggatgcctatggacatctttcagataaggaaactgaggcagaggggttaagtgcttcgcttcactgaagggccctaggagaccatggagtccgatccccgtgtttggtaagcggggagatgggcccacaggggagaattggcttcacagtccggcagcgcaagaggcaggagagaggccagctgcggtgaccagagggtctgaattcccaaggggacccaggcccaggctgggtgggcctaatggtggcgttctcttcagcactcatcaaacctcctatggacttggggcttccttcaagggacactctgcgttctcacccattcaaggggacatggatggggaaggtggagatggggacagaggaagaggagggaggggagggacatagaagggtctggaatgaattggaacaaacagccctggaatcccatagcccttcctgagtccgatagaattgacttttgacttatctttggattatctgatccccctggctggttgatcaagaatcagctgcagatacggtggggcttcccccaggagggcagggcctggagagcggtgtctgcaggccctgaagcctgcacgctccagggcgagaatcctaagcagtggacatccacttgagtggctccgggatagggacaggtctgggctgcatccaggccaggtcacagaaggggcccagtcaccccgagacctgtgtctgggatgcggggtggggcggggggacccatacgtgtgtgtccttccctcaccatctccccaaactcggctttgctggtctgggggaaactgcagtgcggccccctccccctcccaccagccagcaggaggagagagcttgcctgacccagttttctctacattgcctgagagggagggaggcaggcgggaagccttctctctgcctctgcccctggcgtggggccggcttggggagggggaggtccctctgcggacattcgctgtgtcccctgatcccaagtggcccctggggacccagggaggaatgcagggaggagcgcggagaccccctccctagttctgccagcctcactccagccggcctccttcagggtccctgacggtggggtggggagggtgagaggcaggagaaaatcagcaaataagagcatcctcactccagcatttcctgaggacacttgtctctgtcttcgaggggcaggcttagagctatgcaaatctcaggcagaaggacacccagcctccccacgggaaagttccaggagagctccacctttaacccccgtcacctgcccaagcccgctgattggggtggttaaaagcccatggctgttggctgggagaaggggtcatggaaggcagagtgaaagggaaagctgtgggactctggagccaaaagccctctcatacagcaatcaccagctagatcaaaaggaagcaaagaggtgaagggacttaaccaaggacacacagcagttagagacggctgaagccggagccctgatttctaaacagcataatgcatctgtttcaccttaagtgagggtgtgaccacaagggacatggagagaggcagggggcgggggacttagagaaggggaactagtgttggtaaggaccagccctggctccaggcttcacgtaatttcctgaccctcatcccacccttaggtactatgaacccattttacagatgagaaaattgagggtcactcgctaataagtagctgccttgagacatgggcccaggaatgtctgaccccccagatgggctcttttccctaccatgttgagcctgcagggtcccctttgcagagggcctgacttagagtgactttgccctttggaccagtgctccttccctgccgtggagactacccagaggttctgtttctcgggcccgagcatccagggatggtggatggcctgccgttgctacagcaagtgctccgaatggcagctccgccagctacacctgtggggctcttggcacattcccggacctccctgaggctcggttcttttatctgtaaaatggaggtaatactggccgcctctcaggttgttgtgcggggtgcagatgaggcatctcaagctccccttgcagatattggcacatagtgggtgcccactaagaggcagctcttaccccgctaagcccctccacaccagatgtgcacggaggacgtgctaaatgccaggcaccgtgctgggggaacagggtgattatgaagctggggccagtcctcagatgggaggtatgactttgcagcatggaccttgaatgccatcatggctcttacaggagacaagggtcaggtcatcatcacaaaagccctgtgggaccggaattgttatcaccccattttacagaggaggaagctgagactcagggaggtgagggggcttgcccagggactcacagctcctaagtggcacaactgggattcagaggcctgccagcttcgagcccacctcaactatcccactgtgccaccaaccaaggatgtctggcacttggaacagcttgtgttctgggagttcagaatattactttttggccaagagggtgagaagaaggcttcagggaagagaaagaacttaaactgggccttcaaggagaggggaagagagaaagggcattcaggcagagggacccgtgtgagctgtgtgctgggggctgagtgtggaccagtgtagctgggtcaggctgctcttgaggagctggggagaagtcagaggggcctgatgccctcttgtctcctgttttacagtgaatttgctggacacgtcgaccatccacggggactggggctggctcacgtatccggctcatggggtgagtgatgggcactggggacaacgtcatccctctgtgagcagagagaggctgccactcacagagtctgcatgagatagatcaaaaggaagcagaggcccagagaggtcaagggacttacccaagggcacacagcagttagtgctgctgatctcttaacagtttagtgcatacagacccttgagattacagaaccaaccctggcaccagatccctgattcttcaagtctgaggccctaggtccggggatccccatggctgcatcctacagattcatgaggtgccaggccaggactaaagaaggccagccaggccttcctgccttctgggttgctccctccctcccagctgccctggcctcaccagtcctccgacctctggagtctctgcttgtctgtctccccaatgtggccaagctcccggtcctggccacagactctggactcagccttcaggtcgctgtgggtcatgtgctcacaggccgtgcccccatcctcctggggaagggctgcagtgagcaggctgcactgccccgtccctctgcttctcttctctgaatcctgcgggggcagggcagtagagtaggagtgagcccgcgagcctggtgagatcccagctctgcccttgacaagcaggtggacttgggtcaccatttcacctctctgagtctcagtttccccatctatagaaagggacaagtctgtgatgacctcccaggtctgcgccagggtgagagcagatgacacagtcttggcaccgagtctggcacagggtgagccctcgatgaacataggcttttataatgatcattaacattgttactcacgtgtgttctctcacacagttactgtcacatgaacttcctctcaccagcgtgctcagaaacacacacatgcacacacacgcacgcatgtacacacacatgcacgcgcgtacacacacatgcacacgtgtgcgtgtacacacatgcacacacgcacacatgcacatgcgtgggtacacacatgcacacacgtgtgcgcgtacacacacgcgcgcgcgcatacgcacatatgcacacatctctgccacaggcacgagcacattgtgcatacttgagttctttcatgtccacgttcagcttctatggctctgaggacagaagaataataatattaataatgatgatgataacgacaccaacaggtaacatttatgaagggcctttcttgactttgggtagagttttcatctgggccttttgtgggggcctgtgattggaagtgtagacacggccccacttctctctctctgggggtctggtcaccaggcagcggtgagctgagcctgttatcagccctcatgcaccgggctcccgggagctgggggcaggccacatggccctggctctccaggtccctgagcctggaggaagccctcgtcacctgacccagcaccactgcctgagcgcggacgccaggttcttgaggtgtccctttacctcccagcccatcagttccccactctgtaaaacactccttggtgtggctgtcttccccgcgtgagcgtggtgtggaagggctttggtgcagtgagctggtccccccgtggcagggttccacccatgaggaggtgggtcctggtccctccctcactgcatggcggttggctgagatggcattcccctgagtcccagcagctaggagggcacgcctgggccctggctggctccggggtgtctttatcccactcagagcatcggacttggtgtttagggtagtgaggaattgtcagggttttcagcaggtggggagcatggctggcctcgtgttttggacgctcacactggcagtctcaggtgggttttcatgcggggcgctataatgcatagctcagcgttctagcattgcatttgcgagttagaacaaatcaggcaacttagattcgctgagctctgaacaggtcacaggcgtaatctcatcactccccacaaccaatccttgaggtgggtgcagccaccacacttcacaggtgaggaaggtgaggctcagggcagtgaggagtaatttgcccatcatcaagcaggttccagctgatggcaagctgggactcaaacttgggtctctctgggcccagagcctgtggtgagtcccttccgccaccttcgaactgcaggcagcgaggcctactctgtgaccatttcatgagatggggaggcaagcctgcactctctgctgaggcagggaccacctgccatcttcagggggcctggagactggggtttctcggagaggagagaaggctggaatgagatgcctgatttccaaactctagaccttgaacctgtgccaggctagcaggtgaggcatgcagagtcccacatccaggaggtctgcagaggggcctgggaatcttctgtttaattagctttccagggagccaggcatggtggctcacacctgtaatcgtagcattttaggaggcttgcttgcgaccaggagttcgagaccagcctgggcaacatagtgagaccctttctctacaaaaaaaattaaaattagctgagagtggtggtgcacgcttgtggtccccgctactcaggaggctgaggtaggaggatcgcttgagcctgggaggtcaaggctgcagtgagccactgtactccagcctgggtaatggagagagatcttgtctcaaaaaataaaaataaaaaataataagctttccaggtgattctcctgcccagctgggagggggaacctctggagatggtccttgaggttctatccacccctctgactctggagtccattcagtaacttgaggacaagggtcacccagggcagtctccagcctcagaaatgttacccgattatcagacaggtgcagagcctgaagggccagggcactgggtcctgatgaacgggggctccgcctcctgtagtcagtgtgattcgggcagattacttacttcgcctccacctcctcatttataacgtggggacaatcttagaactgctctgtgcagtgccatcattgggctgatagatgaaaaggccattttaccaacgagaaactgaatactctcagaggcaaagcaattctacgaagactgggggaggtctggcccagaccccctgctcttcatcaggctgcgtccttccctctgctcccgggaacttccgcacgctgggacgtgctccgcctgctctggctaattaacatggactaacgaatgctgctttaggtaagtgggcaggttaatttccattgtctcactggattctcaccacgccctggagtagatggaaggagcaggcatttgctaccccattttacagaagagaagcccaagccccagagaagggatatgcctcaccaagcgctgcacagctggttcgctgcattctgatatgggaggaggacagagttgggggagcagcgtgccagagtcagtttttgggcagcggagatgagagtggcacccatcacggggtgggggtgccccaggcagagaacagggctgattctgcccttgcaccagacctccaggagtctgtgccactctgggcatcagcagctcccggggctggcagggctaggccagaccattggccccggtggggcagctggagtagactcagatggaactgattaatttatccgggtccctggcaggaaacagacagggagcagctggctggctctttggtgctccattaattgtgacaatgactttaaccccagatgtgacgctgtgctgcttggagcctctgacagcaaagcggggtgtggagcaggggtccttcttgggtcggggagactcggaagcctaaactctttcaggtgaggctggcgctccctggggcccctttggaagcaggaaatcctcccgcatggtccctggaggcaggcgcggtaggctgtgaagatgctgccagttcagtataatattagggccattcgtcaagggccttcccgtgccaggcctgagctaagcactttgcagaaattttcccattgcatcctctcaaacctcgctcaagtggggcctgtttgagtcccattttacagatgtgggcactgaggatcaagacgagattagatggaggggcttgggatgggcagaaaaagacttgagatgcccatgaccttctctctagtgcttgtggaataagcccagaactccacaggttctcagagcatctggtcatgaagcccccctccccctttaagcaataggatctctagttcaaggacaattgaaaaaggtcaaggtgttgcatgcgtggaggaaccaggacaggggcccagagaccaacccctccctctgccctcatcctccagctcctcctcagagccctcatgagtccctgaagtcagctcaacaagggactgctcctggccagccagtgctcagcagccgaggaagctaggactgtcccctcccctgtcttctgcagacctccacccttgcaagaaggtcctgcttcattgcagtgccaggttgacaggtaaactacagatgcccacacccaggagggctgggaaggggcctgggagtcttgcccacctggattccctcagctcatcaccctgcactgcctagtctggtggacccggggcacttgaggacagggagtgttcttggcatctttctttttttgagacggagtctcgctgtgtcacccaggttggagcgcagtggcacaatctcagctcactgcaaactccgtcccccgggttcacgccattctcctgcctcagcctcctgagtagctgggactacaggcgcccgccaccacgcccggccaacttttttgtatttttaggagagacggggtttcactgtgttagccaggatggtgtcgatctcctgacctcgtgatccgcctgcctcagcgtcccaaagtgctgggattacaggcgtgagccaccgcgcccggccaggcatctttctttctttcttgtttattctggtgaaatacacataaggtaaagtttaccgtcttaaccctttttaagcgcacaccttggtgacatgtagtgcattcacattgctgtgtggccatcaccaccaccactgccagaactccgttcatcctgcaaaacggaaactccacacccttaaacagtaactgccccctccctgccagcccctggcagccagcattctactttctgtctctctaaatctgactatctaggtactgcgtatacatggaatcctaactatttgttttttgtttctagcttatttcatttggcatgtctttaaggtgtatcagaatttccttcccttttaaggctaatactccgttgtaggtatatgccacattttgcttatctactggttcattgacgtacacttgggttccttctacgttgtggctgttgtgaataatgctgctatgaataggggtgtacaaatatctttttgagaccctgctttcaattctttgggatatatacccagaaatgggattgctagatcatatggtaattctattttaaacactttgagaagctgccatactgttttccacagcagctgcactattttacaatcccacccgtaatgcacagggttctaatttctccacatccttgccaacacttattattatcatttttttttaagagggagtctcgctctgttgctcaggctggagaacagtagtgcgatcttggctcactgcaatccctgcctcccaagttcaagtgattctcctgctgcagcctcccgagtagctgggattataggcacccgccactgcacctggctaatttttctatttttagtagagacagggtttcgccatgttggccaggctggtcttgaactcctgacctcaggtgatccacctgcttcggcctcccaaagtgctgggattacaggcgtgagccaccgcacctggccttattattattgttttttataacagccatcctaatgcgtatgaagtggtatctcattgtggttttgatttgtatttccctaatgattagtgatgctgagcatcttttcatgcaccatttggccatctgaatattttctttagagaaatgtctgttcaagtcctttgcccattttctaattggactgtttcttttctgttgttgtcgagttgtgggaattctttatgtattctggatattaatcccttatcagctacatgatttgcacatagcttcccccatttcctgggttaccttttcactctgttgagagtgtctggtttatttcggaatcactgatgcccagccagcaggcagcacagaagcaattaacactcaactttctcacatcctgggattcccttgagtgggacccaggccagcccaggggaacagcaagaagagcagggtggagggagtctgtggatcaggcaatcactcaacaagcagctgtgcaggagaggcggctgaaggatttgaagtgggggcaaggcatagtctggttcatatattagaaagattcctctggcagctgatatggaaactggacttgctgacttccccaggcaagttctcccactctaagaaagataggaggagccacagagaaatgagggcagagctttggcatcagacaggaccgattcccgtccagccattgctcgataatgacatgacctcagatgtgtggctcacaggtcagagcctctacttcctcatctcaagagttagtaaataacacttcccctgaagatcgtggccctcttcgagatcatgtctgcagggggcctggcatctagtagccaccaggaggccagctcctttgtctttttttttgccagcgtccccagcacagaacacagggtcattggcaaaagagggtgaggtgctggctctgctgtagtggctgtgttctctctgcccacagtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtgggtgagcgcgccatggcctgggcatgggtcagccggcagcggtgcttggtcttggcagggctgccagggtgtaaggggggacgtcagagcccacaggcacctgagtgacccacacagcccctgggaagatggataaacctccagtgttcctacatcaggaaatatgcgaggccacctgtgtccgtgtgttgggaaggacgtgggagcaagatgggggaggggagagggagggaaacagaccccagcgaggcggtgccttctgtgggaggtacagctaaaggcacctgtgcaattgggtatgctatgggattcctacccggattagggagtgataccatgggctaactcaggtcagacatagttctaagcactttgcgagtattaactcattgaatcctggccactacactatgacgtaggaactactgttatcctggttttatagatgaggagagacagtgaggcaaagcaacttgcccaaggtcatgcagctggggatggcagagctgggatttcaactcagaagtctggctccagagttggtgctcgaaaccgctgaacttctaacctgtagggtggagggaagtgggaccggggccctgggtgaatgagcacactgaggggtatgaagccagggacacccagggagtacagtctgggttgggcctgtccctggggccctgaacaggctgcttctgttcagggggatcttatcagggacctgtgtgagaagacaggcaagggccttgtggaggaggacagtgagaagagagcccctgggccatgacttagggtggcagctgtacccataggtgtgctgctgggttcctgtgtcggagcaggagcaaggcatgcagacgagggagcctaggcccaggtggtgtgcatgagtgtgtgtgtgcatgtgtgcgtgtgtgcgtaagtgtatgtgtgcatgtgtgtgcatgtgtgcgtgtgtgcatgtatgtgtgcatgcgtatgtatgcattgtgtgggcctgtgttcatgagtgtgtgcatgtgtgtgtatgtgtgcgtgagtgtatgtgtgcgtgagtgtatgtgtgcgagtgtatgcatgtgtgtgcatgtgcgtatgtgtgcatgtgtgcatgtgtgcgtgtgtatgtgtgcatgtgtgcgtgagtgtatgtatgcatgtgtgtgcatgtgcgtaagtatgtgcatgtgtgtgcatgtgtgcgtgagtgtatgtgtatgtatgcgtgtgtgtgcatgtgtgcgtgagtatgtgcattgagtgcatgcacatgtgtgcatgagtatgtatgcgtgtattcatgtgtgtgcatgtgcgtgagtgtatgtgcatgtgtgcatgtatgcgtatgtatgcatgcgtgtgcatgtgtgtgactatgtatgcatgtgtgtatgtgcatgtgtgtgagcgtatgtatgcatgtgtgtgcctgtgtgcgagtgtacgcatatgtgcgcatgtgtgcgtgaatgtgcatgtgtgcatgtgtgcatttttgtatgcatgtgtttgcgcatgtgtgcgttgagtattgtgcatgtgtgcatgagtgtatatgtgcatgtgtacgtgtgcatgtgtgcgtgggtgtatgcatgtgcgtgtgcatgagtgtatgtgtgcgtttgtgtgcgtgtgcgtgagtgtaccaatgtgtgtgcatgagtgtgtgcatatgtgtgcatgagtgtatgtgtatgtgcatctgtgcagttgtgtgcatctgcgtgagtatgtgcatgtgtgcgtgagtgtatgtatgcatgtctatgtatacgtgtgcatgtgtgtatgtgtgcgtgtgtgcatatgtgcgtgagtgtgcatgtgtgcatgtgtgcatgagtgtatgtatgcatgtatgtgtgtgcctgtgtgcatgtgtatgtgtgcctgtgtgtgtgcctgtgtgcatgtgcgtgagtgtatgtgcgtgcgtgtgtgtgtgcaatgtgcgtgtgcatgtgtgtgagtgtatgcatgtgtgcgtgcacatgtgtgcgagtgtatgtgtgcatgtgtgcatgagtgttcatgtgtgtgcatgtgcatgagtgtatatatgcgtgagtgtatgcatgtgtgcgtgtgtgcatgtatgtgcatgtgtgcgtgagtgtacgcatgtgtgcatgaatgtgtgcatgtgtgcatttttgtatgcatgtttgcgcatgtgtgcgttgagtattgtgcatgtgtgcatgtttgtgtgcatgtgtatgtgtgcatgtgtgcgtgagtgtatgcatgtgtgtgcatgtgccagtgtagtgtgcttgtgtgtgcatgtgtgcatgagtgtgtgtgcatgtgtgtatgtgtgcatatgtatgcatgtgcatgtgtgcatctgtgtgtgtgcatgtgtgtgcatgtgtgcgtatgtatgcatgtgtgcgtgaatgtatgtacacctgtgtgtgcatgtgtatgtgtacatgtgtgcatgtgtatgtatgtgcatgtgtgtgcatgtgtgcatgagtatgtatgcatgtgtgtgcatgtagcgtcagtgtgtgcatgtagcgtcagtgtatgcatgtgtgcgtgagtgtatgcatgtgtgcatgtgtgtatgtgtgcgtgtgtgcatgagtgtgcgtgcatgtgtgtgcgtgcgagtgtgtgcgtgtgagtgtgcatgtgtgtatgtgtgcatgtgtgtgtctgtatacccgtgtgtgcatgagtgcatgtgtacgtgtgcatgagtctatgcctgtgtgcatatgtatgcatgtgtgcatgagtgtatgcatgtgtgtatgtgtgcgtgcatgtgtgcgtgctttagtatatgtatgcatgtctgcatgagtgtatgcatgtctgcatgtgtacgtatgtgtacgtgtgtgcatgtgtgcgagtgtatgcatgtgtgtgcatgtgcatgagtgtgtgcatgtgtgcatgagtgcattagtgtattatgcatgtgtgcatatgcgtgcatgtgtgcgtgagtgtgcacatttgttagtgtctgcatgtgtgcatgaatgcgtgtgtgcatgtgtgcatgagtgtatgtctgcgtgtgtgcatgtgtgtatgtgtatgtgtgtgcatgtgagtgtatgtatgcatttgtgcatgagtgtatgtgtgcctgtgtgtgtatgtatatgcatgtgtgcatatgtgcaagtgtatgtacggatttgtgcatgtgtgtgaatgtatgtgtacgtgtgggcatatgtatgtgtgcgtgtgtgcatgtatgtgtacatgtgcatgcctgtgtgtatatgcatgtgtgcatgcatgtgtgtatatgcacgtgtccgtgtgtccgtgtgtgcatgtgtgcatgtgtatgtatgcatgtgcgtttatgtgtgcatgtgtgtatgtatgcatgtgtgtccatgtgtatgttcatgtgtgtgagtgtatgtgtgcatgtgtatatgcatgtgtgtgcatatgtgcaagagtatgtatgcatgtgtgtgcatttgtgcatgtatgtatgcatgtgtgtgcatgtgtacgtgcatgtgtgcatgtgtatgtgtgcatgtgtacgtgtatgtgtgcatgtgtgtgtgcatatgtgcaagagtgtatgtatgcatgtgtgtgcatgtgtgcgtgaatatatgtgtacctgtgtgcatgtgtgtgtatgtatgcatgtgtgtgcatgtgagtatatgtgtacatgtgcgtgcatgtgtcagagtgtatatatgcatgtgtgcatgcatgtgtacatgagtgtatatatgcatgtgtccatgtgtgcatgagtgtatgtatgcgtgtgtgtatgtgtgcatgagtgtatgtgtgcactgtgtgcatgtgttcatgagtgtatgtatgtgtgcatgtgtttgcatgtgtgcatgagtgtatgtgtgcatgcgtgcatgcatgtatacgtgagtgtatgtctgcatggtgtgcgcatgtgtgtgtgcatgtgggggagtctgtgcagccaggcaccccaagagtggggaacactaagcaagcttgtgtggacaaacagcaggtgtccagctgttcctggtcttggccaggcttctctccgtcgttttctttggtctcatgagtggctgggcacatggtggctcagccccccgggcacagtgaagcctggctgttgagatcattggatcccctggacagaggaggtgaaagggaggaggatgtttatatgcagggatcagagagacaagagcctgtccccagatacccttagtgaaaactggaacggggcccttgtcagctgctgggaatatgcttctagccctttgctgctactatacaggccctggggccacagtgagagggacctttagtcctcatcacccatcccccagcaggcaggcaggaaaggcccctgagcgctaataggactgggcatgacataggctgacagcctcaggtgataacaggtggggatggagtccagctggctccacttaggagccgtcttgcccagagatctctggggccaggatcttccctgcagccactaggccctttgaagcccttcccggaggctctctggttttctttctttctctttttttttttttttttttttttttttggagacggagttttcacttttgttgcccaggctggagtgcaatggggtgatctcagctctctgcaacctccgcctcccggttcaagcggttctcctgcctcagcctcccgagtagctagaattacaggtgcccgccaccacgcccagctaatttttgtatttttagtagagacaagatttcaccatgttggccaggctggtctcaaactcctgacctcaagtgatccgcctgcctcggcctcccaaagtgctgggattacagtcttgagctaccacgtccaactcgctctctggttttcttaagaaatctcatttcacatccccaatttctatgagtcttctcctgtcccgagctctaaaccccaaagcaccttctgtggcatttgcccatttctggatttgttctgccctctgcagcctggtttgccaggctccccaggccacaagctctcatggttactatcacagacagccctgtgtgtcagctttgcactgggaagaaaaacaaccaacacccctattgccttcacagctcatagcggggcgcatcacataccagctcatttgctcattgcagcaaggcaggtatcacaattccattttacagatggggaagctgaggtgtaagaggtagtgttacctgcttaggccttacagctagtgagagctggagcctgaagacaggtctgtattgctctgagccaggtacaggcttttagcgtctccctagcctgccccaggctgctttgtccgccagagctgcgccaaacctcccctcattcaggtggggctaatgaaggaccttagtgatgatttttcgtctttgatgtaatagttatccattctgctgagcatctactgtgtcccggcattggggatacaggtacagggagtccctgcctctggggacttagcaatttcttatccttacaacagtcctttaagataagtattatagtcccattttactgataagaaaaactgaggtccctcaacttaagtagcagagtagtgatctgatcccaggttgcctgactccagcaccttcaattgcttcctctgtgcacaaagccctctgcaaagccccacttccctcctccctggggtagcattcggatggatggttagcaactggtacagcataagtcataacaatctggctggttggccggtgcatacgcactcagggtcggccaccgtccccaagtctggatttagccagcgagtacaaatatgccaattatttgtcccaggtgaactgaaccacatctgtctgtaggaagaagacctgccctcctgtctttggggtcaagacctcgcttggaggtctcaggtaacgctgcagtctccctgtgtggcagaagagggaagcggagcccagagaggggatatgtcttgcccaattttctcagcacatcaggggtggggctctgagtggaaaccccagggcctgagtggcaggacctcacgggggctgggagaggccaaggccactcctatttcctggcactgctgccacattaataacaaataaaaagaaatgccaaagtggggttagggaattgcagcatattttgaattttacatttaaataataatacaacgtaattatgccagttgcaagataattacaggttttataaaaaatattaattcatagtgcactgcaggcagtgagatttgggaacggaaagcccgttttaagtcgcacaaggaaagacatttctcagccccgttggtggcttctttggctgcgtaacctcatttgggaaggtcagcacgggtctcaaactaaggcctttcacaaatgggagccaggtccaagagccctgcctggtccccctttctacccctggagaagcccttgacctctttggagctgcccggctccttggtggatggcctggggcaaaggaagggctgggaacagagtggggtacctttcctgggatacttgagatgtcttctgcaatctgggactgcccctgcccagcctgagggagtcttcaggagacctgctgaggtccatggggcccctgcctggtttgagaacatcctgatcccttctgggcagttctctcagcaaacagttaaggagaggaagggcgtggagtcagggggtctcagcttgcccagtcctgagcccttgtccttctagtgacaggagcaggggttgagagcctgagacccacagcaggggccaggcccccttcaacagctgccctccctgccttgggttttgcccttagaggtaccctcagaaggtggccaggcagtacttgattttgcagaagacagtatagcctgggataagggacccgccaggtcacatggctctttagaggccttgcttagattgcactcagacctcaagagacccatggaaaaatgtcagagccatgtggggttcgtccagtttaccactggggaattggaggcccagagaagtgaagtgactagcccaagggcacacagcgaggggtggttgatagaatctcacatctcccaactccttgcccagaggaagctccccacactccacaactccggatccagtgacctccccacaccagactgcacttcccagcaccccccgcaccctggttcaccccagaaagaggaagggcctctcagcgcatcacccagcggagcagcagctcagagtctgaagtcctggttgctgtccttcctgtcacctggacgcagaatataaatcacccttcgcggccctaatcatctttctataaatatcagagagtctcatttcggagggggagcaggaacagtgagctcttttgccttcctgactgtgtttaaaatctgatttagaattaatttcctttggttgtccaccagcggacaccttatttgtcaaatctccggctctttgcgggggagagcagagaggtggccagggccacaggcagctgctggcctgacaggcggcctgggcaaggtgccctcagcagggtcaggagcccctcctggctcgcggcccaacacccgggcacgtgcaggctccggaagcaccctgggtcgacaggcagggccgggccccagcccagagccactccatctgtctcagccattaattcccggcccagcctccaggtctctgggctccctgaggcctggtgattagtattcttattaaagattattttattttcattgcgtggattaatctggccttgacacattatagccatatgggtattagccgagtgtgtgagaactgccgactggtgagccacagcggcgcagccatctctcagctctgggacggtgctgggaggacggggggaaaggccatagctccagaggctcccccgcctgactgcacattctggctctgctgggaacctggggcaaggcattcaggctccctgagcctctgtttcctcttctgtcgaacaattgtaagaattccaactacatcaaattgttataacaacaagtgccaggcactgccctggcatgaatttatgtgtcttcactcatgtcatgcttgccatctccctctaaggtgggtagaattatgatctccaccttaaagacgaggaaactgacttccagcaccttgcctaatgtcactgagctcagataaagggggttagacgaggacaggaacccaggtgctacacccgagcttctgctcgggcctgacaaggaccaggtgggccctggaaagggtcagagacttgcagggccagccgtggtgctggcttccctcaggccccgcatcacgccatgaggctttgcctgtccgtctgccaatgccgtggaagctccctaagagcaggcccagctcttacttctcttgggtccatagtagaagctcagtaaatgttggggaaaggaataaatgagggagggaagaagcaaatggtctctgagatgctaatcgttgtggattggatcattacagtgaggattactgtcattcagctcagtaacaggttcaacaaatatttgctgacaaaatgcaaagcccttttctgatgatgccacccccagcggcccccggggctcagaaggagcctgtgcccaaggctgtgccccaggactgagcctcccggggggcttctgggaagaggaggcgagatcacagtgtgtcagtcaagactcctcacgactccgagctcctagacctgagctcagcccccaggcagaccagagccctcttgggatcctctggaggggagggaaagatgttgcaacaatggtgcgtattttcccccactctgcaacttacaagctctttctggctctgcagccttctagagtatgaagcaacttcagggcgttaccatttctcctgactccaggttttctctcaagtttgtagaattttacaaatgaacctggttttagcttttgtaataaagagatacgatcaacatccagagaagaaatgctctgcagtggcctgatgtctttgtaattgaaggttctctcaggcactgagttttccagaacaggatttagtggagagagaaccacagtgagcttcccagtggtccctgttgcaaaggacttcagttccatggacggagccgggagctgcctggctgggtggcatttggcccacctgaacctctggggtctctgcccagagcagataatggtgggatccattcaatttgaaaactcctgcctggagtttaacagcatctgcccagggctagcactggaccaggttctgggacattgagatgaataagggagtcgtactctgtttgcaaggatctgcccacgggggcctcccagtctagaaggagagtcagcactgacaagcgagtacagccatagtgttgcaggtggtgaggccaagcaggggccgcaggagcagggcggggaatggtcgtttctctgtgtgtgtgtgtgtgtgtgtgtgcgcacgcgtgtgtctagagttccagaagggacagtcaaaattaatcttaaaagaggagctcagtaggtggacagaggagaaaaggcagcccaggaagcgggcacagcctgtgcaaaggccccgaggcaggaatcagactgctgggtgtggggatcggccagtgctttagtttggcctaaggatgggggtgaggggcagcactaaacaaggctccaagtgggttttggctgggcagggagggatttgaacaccaggtttcattgtctaagccctggggagcctgtgaggcatgaaacaggcagtgactgagtgagatgtgcattttggagactccctcaacctagggtatccccctccctgcacagtggactccttattctttaggccacaactcaaatatcatctcctcctctgggaagtagctcctcccaccatttacccttccatcaccttagcccccttgttctctccctccctcctagcagtgatcccagctgagagccagtggctctggttcacagccctccaaggcccaaacaggcctggtccagagttgtgctcatgaacagtggttgactgaatgcatgatcacgcaggcagctgggtggggggaggcagggctggaagccaagtctgcaggctgctgtgggtgagagatgaggtagggtgtggcagtggctggagagagggtcagtcccagccacagtgacggggacagtgacagtgtgggcctgggaggggagaagcctgcgcttcttggatagtcaccctcccatgggggcttgtaaaacagaccccaggtaccggccctggctcttctaactcagctgtctgtggtggggccaggaatctgtatttttatggaggtggctccatgtctgcctgtgtttgggagcgatgggtcttaccaggtgtcccccccctttctagtcgcattcccagcacccccatccctggcctgcttcctcatcccacccaagtcagttccggggcatttgatcctcagccccatggccctggcccctaggctggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccccctgcaaatgagggcagcactgggcagtgtgaaggtctgcacctccgtccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagcacccttgagcccaagactgggccgggcccctgtgtttggtcctccaggcctcagagagccagttctctgctggtggggcaggggcgggtggctctcttgagccagaggccagtctgaggtggggggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgggcaagccagggtgctcgcctgtgcggagagggtgagggttagggcagcaacccttccatcaccatcatctttgatgaacttgttggaactgctgaatgctgagagctgccttacatgtgtatggtgtgtgtgcatatgtgtgtgtacccatggagttcgaatatctgattctgtgtatgccctggggccctgcagtgattgtgtgttagcgtgtgtctgtgtgagcagctgctcttacagacgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatggggggattctgcgcccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagggcccaggtgcattcatgcccacatgcttgtgcacatacacacagacacacacacccaccctccctccactgccctgcccagatctgtgcattttccacatgtgggacctgttggggcagaaaaggtggccaggtgacagcgtgggcacctcaggcaagtcgagtctggccccaggtcatggacacttgcgtgaagctggctggactctggtttctttccaaacccacagttcagtgcctttaggttctggaaagcttaagatcgtaaaggctgagcttttagtattctatacccttccgatgttaaaaattctcttctcttcaaattgtaagattctgattccaagatcttacaattctattttctgaagatttaagattctctgcctggaattctgagaactggaattctgaggccaggggtccccacagacccccatgccctcttggctcaaacccccaccccagcccctcaggcccccagccccacgtcctggtctcctcaaccaaggggtcacccctctctctccaaagtctttgtgctgcccagacagaggctcccatgcccagggttggggagcggctgcttggtgcacacagccatggggatacacggtgggcttctgggggcctccacttaattccacagtgcgtgctcagtggcattttgtatcggatccggcacagaagggtcaaggaatagatgtggctgcaaatacctgggtcacttacacacagggtggctgccgtgggcacccccgggactgtgcggtctctctcccactctgggtgagcagtaggatgtccagacccttggatcatggtggtcctgatgggtgggggggatggggtcccagggttctgtgcccagactctgacattgtggtcccggtctgatggcagagacacaaactctgcccttggggaggctacagaggatggagtagatgtggaccttatccttaaggagccctaaatatgatggggagcccttcccttggggagccccaggtctgatgataggaagacaggacagcccaaataaataaccactgccccatctgtcatcctctgccctcagggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgccccagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctctgtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaatcactcggatgatcattttccagaacagctgctacagctgcccttgggatagacttggctgcactggcttggaccacagtagtttatctatcagtttctggccagttggtgggctgaattcacccccggaacctctttcttcccaaactctggaggaccctgcccgtcaagtgacagcgtgacccaagagccctcctagggcagcttcctattaacagccaccctcacctgtgcccaagaccctcaggcccccacccaccatctcctcccaaaaccacacagccctggcctcgcagacaatatgcccaccacgtcacagaggaagaaactgaggcctggagagcacccagggccacctgacataggaagtggcagaggcagggctcaaacccaggtctgtgtcactcccaagtgaagcaggtccccccactctgaatctagggcatgctgctccctgacgccagggcctcagcccttcagaagattccctcattcgacagccctcgtggaacacccactaaatgccaagtgtggtgccaggtgctggcaacacagagagagagtgagctatgtgccccgtggtagagcccagccctggcccacctgtctctaggcacctgaggcccctggcaggctggtcccaagtggaggggagagcaagagaagttcacagcattcaggcagcatccgggatgccccaacattaaagaggaaactagaccctgccttgaacctgccttcccctccggtcaccagaccatttctcttcccatacgaccctctctgtccgtgcctggcgtatctacttcttcctctcctctgcgggacttctccatgtctttcctcacctcttcacagaaatcagcagccctgcgtggccacatccatgggcgcctcttccccctttcatttcctcctcctggaaacacttttctcttgctcgtgtgtcccagcccacgcccattttccattgacctgtgtggcctgtccctctctgtctttgtagccccacctcctttaaatggcctctaaaggccatgggtccctgggaatgtcctgggccctcctctctttcctgtgtgcccagatccatcttttctgggcggctgtttcagggcccatgactttgaattccacctttgtgctaacaacccccaactcgcggtcaccagcgaagacctctcccctaggacccagctgcccactcctgtctccattcggttatgtgaaaaacaaacaaccctgccacacctgcacctgccccgccctaggacatggcacctccagacccaagctgtcatccttgactctcatgcatgtcacatccatccccccctaaagccccagggacctcccttcaaaatgaccaactgacttccaccccccacgagtccatgcctggaccaccacaggagacccctcttgcctcacccccacaagacattctccacaccagtcctgagtgagctttaaaaatagaagtgagggctgggtgtggtggctcacgcctgtaatcccagcattttgggaggccaaggcgggaggatcacttgaggccaggagtttgagatcagcctgggcaacatggcaagaccccatctctacaaaaaaaattttttttgagacaatgtctctatctgtcacccatgctggagtgtggtggcacaatcacggctcactgcagtcttgatctccggagcccaagtgatcctcccacctcagcctcccaagtagctgaccaagggcacacaccaccatgcccagtgatttttttttttttgtagagatggggtctccctatatttcccaggctgatctgaaactcctgggctcaagtgatcctcctgcctcagcctcccacagtactgggattacaggcatgagccaccatgcccagcaccaccgccccccaagttttttagatgaaaatacatgagaacaagctgtcctcaaagcccttcacagcctaggctgagcgcacatgcaattcagacattctcatggcctgtggacccacacagcttcacccctgcctgcctctccagagcacctctttccctggctcactctcttctggccatgatggtctccggtgccccctccttgaacacactgggtctttccctgctgctaggccgtggcctggcttctccttcggaatgactcactcttcccctgacattcctatgcctggctcctctgccctggaagctcccccgaccacctcagctgaaacgtgccagtgcccttccgggccctgcagtggtcttctccatcacagacagcaccccttcctacctttcccagcaccaaaagaacccccattctcctgtttattggacgccctgtctcctttcctgggacagaagctcctagagggatgtcttgggcactgcagagttcccggctcctagccccgtgcccagcatgtgataggcactcaggagtcctagaggatcaagcgacagctctaagcaaatgtggaggactgtgctcaaagaccacctgcccctcctgcctcaccatcaccacttctctacaaccaactcctccctggagccctctcggacgcgaaccccattcccctcccgctctgggccctggtctcactctgtctgcccccatcccacagcacctcctgccttggtttttaagagacacaccctgtgtgtcccttgcaaacagtggcctcatcgaatcctcccctccccctggcaagtggtgctcactagcttcactttatagaaggggacctggtgtccgcagacagcaagtgactcacccagggtcccagctagcaagagagggagccaagtcccgaacccacgcctggctcccagactggtgggctttcccctggaccacacccttccagtgcaactctggagctgcttcttaatttctcatgccagaatcctcagcagcatttattgggcacctactgtgtgcagtccctgcccccagggagctcccggttgtgctggggatgcccagacatgagggaagacttagtcacatagggcagagagtcagaactcggggtgagcagaggggaggaggaggcctgagggctggaggggcagggaggacagggcagttccctctgtttggctgtggcgtggctgtgtctgacacctcctagcagcctccccacagggctgaccgcacctgagccaggagggagagatgcatgaagaaaggcatgggtgacgccgtcaaggagggaggggtgggcgggcaaccaagtgtgactgggagaatacttggggctcagctcacccccttccctcagcatccagaactgtcccaggtatgccctccaaacccaggcagtgaggggccagttcctccattctttctacacttctttctcctgacctttcctccttcctcaagcactcccaagcagctggtccatgccgggccctgggctggggagggaggctcaagcgtcttcttgtccaagccaaccccaacatcccagaccatgccaggccacgccaaccccaggggactgaccccaagtggccaccagcgatttgttgggagaactggagggtgctggctgtcctggggctggggcaggaccatcaggaagctgagcagggctggaaccaggatccccaggtggaacctgggaagggttgggagagaggccacgccttgtctcccctccgcccatctgacgggattggccgccccagccccgtcccaggtggtggtgatccgtcaagagcgggcggggcagaccagcgtctcgctgctgtggcaggagcccgagcagccgaatggcatcatcctggagtatgagatcaagtactacgagaaggtaccacgggcaggacggagtgggaggggctgggccagcagggcagggcccactgaccaccgtcccgtggcaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccgtgagtgcagggagggggcgtgggcgcggagcagcccaggtgccaggaccctggggtcggggggtggccgaggagagagctagtgcaggctgagccagtgccaatgcaggatttctgctctccttgccctaccaagtggggttgtcggagttttttatttaattgagacagagtttcactctgccacccaggctggagtgcagtggtgcaatctcagctcactgcaacctccacctcccaggttcaagcaattctcctgcctctgcctcctcagtagctgggactacaggcacctgccaccacacccggctaatttttgtatttttagtagagacggggtttcaccatcttggccaggctggtctcgaacacctgaccttgtgatccacccgcctcagcctcccaaagtgctgggattacaggcatgagccactgctgccagcctaatttttttgtgtatttaatagaaatggggtttcaccatgttgaccaggctggtcttgaactcctgacctcaggtgatctcccaccttggcctcccaaagtgctgggattacaggcatggaccactgcacccggcctctgtcagcatttgcacagatgaaaaaccgaggttaggagaaggacggtcgctcgcctgaggcggcagagatggtgacagccccccacacaccatggctggtactgagatgagtgtcagggtctgggaccagcagcatcggtctcacctggggacttaccaaaaatgcgaattcccagtcctcaccccagcccttcagaaactctgtgggtgggcccagccatttgggttttaacaagtcctcggtgatccccaggcactgtcacatttgggaccctctgacttcgaggctgtccctttcactctcctcctgccccaatctccagccggagtcagggtctcctgtatgtgcacccactgcgtggtggaggtagggcagagctagtgaccgcccacctggcgctccctgggcgtctgagtgcctccagtgcttgtaggcctggcaccccctggagaccacccagatgggaatcctgagccctccatcccatgtactgtgtggcctcaagtcaattcctcgagttctctgagcctctttccatctgaaaactgaagatagtgctggggtctctctggaagggacgtggggagggtttactggggcttgaaggtacagctctcagcacactccgtgttgtcactgtcaggataacagggaggacaggcatttattggctcagaggacacgcgactcttctccggtaccacagccacaagaagcagcggcaccagcattaggaagccgggcatccaggtctcacgaacttgaagaggaagcttagtagagggtggggtgggaacagaggaggaactggcctgcgccctgactctgggctggctcatggctctgggctccccactggccccagggtcacagccaggcaggctcagaggtctgccagacccctgggcccaaggccagggctgagagcctggtcccccaaccctggctttcccctgcagggccccgctatgacaccaggaccattgtctggatctgcctgacgctcatcacgggcctggtggtgcttctgctcctgctcatctgcaagaagaggtgggtggtctggcccagccacacccagcccctcctctcaagcaccgtacctcctgcctgcccccagccccaccgagccggtggtccccgtgtgcctggggctggctcacttacaaacacaccacctcatttaacctagtgacatgccagtgatgtagagattctgacctcactttgcaggtgagtaaattggggatcagagaggttaggcttcttgccagaatcacacagctgataaatgccagagctaggacatgagcctaggtctgtcaaactcaagcccatactctcagttactttgtcctctcccactccattttggagggaggtggagacaggatagtgtgtgggcttgggatcccagacaatgagaactgtaaggatcatctaactgatggagaaatggagacccagggaagagaaggggctggccaaggtcatccatgtagttggccacagaagcctcatctcccaatgcccccaccaagggtggtttcatataacatggggctaacagcattgtagactttgccaagagggtcaggtggacttgagggcattttgaggatcccacagtgcttgtgaccatcatggcggtcacagtttagctgggttgagagcctggagtcagggactctcccctgcagactttgtaaggagcaggagctgacctgtcaggggaaggggcatgaagagagaagccatgactcgttccctggttggggtcagatcccgggctagggatggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtggcacagatgggaaggaggaaggtgcccagtgaaaaaaccagagcccaagaggcagattccagggtgtcacagagacctggtgccccagagggcagcgccgttcatgcctcctggactctcagaccccattcaggatgctagagatcctctccccagggaagggcacacatttgtatgatttcggggtgggagtgcatatactcttggacaagaatccctactacggagagattttcaggatcctgtagagatcccagacaacaaggcgaatctggagatgcctccctccacgccccactcctgtgcccgtggcagacagcatcaagcatggtgctgattcccaccaggcctgggtgcagcctcagactcctccttaactactttttatttttattttattttattattttttattttttattattttttttttctgagacagagtctcactctgttgccaaggctggagtgcagtggctcaatctcagctcactgcaacctctgcctctggagttcaagcaattctcctgcctcagcctcccaagtagctcagattacaagcattcaccatgcactactaatttttgtatttttagtagaacgaggtttcaccatgttgtccaggctggtctcgaactcttgacctcaagtgatccgcccgcctcggcctcctaaaaagctgggattataggcatgagccatcacgcccagccagaaactattttcaatgaatcaaagttgacccttgtggcaaaaacttatttttgctacatccctactccagaacaatttagaaagatctcaaggactgtaaaagtgaccccagaaaatgacagacatgcccagaactcactggagactccacagccccatagaaaccccagagcgactccagagaccccactttcacttgggaaatacttatggggtgcgtgttgtttgctaccacatccagagactcccagagacacccctcaccccaccccagacccatcccaggcccagggaatgtcaggaaaaagcaatctctcctgggccccactgaaggccctcctcccgcccctcagcacccccacctgtcttcctgcctctgcatcaccccccgggaaagctcccagagccccagttctatgcggaaccccacacctacgaggagccaggccgggcgggccgcagtttcactcgggagatcgaggcctctaggatccacatcgagaaaatcatcggctctggtgagtctcaggggttgtgagggcggggccagcatggggcaaggtgggggcacccagggcaaggtgggggcacccagggcagagggagcgtgtgacccaggggtctggcaagcccagggggtccaagggcctgggaggctgggggagtctgagggtcccactgccctccctccacacctgcccctctcggggcctgcaggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggtaggtgccgggcaaagacagcctccccctgcagtgcccctcctgcctggagaggcctctgggtccatcccctcatccatcctgctctgccccacctgaccctgtcctcctggttcaggtccctgaatgactcggggtgcccagagcctgggaccccagtggaaacccaaggcaccctggggtttccagtgctggcacaggtcctgagatggtggtatgctcctggggtctctgatcagcagccctgagccccaaaccaagagccaccctctccctactgcccgcccaggccgcctggcaatgattgtgactgagtacatggagaacggctctctggacaccttcctgagggtgcgtgtcccacccctgcctcttgcatgggcttggggagggaggtccagtctgggtgctgggagatagtgcaaagccctctaagccccctccctggcttggacaccacaggccgggggacaggaggcaggtatagggaggaggtcttcgagttcagccagtcgaactgcctttcggcccccattgcatgaaagtccctctgctccatgggatcctgctgccctgcacacaggctgaggggggtgcctctgtgggaatccaggccccacccagctggggggcatgctggctgtggtggagacggctggattcccagctcctgcccacagtttctttgctgggtgctcttaggcacagagcttaacctctctgggcctccatctctcgttccacaaaatgggtaagcagtcattgctgccccacgtacctcgcagggttgctgtgagggtaaatgagaccaggagaataacccttaactgcaaagtgcttcagaagtagtggcgcacttggcaaattgcaaagcaccgtctcaactcgagagcatcctacagatgggaggtgttcctgttcacggaccaggcgcctcgccgggctttcctgaagtccaagccatgtccccctgcagacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacggtgcgtcgcccacactccttccggctagactggggagtggggagatggcgccggtggcacccagggcccaacaattctgcaagtagctgaatgaagttggcagtttcggggtggccctcaacctggggcacatcctgtttctcctcttcacgccagtgccttcctctgggaaatgggaacagccttgcctgcctttcctctgtcaccaggtggccaggggagaccccagggctggtccccacagtcactcaccaggagacttcaggagggttggaatctccccgaattgtacccagactccacatctgtctctaaagtttgcctaaaacccagctgttttcaaacacattccatggggatttggacctctctagaggtgccttaggggcagccttaaaggcaggagctgagtgcatgggggccagttttcaccctggccccaataggagccctcccttagcctctgtcccacagcctctgggtaaggtttcgcatggagaaaggatcctgtgacaacaaaagaaagaaggaaggaaaggaaggagggagtggagagagggagggagggaggaagaagggaaggaaggaagggagggagggaaggaaggaaaggagggagggaggaaggagggaaggaaggaaaggagggagggaggaaggagggaaggaagggagggagggaaggaaggagggagggaggaaggagggaaagaagggagagagggaggaagggggagggaaaagaaaggagggaaggaaggagaaagaagaaaggaagggaggggagggaagaggagaggaggggagggaagggaggaagggaaggagggagggagtgggggaggaaggaaggaagggagggaaggagagaagggacgagggagggagtgggggagggagggagggagggaggaaggaaggacaagaaggaaggagagaaggaggaaaggagggacggagggaaggaaggagggaagggagagaaggagggagggagtggaggaggaaggaaggggggatggagggaggaaggaagggagggagggaggaaggagagaaggaggaaggaaggagggaaggagagaaggaaggaggagggagggagggaaggagggaggcaggaaggaaggaaagaaggagggaaggaaaggagggagggaggaaggtgggagggaaagaagaaaggagggaaggaaggacagaaggaggaaggaagaagggaaggaaggaagggatgaggaaaggaaggaagggaagaggaaaagaagggaggaaggaagaagggaagggaggagaaaggagaaggaagtgggggaagagaaggaagaggaagagttagaaaacgactaggctgtggcccctgagcccccttggcttgtggctggtattggccgagcatctgcttgtaccaggcgtctcactccctccttccttcgtctccacagcggctcttgtgaggcctccctcaggacaggtgctctgggacggtgggggctgtgttgtccctctggactggaaaacaggaccccagtgtttagctctctgactcagacggctcgggggacaccctgccaggcctgggcagcccctcaactcttgtgtgtccgtcgcagggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtgagtgccaggccctggcagggccgcgggcggtggagcctcagggtgcagggagggacggctgagcccagcgctgatcccctgcaggtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgccttgtgcccaccccagctccttgaggcccagctgcctcccagtattgccccagatctgtccctgggacagtttggccctgacactaggaccaggcccagcctgggcccccggcccctgccctgccgaaccccttcctcagcctgcttcttctgggggtccagcctcccgaaccctctggccacttaccaagagcccctgtgcctcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccagtgagtgatgggtggggctggggccccatgcgtgtgggggcagggggggggacccctgccggggaggctacaggtccagatccatggccctggctgcgtgcgcggctcccagcctcccaggcccagctggccagcagcacccttccttcacagggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccgagcccaccccaggtcatgccagcggcagaggacgtgaggggctggcagcaggcagggcggccccaggcctctgccctcctctcgggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacgcctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacgccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatctttgcctgcgtcccccattttttccccatctctgaaagcttgacatctcctgttggggaagggccagcctcatactgagcacctactgtttgcatcccattcatttttctcccctctggttttctcatctgtctggggaggtaggattag

SEQ ID NO: 12840 - DNA, 7247 bp, Human
gattaatatactgccaaggggttcctgggtaaatttctatgcatttcagtttctttttagggaagtaggaacaatatctatcttacaagattagttctgagaacaatgtggtacataaggcgctggaattctttcaaaaatttataccctgacatttccaagagccatggtcacccttacaaaggagagttaggcatgcatttgtagacaagcaatatgacttttaagctagaaaagaccttaagtaacattcaatctaatcttattataaaagttaagtataccacaaaaaagttaactgacctctccaactaatgtgcagtcaagtaaagatagaacctggaattgagatgtcccattgcagtcactgtttcaccttgcctcaatcattgtagatttgcatatcataaacctgcagagacaatggtgtctatccctgggaagttttcattgtaacatgtgatcattattaccctggagggtctatctgattttaatttttttcccttcatacttggtctctctctatcgagtcagatttctttcattctaatattaggggaggggtggagatacgaagagaggggaaggattggttagtacaaggccagtcaaggtaaagatgattgcaataatcaccagaaatctctgcagaactacagaggcctcctgggactaattctgaagagctctgaccgaagtttgctttattttgcctgtaccaattctaccaagtagatgaattcagtccatggcttgcaggcttggaggtggaggtggagtggagagcataaattatatttctgcaggtgaaaccagagcatagtgagccgaaacccctttctacccaggtggcgtgaatgggtccaactgctactgtcccccaggacaagagagcaaggaggggcgggcaggatgggactaccttgagcctcccgcaggatgcctggcaactactttcttagtggtccttaaggtccaatcgcggttaaggcactaactaaactcattcttcagcctccttctctaagttctcctcgaatttgggtgcccagaagtaggctcacgatcctttttctgcgggagcacaatgtaggtcagatagcataaacgaatagctacttatgaacacaatagctactctgctattgcaaggtatccacaaccaccactacaaacattaacaccttgctttacttgggaaacaaaaaaaatcatggtcctattcagcagtttccccatacagggagcgtttgcccctcccccagtcaacagggctgttcatccctaggaagtgatttgagagttctccaaggatttaggcttttcactcctccaaagctttcacaacttctacctggcgggggtgcgtgggggggtgggggcgaagctaaaagttcctttgctgcaaagagcctggtataggcagaaacaccggcgcggcctgcagccccctaaccacagtgcgtccttccccttagaagtctggggaaagcaaatccctacgcccagccatcatttccactcttgcgttttcaaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggccgcgcggggcaccggcccaactcggaggggcggcggctgggccctggtggatggcagcgtcgccacacgccccctccccccagacccgtcctctaggccgggggcggggcggcagcggggacgcgaagtccccggttgcataaggcggggcgggagtttctggccgctggcgggcgccgagcagccgggaggggaagtacagggcgttccgagctggcgggagggcggggcggtctggccggcgcccgccggggccgcggggggaggggggcggaaagtccctgggcgcctgccaggaacactcagctcataataacctcgcggaaaacaccgcggcctcggcctccagaaaccccggccttgcgcaatcccccgcagcccgcgcctccctgggccccacgcggtgcactcaccacccctggggtttttccctctcttccccacaggttcctgcacttggccatcatccatgaagaaaaggcactgaccatggaagtgatccgccaggtgaagggagacctggccttcctcaacttccagaacaacctgcagcaggtgcgccgcttgcctggcccgggttctctctgaccctgggacgtagctgatgtagcagagtcaccccagatcctttctgaattcagggccactgagcactatttaccctcaccttttacttcacatcagcccacatcctagagagtgaaggaaattccactgatttggtgaggtctttatgacccacctggagcctctgctatttgccagccctccccacccccctgtctaggaggagcagcacccaaccaggagacacgggttgaggggaactcggggtgtgggtttggtccatggcttactttctctggtctctcttgcattcgtagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccataaaagaataggtgaaaggagtgagggttgaaacaggtggttatacttttttccttttgttcttccaggccacacgtgtctacacttagcctctatccatggctacctgggcatcgtggagcttttggtgtccttgggtgctgatgtcaatgctcaggttggtgcttcctgcctccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgaggtgagtctgtgaactccttcggcgctctaactaatgaggtgccattcccttcaccctcccaggcccctagagctgctccttatcagaggggtatctacataatgagtctctcaaatttctgtgcataaccagtatcccaagaatgtacctgccccccccctttttttaatagcttactctttttttaaagagaagcattaaaggcaaactccctcagcctgtaaagttcattatatttgggctatggagaatggagtccaagagttatttccagtagtggcctccccatcccggtagcttggcagagctccgctccggaagcttaacgtgtcttttttccccttgttttcagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgagttatcctgatcattttcttcaggctgccgtgggcctccggttctgaagttccatcctccggcagaggtggaggtggagcagtgtgagggaggaggtaactcccagcagcttctcacacctgacacccagcctccagcaaagctttgcaggcaccctgggcccagtgtgtgggagggaggctgttgcaaggttataggaaattaccaatctcaggcttggggtggaagcatgctgtttggcctgtggttggagacctctccattgtcattctgtcatcccgttgatttaaacttcctggaccctaattgccagttgaggaaattattttggccaagaagaatatgctgaattcatatagagctgggaaagatctcactaatacaggaagttcctaaggacataggctcagaaatgggactgcactgacatttgttagcagatgctcacctctgagcctcagttttctcatttattagctgggctgttgtgaaaattacataagacaatccacgtaaaatgcatagcagagcggcaggcacgtagtgctaaagaaaaacaagctgttacgcaacgttctttatgtcataccaggagaaacaagtccagagagaatgtcctgtctagggtcaccttgcaggagaaataggtggttaacatatttcatacgtgctcgttttggggtaaacatcttttaagagcattccatctcttaaatctatgtgttattggctgtagtagaaaagtaataaaggcttgaagggtcttatcagttcagtctactgattgtactggacgattctacaggagcaaatgtcacaagaaaccagtaatgtgaaacttggcttaggtgctctatcttgaggttttcatccctaaaatggctctcttgcctaggtagagagaagaataaagatgggtatactgaaagcccagactttaccgctatacaatataaaaaatctgcatttgtactctgtaaacatttttattaaatttttgggggatagggtctcactctgttgcccaggctggggtgcaattgtgcaatcacagctcactgcagccccaaactcctgggctcaagcgatcctcccaactcagcctcctgagtagctgggactacaagcatgcaccaccatgcctgactaattttatttgtagagacagggtttctctatgttgcccaggctggtctggaactcctgggctcaagagatccacccactatggcctcccaaagcactgggattacaggtctgagccaccacacccagccaaaacatttctgaggaaaaagtaaagttattgcattctagaaaatgcagagtagtgtataaatgcaattcatgtctttgacttatacctaagaaaaaattattacattatccctttcctgatccacaaacgatgtcaaagtcaaaagaatatggtcaccttggaccaaaaaggagccagtatttagtggtcttccacatataaggagtgttactacagactggttaaagccaattctgccccaattctttctctttcttttttttttttttttttttttttgagatggagtcttgctctgtcgcccaggctggagtacagtggcatgatctcagctcactgcaacctccacctcccgggttctagcgattctctgtgcctcagcctcccgagtagctgggattacaggtgcctgccaccacgcctggctaatttttatatttttagtagagacagggtttcaccatgttgcccaggctggtcttgaactcctgacctcaggtgatctgcccacctcagcctcccaaagtgctggaatttcaggcgtgagtcaccgcgcccagctctgctccatttctgtagccttagtccatccggaacccagcactggcggtccctctaccagtcttattctctgtcaaagtgcccgggttcttccctgaaattccttgtccatccccaagcacctcaacacaggtgttaaatgacctaccacaggaatta

SEQ ID NO: 12841 - DNA, 26274 bp, Human
acaaactttcagtccttaatgggaatccaagtcagggggtcataagttgagtgtcagaagagaaagattaaggaggtattattagtgccggtgggccaaacatgaagtctagacacattacttaatcattacattcattcatatagtaaatattcaccaggtacatatatactgagtgctgggctagtttctgatgatgcagaaatgaatggctttattgtcttcgtcctcaaggccctcatggtctagtgtagaagacagactgtaaatatttaccattcagtacgatgtgtgctgttgcagagcgtggcttgggcgctatggggaaccagagggcatggagcctggtttggaggggcagggaagactttctgaaatatgggagacaagtcgaagcctatctgaccaaggcaccatgcaggaggaggcgggacattcatggcacaaggccagcatggcagcagtgtgaggtgtgatgggtgtgacccattcaaggaactgccaggtgctccatctgaaccaacatgtctgagctgggggcctggcatgagggtcatgcagtcctgtgggtgccaaaacaaggtggttaattttatcctaaaaacaattggcatctactgaggagttttatttgggaagaggtaaaattaaattagaatgggcaatgtatctctggaagcagagtgaagggggagctggaggggcaagcccagaggcagggccaacactgagctgcatggtccctgcgatggacaatctgagcctgaggtaaacgggctgatgtgggactgacggatgcaaggtgacaggctgaggctagggaccgtcatcactcccagtcacactgcaagctgcagcagggtagagccacatctgatttgtccccagtgcctgaccagagttggggctcagtgtttgttgagtgaattcttactgcatggccagggtttctggtcctggcagctgggtggatggaggggtcatattgagaatcctggagtgcagtagtagccaggtgtgaagagtcaagcaggtctgcagcctgaggatcagcatggcagcaggagggtcctctgggagctggtcatgaatttgatatggaccatgggatggtgcccacttttgtttgtatcctggggtacagatcacagctccatgaaggtttgagctaggcaggtgagccacgctgggagcaaagatggtggtggctaggtacttgcttatccctataccaatcagcaggatgtgggtggggccagataagagaataaaagcaggctgcccgagccagcattggcaacccgctcgggtccccttccacactgtggaagctttgttcttttgctctttgcaataaatcttgctactgctcactctttgggtccacgctgcttttatgagctgtaacactcaccgcgaagatctgcagcttcactcctgagcccagcaagaccacgagcccaccgggaggaatgaacaactccagacacgctaccttaagagctgtaccactcaccgcgaaggtctgcagcttcactcctgagccagcgagaccacgaacccaccagaaggaagaaactccgaacacatctgaacatcagaagggacagactccagacacgccaccttaagagctgtaacactcaccgcgagggtccacggcttcattcttgaagtcagtgagaccaagaacccaccaattccggacacagtgctgagaatcatgccttgaaatctagcagctctgttaaaaactgagcaaggtgtacttcggggttgtgttgagaaggttggtgttcagctaaatcaggagggaaggccaaggaaaatcaggcttggcacctgtcaacaggtgggacccaatagccaagcaaatggtcctgcaaactgtactacccaacgttcacagcaaggattccaacttctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttggaatggaccttttcctttcttagcttgctgtagggattgtgcttcagctaagtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaatgtaagtaaggaaaaaggctaatctataatcagagaaacaaaggttgcagctgcctgtttacatgactcaggtcccatgatcaaattcccttaaggctcgaaatattttaaagttccaacagcttagattttgaattgcttattttcacagaatggacctgtgtaaggaggtatgtgtgggagaagattccagaaggtcttgagacactccagatgaaggttggtgtggggctgtgctgctggagcaccagagagtgaaaagaggcaagcgatttatagtctcatcaaatatcgacaagtttgggttttcctttagagttgggcagggcctggctggacttctttctccaccagtctccgggaggctcaaacaagttctgattttcaggttctgaaaaagctctcagggaaaaagcagcttccattctgttttttttccctttctgcattctacttcccttttatttttggcctggtaatttctgtcttatcagcttttagatgtccttgagatttttcttttctttcatttttttttttttgagacagggtgtaaaccaaaaactcttttattctttttttttttcttttgagacaggatgtaaaccaaaaataaaattctaagccccgccctccctgcaaccatctgaatggacttcctcctgggccagggtacttttaacctgaaagactggttcaggccatgatggaaagtagaggtcagacaggactcattatacctctctgatgagaagcatttacaatctattttctctgaagcctgctacccggaggcttcatctgcatggtaaaactttggtctccacaacctcctatcacagcacagacattttctttctattgagcccagatctttagataaacttaaccaattgtcaaccagtcaattttaaatctacctgtaacctgggagcccccaacctccacccaacaattcaagttgtcccacctttctggacagaaccaatgtatttcttaaatgtatttgattgacatctcatgtctccctaaaatgtataaaaccaagctgcaccccgaccaccttgggcatagttctcaggatctcctgagggctgtgttacaggccatggtcactcatatttggctcagaataaatctcttcaaatattttacagagcttgactgtttttatttgttaatgatctcactctatcgtccaggctggagtgcagtggtgcaatcatggattactgcagcctctacctccctgggctcacatgatcctcccttctcagcctcccaagtagctgagactacacacatgcgccaccatgcctggttaattttaaaactttttgtatagatggaggtcttactgtgttgcccaggctggtctcaaacttctggcctcaagtgatcctaccaccacagcctcccaaattggtgggattacagggatacgatttttattttatttttatagagatgggggtcacagtatgatgccctggctggtattgaactcctgtgttcaagcaatacccctgccttagcctctcaaagttctgggattacaggtgggagccaccatgcccagcctgggagaagacttttaaaacatattttgtttaggccagtcatggtgttgaggtcaggagttcaagaccaggctggccaacatggcgaaactgtgtctctactaaaaaatataaaaaacttagccaggcgtggtggcaggtacctgtagtcccagctacttgggaggatgaggaaggagaattgcttgaacccaggaggtggaggttgcagtgagtcaagatcatgccactgcacttcagcctgggtgacagagtgagactctgtctcaaaaaaacaaaagcaaatcatgttttgttgagtttgtttagctgtgtattcacaagttgattggcatctctcagcccatcccaaccccaccccggaatgctcttcccaggcttcctaacaggtattctcctttacctggattgcatttgtagaaaacactctgcttcagtgggaggcaaggaacagaatatttctctgtctagggcatactcttccatgttatctgattccaattctatgggacctattttaccattctgaaagctacagataaccgatagaaatgaaaaataattcttgtctatggatatgcaaatgcttatattttgaagagagacaacccttcctcacttccccccaaatcccctagtttgcttccattttacacattcatttcaatatttctcttctcttccttcttttctttttttttaggttatctccctctgtgccaggccagagtgcagtggtgcaatcacggctcactgtagtctcaacctcctgggctcaagagatcctcccacttcagcctcccaagcagctaagactacaggcacgtgtcatcatatctggcaaattaaaaaaaaattatagagatgggctctccctgtgtttccctggttggtctcaaactcctgggctcaagtgatcctcccatcttggcctcccaacttgctgggattacaggcatttgccactgtgcccagcccatttcaatatttctgatcaataaatgtgcctgtccttcagattctcctttgaattggctgtcacacctcttcagtttcttcactgaggagttaaacataatcttgagcagcacgtgatattgtttagctctgtgtccccaccaaatctcatcttgaatcgtaatccccctgtgtgtcaagggatggacctggtaggggatgattggatcatggggggtggttttccccatggtgttcccatatagtgaatgagttctcacgagatctgatggtttaaaagtgtttggcagttcccccttctctctctctctctctctctctgtgtgtgtttttctctctctcgccactttgtgaaaaatgtgctcgcttttccttcgctttctgccatgattgtgagtgtcctgaggtctccccagcgatgtggaactgtgagttaattaaacctctttcctttataaattacccagtttcaggtagttctttatagcagtgtgcaaatgggctgttacagcacatattcatttttatatctatattgagttatcatttaacctgtttttgaaaattatcttttaacatgcatttttctctttcttattatcttcttttgctaaaacctgttctccagtagcttcctaagaaagggtgcacaggagacccattttttgagcccctccttatctgacaatgtttttgtttgaccctaacctttgattaataatgcgactggatgttgaacttgtgaaaggaaaataaaaactcaggaccccaattcagtatgccaaaaggaaaaaaaaaaaagaagctgaaagctgagtcatgcaagaaactgccttttcttttgctcctaagtagatggctacagataaaagattaaatatctccacaggtagctactccatgttcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctgagtatctggggcaacaggcatgtgcaactatggctggctaatttttaaattttttgtagagatgtgatctcgctatattgcccaggctggtctcaaattcctggcctcaagcaatctttctagattataggacttcttggcttccacaattgcatgagccaatcctttataataaatgtatatccatctgtatatgtcttgtgtctgtctctctacctatcaatctatccatccatccatccatccatccatccatccatccatccatctatccatccatctatctattttattgtttctgtttttctggagaaccctgactaatacagaaggtgagcccaacttctcactgaggattctcaagcctcagcctcttgaagtgctgagattacaggcatgagccaccgcattcagcctctgattgtcattgacagtgatgtgctctactgtgagtctcttttacccactgtgctgggtattcactggccctttcaacttggaaacgcgtgtcctttggctttgcaaaaatatctgtagcattgattgcctgatttctctccctctgatcagggcctctgcagcatccgactccagggcactgttcaccccatattctatgaatggcgtcctctggagttgtgctgttgcacctgcaccttttatttatttattttggaacacattggagtaagatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttccccaatttgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgggcaccatacccttgaaggcttgaatagaacagaaaggcaggagaatttctctcttggcctgaacacttgagctggaacgttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaacttcttgttggggatccccagatatcagcgggcagagtgtctccttttggcaccttcagtttctccagaaatgaacctttccatttccatcctaagggattgcaagagctgtggacttgccaggagggaagggagcagaggcccccacagttcacaatgtaatgtttcccttaaacacagcccccactttcagctgggaacccaccctttccttgccggtgctttgtgtcctcaagactggacataaggtgttgaggtgtggtgtgtggtttcaccacacaatcatttggggtctcctgagagaggtggggggaggggtgtggtctgcttgagcaggtgagggaaatggattggggtgctagctggtaactgtatactgactttcttttgtagaggcagggtctcattctgttgcccaagttggagcgtagagtcatgataacagctcagtgcagcctcgaactcctaggctcaagcaatctacctgcctcagcctcctaagtggctgggaccacaggcatacaccaccatgcccagctaatttattttttgtagagatggggtctcctatgttgaccaggttggtcttgaactcctgggctcatgtgatcctcctgcctcagcctcccaaagtgttgggattgcaggcgtgagccacggtgcccagccagtatactgactttcagtcaacctcatgctttcagtgccagttcttcttggtgcctgatgattgcaaacccaggatttattggagagtctctgttcttgatgcccaccctgcccctccactttcccacacccccttcacctttaccatacactgtcctcaactcttctgaggctgctcccaagtgttgggtgctttgatcctgtctgccattgcctgagctcctgttctctccatccctgtgggtcaacagcttttatttagttcattcccttactatcattttcatagagttgaggaggtagggaggagatagaggcaggaagttattctaccacatttgtccagagtctgccctgtttgggggcatcagtgggcagagctggaaagccatggtggctgctgagatttggaagtacaagaccaggaggaaggaaggaggatgcttaggtatggggctcaggtgtggggttcaggtagcccgtgcatggtgaggaaagggaacaaatgagaagagtgtggtagatggtggtgtgttctatctattttgatggtgggtcaaaagagggaggtgaggaatgggttgagaggatttggccccactttgaatgcagggcgaggggaaaccagcatctcagatgtgcctcagtttgtgcagggctaagtgggacccagagcaggaggggcagacttggacgggaggccagtgactctggagtttgcagtgaatatgcagggtcctgggtgtgatgcttgggttgtttatctggcctaggggaagcgaccagaaggcacgtgcctccagtccagccaggctgcaggtgttaaaaatctctgcagtcacattttctggcttctctgaacagcccctgtaggtgctcacacatgtacacatgcatgcatatatatttatatatatatacatttacatatttatatatatttaaatatatttaaatatttaaatatatttttatatatatttatattttatatatgtgtatgcatacacatgcacacagatgtacacacacatatgcacatacacatatgcacacacacaccctacaactcagacctttcctttcagagctacccctgaccgagacttccttgccatgttacaaatgagcatctcttttagagtagtgtaatagaacgtggcacttcttgataaaaatagaattctttgacttctgcccaggctgcctggtgggcaggctcacagcctcgttctttctcagctttccacgttattaatttttagtgccaaaagacagttctgctgctccaggcctccagctgagctctgctaggttggaagtcccttctcagcctgattcccattagcacagagcttggagaagacccttcctcactctgatcctgctgcctggagctggcagatgcactcctcacccagcagccaagacccatgctcctggtttagaagggtccgtcctgacagctatctccactaggcagcccagggttcctctggacacaggaccctgccaatttattagtcacggtggcaccggatagacacagcttcacccagtgatctgccggcactgctctctcttcctccagtcctgggcttcttcatgtccaaaccacgtggagaacaagataactaggatcagctcttttggagatagaagtcaccttccagcctgggatcagtggcatagtctcagcccaggtctggagacagggaggctgccatgcctgccagccccatccagccccagctggcagcagtgtgaaatagtgctcgctaaaatgagcctgctgtttgcctagatgtgtgtttcccaataattcagagacctagataatgggaaaggcgaacatctcgtatcccccacttccctcagcaaaaagagaacagtgccgcagccacaggcaaggtgggttagaaaacctgtctgctggcagattattgtctgtaacttgcctccttagttcttccaacactctctccttccccctcctcccctcccatggtccaaccctgagggttccagcagcagctgggaggtctccgatgttatctcagagctcccaatctgctgacatttgaaaatcttctggctataacttgctcacttagcggctgctgctctgcagccctgagccctcctaaaggagaccctacacagaagagtacaatgtaaacagccgtcgccagagtccccccagccagagatagcccttgggtacattttgcaatattttgttttgtttgctctcagaccggacttgcccccctttttagcacagcccaattctactacgtatactccctccttgttctttttgtttggcattatatcctaagcatttccctgcatcatccaagctctgtgggatgtcatttttaacacccacacagcgtcctctggtgtggttgtatgacaagtcacttaactattccacacccaaagcctccccttttccaaactcttccctgggacctcctgaaggtaacagcaagatctgagcagcgctggatggatcctgctctcagtcccctgtctgggaacaacgctgagccttaacagggatgtcagcttcctagggctgctgtaacaaatcccacaaactgagtgccttcaaacattgtctggtagttctggaggtcaaaggtgcagaacgagtttcactgggctgaaaccaaggtagggctgtgctctctcctgaggctttaggggagaatctgcttcctgaacttttctagcttggagagctgcattccttggcccttcgtcccccttgcttctcttccaagccagtagtgtagcatcctcagatctccctctgctttcgtcttcacgttgcctttccttttctgcagtcagatgtccctctgtccctcttataaggacatttgtgatgacatttagggcctatgtgggcgatccaggatcatctgtagatctagaacttaaacttttttttttttttttttttttttagatgtggtctcactctgtcacccaggctggagtgcagtagcaccatttcggttcactgcaacttctgcctcctgggttcaagcgattctcctgtctcagcctcccaagtggctgggattacaggtgtgcaccaccatctccagctaacttttttgtatttttagtagagacagggttttgccatgtaggccaggctggtctcgaactgttgacctcaggtgatctgccttggcctcccaaagcgttgggattacaggcgtaagccaccgcgtccggccacattattcttatttgcaaaacaaatacttatctggcatcaaacagatactttgcatccggcaaaaacaggtggaggtgactgaaggcgaatgtgggaggtcatggtgggttaatgatcgccagcgctgtccggtgaaatcaaccacctgtgacaaaggtggtttttcacttttactgaacaagcatgctattctacagtaaactccttaacaaatgtagcttttcaaggtccttaggactattacctttcaatattattgggaagttctttgctcttcttagcagactgcgaaactcaactttgtgatgacaagatacagaataaatgcatattaactgaaattctaggctcacacctatgtgagcttttctctctctaacaagatgtcagggccggttcagggagttcatctccagccacctgtgctaatcatcgcccatcctttccaagtatctaatgacactcccaaccaaggtctctataatttccagccaaaaatgagttacaacatatggaacatctaattttctgtttccattctagttattttattcttatgagcttgtgggctccatctaccaacctctgggcaaatgctcatctgacttccatagacacacagcaagcagacaaccacacaaagaggaagagggagaatatttaccagccatggaacatctgctctgtgcttatatctcatatgcattatctctaattatcaaaagaaggtattattattattattgttccgcattcacagatgacaaactgaagatcagattggttaaatacttgtccaacattaacttagcatttgggcatcatagttggaattaaaacttgggtctgctcatctccaaaaacaccctaagccttaccacactcatgggacacagctgcagctgcaggttctgaaaggaaaactaaaacttcagaacccagttcactatgccaaaaaggcaaaaaaaaaaaaaaaaaaaaaaagccaaaagctgagtcatgcaagaagctgactttccttttgctcctaagtagatagctacagataaaaggttaaatagctccacaggtagctactgtatgttcaccttatcttacgtaaactgctgatttattgagcatgagacaaatacgtaattgactatcccctacctactccgtttcctttgcaacatgtggattcagtcatgtgaccatacactgcctttctcctctccagcctacttttccactttaaatatcaaagccctcaaaatcatctttggagaaaggcacagactagcgactgtttctgtgatttcgtgtctttttacttccagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgcggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggtgaggcctggaggtgatgtgcttgagattaccaggctcttctgaacctgggggaccttctcctatgatagccctgctcctccagacccagcaggtgatttccccaaaagccgcttacagtgaacgcacctgatagcaataacttaagcatcccctgagaatgacccttatggcaggtgcaggtgaatgtggtttggagttctgagctaaggaatctgggagtggccaacctggagattcattcctattccttatctatgaggaacatctgagctcctgtcccgtcctgtgcaacacggacagtacaggggatcaaggccctttgttttgggttaggtaaatgttgccaggtggacactgttgggggagggtgctaagtgaagatgctatatatgctgcaagctttttgtaagttgtgtggctctcctgcccagcccaccactgctagatgctctcccctgcatgtaagccccagtaaaactccatgtctccttcagcagccctgggtcctttcttcagcctctcaaacctgctgccatccccattggagtagataggggttcagcataacagcagccaccagctggggaaaggcgtggcatttggagctccctacatggtcttgactctaatatggagggaaagaaaacagattctgccctgctcagtaaagccccctactggcctcccaccctggactgtggacaaagcttttttttttttttttgagacggagtctcactgtgtcccccaggctggagtgcagtggcgtgatctcagctcactgcaagctccgcctccccggttcacgccattctcctgcctcaggctcccgagtagctggggctacaggcgcctgccactacacccggctaattttttttttttttttcatttttagtggagacggggtttcatcgtgttagccaggatggtctcgatctcctacctcgtgatctgcccacctcggcctcccaaagtgctgggattacaggcgtgagccactgcgcccggccaacaaagcatatttttttcctctgaggtctttaccctataactgcaagtggtttcatgacactgcacatgggttcttatctggggttggtagattcaactcaattccacaggtttactgggtgttgcctcccatgcttggagccaggaggatgcagggaaatggggctgccaccatacccgctcttcttatgatcccatcacatcattgcaccctttggggcctggcaccatgctctggcactttgcctccatcatctcctttaacctctgagctctgtcaggaaggcattactactatccctggaatacagacaggaaaactgagttggattgaggctcagagaggttaagtcacttacccaaggtcacaaagctagagagtggcaggccagcatccaaggccagcaacacgagctccctctgatccaaatggtgactctatgtttgatcagtgctctgagaactctccaaagatctttatcaactgtcatctcttcattgcccaggcccagtcagggagccacttggctgcggtcccgctgagatttaggggcaggacccctgatgtgaggtggaatgcttggtcacgctgttcaagcctccaccagtcactcctgactggttatggacactcaatgtgccccgtcctgtgtgcaatgcagtgtgggaaggggatcaaggaccttggctaatcccaggcatttccccagaatgtcccaggtgtggaccccttgggaggtgctgggaagcaggctggtgtcccacaggccttggttccatcccagctgtgctgtgctaagctgaaactctttgggcagcttgtttcacctcatgagacttctttttctgaactgttaaatgggatgattcgacctctgcttggcttttggtgacgattaaacgagatattagctgtaaagcatttcatcccgggtctggtatagaagaagcacttgataaatgaaagctctgttgagtatgatgatccgtcaccccaggcatcagtgggatctcacagcaggaacaatgcctaactcctaactgatgcccagtaaacatcgggtggatgcaatgtccaacaagacagatattcatgttcagttttacagaaaaggagacagaggccagaaaaggaagaaagtgcccaggtcagccggctagtaagaggcagagttgaaatttgaaccgggttctggctggctgcagctccactgctccactactgcactgtctgagagccaaaaggcaccttgtagtcaggcaggcagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggcctatgtctgcacgtggtgaggcccctgctgggtattgtaccacaccttcattgtgctcagggtggccagtggaggcccttcccagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggctataactgctgcaaagatagagaattgcaatgattaatatgcatttatgtatttccaaaaagttaccagaatatcaaactcatgattttgtctatagtttggttagattcaagctatttttatatcataaaacaacttaaaatttttttatttttaatttttgtgggtgcagagtgatgtatttatggggtacccgagatgttagaatgaagctattaaatgtgagtgtgaacgttcacctttttgcagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatgggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaatttctttgggctcttattagcagcatccaaatctgtgctggtttcttctcacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcccaggggctgtctaagggctcatctctcccaggagcccctgtatcatctcagtaactagaccagtaccatatccgacttcccctgactttgaaataattttcacctgcaatcaggtgcgcttccctagaacctctctcgctgttctttgcctttctccttcccccgccttgtatctccgtggtcctgccaaaaatcagaagctcattattaaaccagaagcttccttgcattatcccagagactacagacagaaaatatttgcttctatctcaactgaggactgacatagtaaagactccttgagatgttagctgtcaaggaggggaataaaagtttttcatctgcatgagtaattgtttcctgttttatccagagagacaacagatttacatcccagacacattcacactgggccaagagcagctgccattgcagattcgagtcacgtccttttttccttccttctccttcttggagttacaacagaagctggggaggtgagagtgcaggtgagagaggaggggggctctggaacatgtagcctgtgaggagggaaatcaggatggtgcttgggtggaggtgggagctgggccagggtcttggctggtcaggaaggctggtgaagcatgtactggggaggcagaggtcctgctttctttcctctctttccttcacacctacctcaacccactgtcgagtcctatcagctctgaaatagatccttcctccagcgccttctcacctctctctccaccattccagtccatgccgcctcatctcttactgggactttcacaacagcctcccgagtggtcttggcttctgctcgcaaatcctgcagtgccttctctgcggagccacaagctggatctttttaatccgctctcggtttctcacagcccttggaatgaaaccttggcctacagccctgtgtgacttgctgcctgtccttacctcctaacctcatctaatatccccttcccctcctcgtaccggcctttctgtttctcagacactccaggcttgttctgctcttggaccttcacgctgtctttctgtctcctgggaatctgtgccccctctgccagatcatgcagctggctctctctgcccaaataccctcttccgaggggtcttccttggccctgtgtctgacataggtaccctcctccatcactccagcccattacagtgccataacacttttattgccatctagagtaacatcagttggttttgtttatcatctgccaccctgctagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggtaaatttggtatcttagcaagtgggtgactaccactgtctgggggaaagctgatacacgaggacttgacaataattacagcagtaacaatcgctactattttgttttgaaatgaattttagtttctgaaattgtccaaagcacttttatcaatagaaacttgttacacatccctccaacagggagaagcagcacaggaagctgccccctcaaacactaaaggctcctggagctattcacagtgctggggaacaaccagaggaggaggaggacagagggagagaatactttttttaaaaatcccaaacaaaaccaaattctatacatgtatatctcgagtgagtaaatgtgtaacactcagcagtctcctacacttgccaggttttgtggcttcatgcagtaatataaaatgtgcttcacaaagctaggagttggcacagaatatagggttctgattcatattttagttttacttttttgtagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcacacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactagtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagtccagctaacatactatataagccagtgagaccagccagtgtctgttcattgcctctgccttgcccctatgcctgcccgcctcctatagcaggtccctatagcataatgaaaatgcgaacaaccttttctctggacactggggaatctagtctggtggataaagatggatggctgttaaacgatcacatcttgggctctgtgtgttcagtgaagcctcatttaccagatctctctgatgagaaaggtgaatggtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttactgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttacaactatacaaagtttgtagtcttttcgttataccttttgacaggtgagttacttgctggaattcacgtggctagtaaatactggagctgagatttgaaagcaggcaatctggctccagaatctgtgttttcaacccacatactatattgaccatcatgaaaagatggtggtgagcaggcttgtttctaaggatgggagggtcctcataatatttgtatttacagagaggagggagaggtgggttacttcctctcccaaccccagaaagccaggcatgttggctggcatccctgggacctcagatattcaagcaaccatggccttacaaatcaggcattctatttattagagttgtgcagtgaggtcccctccatttcatccccagaatatctcctagacaagttggatcctgcagggcccgagtataaataagatggtgccctctgttgttatggagtagcttggagctgggccccagatgccctgtgtggattagatgagtgattagtatttggcaatgtagcttgagaggcttgctgagttactggggcatatgtccccagctcacgagtaccagcctgacttctgtcaatcaatcagtgaacagggtttgcagcgtccaccaggtacctgtggtgtagtagaagagagtttgaactttggaatcaaacatgctgaagttcagattccagctcctccactaactacctctgtgatcttggctaagtgaccgtcactttttttttttttttttttgagacaagatctcattctgtctcctaggctggagtgcagtggcatgatcatggctcactgcagcctcaacctcccgaactcaagagatcatcccacttcagcctcctgagtagctgggaccatggggcacctgccatggcatcaagctaattttttatcttttgtaaagatgggatttcgccatgttgcctaggccagtctcaaactcctgggctcaagcgatccacccacctcagcctcccaaagtgctgggattacaggtgtgagccaccgtgcccatcctgatggttgctttcagagccttggttcttcatctctaaaacaaagataggaatactgcctagtttccatggggagcttgtaacacatgcgggcctctctcccctcaccccagtctttggttagacacttactatttgcaaagacccaatttcttcatcataagaaggctgccaccacacttgagggagtgacccatttacaaacaattgcttccttct

SEQ ID NO: 12842 - DNA, 24671 bp, Human
acaaactttcagtccttaatgggaatccaagtcagggggtcataagttgagtgtcagaagagaaagattaaggaggtattattagtgccggtgggccaaacatgaagtctagacacattacttaatcattacattcattcatatagtaaatattcaccaggtacatatatactgagtgctgggctagtttctgatgatgcagaaatgaatggctttattgtcttcgtcctcaaggccctcatggtctagtgtagaagacagactgtaaatatttaccattcagtacgatgtgtgctgttgcagagcgtggcttgggcgctatggggaaccagagggcatggagcctggtttggaggggcagggaagactttctgaaatatgggagacaagtcgaagcctatctgaccaaggcaccatgcaggaggaggcgggacattcatggcacaaggccagcatggcagcagtgtgaggtgtgatgggtgtgacccattcaaggaactgccaggtgctccatctgaaccaacatgtctgagctgggggcctggcatgagggtcatgcagtcctgtgggtgccaaaacaaggtggttaattttatcctaaaaacaattggcatctactgaggagttttatttgggaagaggtaaaattaaattagaatgggcaatgtatctctggaagcagagtgaagggggagctggaggggcaagcccagaggcagggccaacactgagctgcatggtccctgcgatggacaatctgagcctgaggtaaacgggctgatgtgggactgacggatgcaaggtgacaggctgaggctagggaccgtcatcactcccagtcacactgcaagctgcagcagggtagagccacatctgatttgtccccagtgcctgaccagagttggggctcagtgtttgttgagtgaattcttactgcatggccagggtttctggtcctggcagctgggtggatggaggggtcatattgagaatcctggagtgcagtagtagccaggtgtgaagagtcaagcaggtctgcagcctgaggatcagcatggcagcaggagggtcctctgggagctggtcatgaatttgatatggaccatgggatggtgcccacttttgtttgtatcctggggtacagatcacagctccatgaaggtttgagctaggcaggtgagccacgctgggagcaaagatggtggtggctaggtacttgcttatccctataccaatcagcaggatgtgggtggggccagataagagaataaaagcaggctgcccgagccagcattggcaacccgctcgggtccccttccacactgtggaagctttgttcttttgctctttgcaataaatcttgctactgctcactctttgggtccacgctgcttttatgagctgtaacactcaccgcgaagatctgcagcttcactcctgagcccagcaagaccacgagcccaccgggaggaatgaacaactccagacacgctaccttaagagctgtaccactcaccgcgaaggtctgcagcttcactcctgagccagcgagaccacgaacccaccagaaggaagaaactccgaacacatctgaacatcagaagggacagactccagacacgccaccttaagagctgtaacactcaccgcgagggtccacggcttcattcttgaagtcagtgagaccaagaacccaccaattccggacacagtgctgagaatcatgccttgaaatctagcagctctgttaaaaactgagcaaggtgtacttcggggttgtgttgagaaggttggtgttcagctaaatcaggagggaaggccaaggaaaatcaggcttggcacctgtcaacaggtgggacccaatagccaagcaaatggtcctgcaaactgtactacccaacgttcacagcaaggattccaacttctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttggaatggaccttttcctttcttagcttgctgtagggattgtgcttcagctaagtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagccaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacattctatcccagacaatgtgatggtcatgaagtctctgtcagagaggaaagagggagttaatctataatgaagatcaacagtgaagaggaaaggggtcttccctggaacgcttcagtcatatacgacattttacacaacaatgtaagtaaggaaaaaggctaatctataatcagagaaacaaaggttgcagctgcctgtttacatgactcaggtcccatgatcaaattcccttaaggctcgaaatattttaaagttccaacagcttagattttgaattgcttattttcacagaatggacctgtgtaaggaggtatgtgtgggagaagattccagaaggtcttgagacactccagatgaaggttggtgtggggctgtgctgctggagcaccagagagtgaaaagaggcaagcgatttatagtctcatcaaatatcgacaagtttgggttttcctttagagttgggcagggcctggctggacttctttctccaccagtctccgggaggctcaaacaagttctgattttcaggttctgaaaaagctctcagggaaaaagcagcttccattctgttttttttccctttctgcattctacttcccttttatttttggcctggtaatttctgtcttatcagcttttagatgtccttgagatttttcttttctttcatttttttttttttgagacagggtgtaaaccaaaaactcttttattctttttttttttcttttgagacaggatgtaaaccaaaaataaaattctaagccccgccctccctgcaaccatctgaatggacttcctcctgggccagggtacttttaacctgaaagactggttcaggccatgatggaaagtagaggtcagacaggactcattatacctctctgatgagaagcatttacaatctattttctctgaagcctgctacccggaggcttcatctgcatggtaaaactttggtctccacaacctcctatcacagcacagacattttctttctattgagcccagatctttagataaacttaaccaattgtcaaccagtcaattttaaatctacctgtaacctgggagcccccaacctccacccaacaattcaagttgtcccacctttctggacagaaccaatgtatttcttaaatgtatttgattgacatctcatgtctccctaaaatgtataaaaccaagctgcaccccgaccaccttgggcatagttctcaggatctcctgagggctgtgttacaggccatggtcactcatatttggctcagaataaatctcttcaaatattttacagagcttgactgtttttatttgttaatgatctcactctatcgtccaggctggagtgcagtggtgcaatcatggattactgcagcctctacctccctgggctcacatgatcctcccttctcagcctcccaagtagctgagactacacacatgcgccaccatgcctggttaattttaaaactttttgtatagatggaggtcttactgtgttgcccaggctggtctcaaacttctggcctcaagtgatcctaccaccacagcctcccaaattggtgggattacagggatacgatttttattttatttttatagagatgggggtcacagtatgatgccctggctggtattgaactcctgtgttcaagcaatacccctgccttagcctctcaaagttctgggattacaggtgggagccaccatgcccagcctgggagaagacttttaaaacatattttgtttaggccagtcatggtgttgaggtcaggagttcaagaccaggctggccaacatggcgaaactgtgtctctactaaaaaatataaaaaacttagccaggcgtggtggcaggtacctgtagtcccagctacttgggaggatgaggaaggagaattgcttgaacccaggaggtggaggttgcagtgagtcaagatcatgccactgcacttcagcctgggtgacagagtgagactctgtctcaaaaaaacaaaagcaaatcatgttttgttgagtttgtttagctgtgtattcacaagttgattggcatctctcagcccatcccaaccccaccccggaatgctcttcccaggcttcctaacaggtattctcctttacctggattgcatttgtagaaaacactctgcttcagtgggaggcaaggaacagaatatttctctgtctagggcatactcttccatgttatctgattccaattctatgggacctattttaccattctgaaagctacagataaccgatagaaatgaaaaataattcttgtctatggatatgcaaatgcttatattttgaagagagacaacccttcctcacttccccccaaatcccctagtttgcttccattttacacattcatttcaatatttctcttctcttccttcttttctttttttttaggttatctccctctgtgccaggccagagtgcagtggtgcaatcacggctcactgtagtctcaacctcctgggctcaagagatcctcccacttcagcctcccaagcagctaagactacaggcacgtgtcatcatatctggcaaattaaaaaaaaattatagagatgggctctccctgtgtttccctggttggtctcaaactcctgggctcaagtgatcctcccatcttggcctcccaacttgctgggattacaggcatttgccactgtgcccagcccatttcaatatttctgatcaataaatgtgcctgtccttcagattctcctttgaattggctgtcacacctcttcagtttcttcactgaggagttaaacataatcttgagcagcacgtgatattgtttagctctgtgtccccaccaaatctcatcttgaatcgtaatccccctgtgtgtcaagggatggacctggtaggggatgattggatcatggggggtggttttccccatggtgttcccatatagtgaatgagttctcacgagatctgatggtttaaaagtgtttggcagttcccccttctctctctctctctctctctctgtgtgtgtttttctctctctcgccactttgtgaaaaatgtgctcgcttttccttcgctttctgccatgattgtgagtgtcctgaggtctccccagcgatgtggaactgtgagttaattaaacctctttcctttataaattacccagtttcaggtagttctttatagcagtgtgcaaatgggctgttacagcacatattcatttttatatctatattgagttatcatttaacctgtttttgaaaattatcttttaacatgcatttttctctttcttattatcttcttttgctaaaacctgttctccagtagcttcctaagaaagggtgcacaggagacccattttttgagcccctccttatctgacaatgtttttgtttgaccctaacctttgattaataatgcgactggatgttgaacttgtgaaaggaaaataaaaactcaggaccccaattcagtatgccaaaaggaaaaaaaaaaaagaagctgaaagctgagtcatgcaagaaactgccttttcttttgctcctaagtagatggctacagataaaagattaaatatctccacaggtagctactccatgttcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctgagtatctggggcaacaggcatgtgcaactatggctggctaatttttaaattttttgtagagatgtgatctcgctatattgcccaggctggtctcaaattcctggcctcaagcaatctttctagattataggacttcttggcttccacaattgcatgagccaatcctttataataaatgtatatccatctgtatatgtcttgtgtctgtctctctacctatcaatctatccatccatccatccatccatccatccatccatccatccatctatccatccatctatctattttattgtttctgtttttctggagaaccctgactaatacagaaggtgagcccaacttctcactgaggattctcaagcctcagcctcttgaagtgctgagattacaggcatgagccaccgcattcagcctctgattgtcattgacagtgatgtgctctactgtgagtctcttttacccactgtgctgggtattcactggccctttcaacttggaaacgcgtgtcctttggctttgcaaaaatatctgtagcattgattgcctgatttctctccctctgatcagggcctctgcagcatccgactccagggcactgttcaccccatattctatgaatggcgtcctctggagttgtgctgttgcacctgcaccttttatttatttattttggaacacattggagtaagatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttccccaatttgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgggcaccatacccttgaaggcttgaatagaacagaaaggcaggagaatttctctcttggcctgaacacttgagctggaacgttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaacttcttgttggggatccccagatatcagcgggcagagtgtctccttttggcaccttcagtttctccagaaatgaacctttccatttccatcctaagggattgcaagagctgtggacttgccaggagggaagggagcagaggcccccacagttcacaatgtaatgtttcccttaaacacagcccccactttcagctgggaacccaccctttccttgccggtgctttgtgtcctcaagactggacataaggtgttgaggtgtggtgtgtggtttcaccacacaatcatttggggtctcctgagagaggtggggggaggggtgtggtctgcttgagcaggtgagggaaatggattggggtgctagctggtaactgtatactgactttcttttgtagaggcagggtctcattctgttgcccaagttggagcgtagagtcatgataacagctcagtgcagcctcgaactcctaggctcaagcaatctacctgcctcagcctcctaagtggctgggaccacaggcatacaccaccatgcccagctaatttattttttgtagagatggggtctcctatgttgaccaggttggtcttgaactcctgggctcatgtgatcctcctgcctcagcctcccaaagtgttgggattgcaggcgtgagccacggtgcccagccagtatactgactttcagtcaacctcatgctttcagtgccagttcttcttggtgcctgatgattgcaaacccaggatttattggagagtctctgttcttgatgcccaccctgcccctccactttcccacacccccttcacctttaccatacactgtcctcaactcttctgaggctgctcccaagtgttgggtgctttgatcctgtctgccattgcctgagctcctgttctctccatccctgtgggtcaacagcttttatttagttcattcccttactatcattttcatagagttgaggaggtagggaggagatagaggcaggaagttattctaccacatttgtccagagtctgccctgtttgggggcatcagtgggcagagctggaaagccatggtggctgctgagatttggaagtacaagaccaggaggaaggaaggaggatgcttaggtatggggctcaggtgtggggttcaggtagcccgtgcatggtgaggaaagggaacaaatgagaagagtgtggtagatggtggtgtgttctatctattttgatggtgggtcaaaagagggaggtgaggaatgggttgagaggatttggccccactttgaatgcagggcgaggggaaaccagcatctcagatgtgcctcagtttgtgcagggctaagtgggacccagagcaggaggggcagacttggacgggaggccagtgactctggagtttgcagtgaatatgcagggtcctgggtgtgatgcttgggttgtttatctggcctaggggaagcgaccagaaggcacgtgcctccagtccagccaggctgcaggtgttaaaaatctctgcagtcacattttctggcttctctgaacagcccctgtaggtgctcacacatgtacacatgcatgcatatatatttatatatatatacatttacatatttatatatatttaaatatatttaaatatttaaatatatttttatatatatttatattttatatatgtgtatgcatacacatgcacacagatgtacacacacatatgcacatacacatatgcacacacacaccctacaactcagacctttcctttcagagctacccctgaccgagacttccttgccatgttacaaatgagcatctcttttagagtagtgtaatagaacgtggcacttcttgataaaaatagaattctttgacttctgcccaggctgcctggtgggcaggctcacagcctcgttctttctcagctttccacgttattaatttttagtgccaaaagacagttctgctgctccaggcctccagctgagctctgctaggttggaagtcccttctcagcctgattcccattagcacagagcttggagaagacccttcctcactctgatcctgctgcctggagctggcagatgcactcctcacccagcagccaagacccatgctcctggtttagaagggtccgtcctgacagctatctccactaggcagcccagggttcctctggacacaggaccctgccaatttattagtcacggtggcaccggatagacacagcttcacccagtgatctgccggcactgctctctcttcctccagtcctgggcttcttcatgtccaaaccacgtggagaacaagataactaggatcagctcttttggagatagaagtcaccttccagcctgggatcagtggcatagtctcagcccaggtctggagacagggaggctgccatgcctgccagccccatccagccccagctggcagcagtgtgaaatagtgctcgctaaaatgagcctgctgtttgcctagatgtgtgtttcccaataattcagagacctagataatgggaaaggcgaacatctcgtatcccccacttccctcagcaaaaagagaacagtgccgcagccacaggcaaggtgggttagaaaacctgtctgctggcagattattgtctgtaacttgcctccttagttcttccaacactctctccttccccctcctcccctcccatggtccaaccctgagggttccagcagcagctgggaggtctccgatgttatctcagagctcccaatctgctgacatttgaaaatcttctggctataacttgctcacttagcggctgctgctctgcagccctgagccctcctaaaggagaccctacacagaagagtacaatgtaaacagccgtcgccagagtccccccagccagagatagcccttgggtacattttgcaatattttgttttgtttgctctcagaccggacttgcccccctttttagcacagcccaattctactacgtatactccctccttgttctttttgtttggcattatatcctaagcatttccctgcatcatccaagctctgtgggatgtcatttttaacacccacacagcgtcctctggtgtggttgtatgacaagtcacttaactattccacacccaaagcctccccttttccaaactcttccctgggacctcctgaaggtaacagcaagatctgagcagcgctggatggatcctgctctcagtcccctgtctgggaacaacgctgagccttaacagggatgtcagcttcctagggctgctgtaacaaatcccacaaactgagtgccttcaaacattgtctggtagttctggaggtcaaaggtgcagaacgagtttcactgggctgaaaccaaggtagggctgtgctctctcctgaggctttaggggagaatctgcttcctgaacttttctagcttggagagctgcattccttggcccttcgtcccccttgcttctcttccaagccagtagtgtagcatcctcagatctccctctgctttcgtcttcacgttgcctttccttttctgcagtcagatgtccctctgtccctcttataaggacatttgtgatgacatttagggcctatgtgggcgatccaggatcatctgtagatctagaacttaaacttttttttttttttttttttttttagatgtggtctcactctgtcacccaggctggagtgcagtagcaccatttcggttcactgcaacttctgcctcctgggttcaagcgattctcctgtctcagcctcccaagtggctgggattacaggtgtgcaccaccatctccagctaacttttttgtatttttagtagagacagggttttgccatgtaggccaggctggtctcgaactgttgacctcaggtgatctgccttggcctcccaaagcgttgggattacaggcgtaagccaccgcgtccggccacattattcttatttgcaaaacaaatacttatctggcatcaaacagatactttgcatccggcaaaaacaggtggaggtgactgaaggcgaatgtgggaggtcatggtgggttaatgatcgccagcgctgtccggtgaaatcaaccacctgtgacaaaggtggtttttcacttttactgaacaagcatgctattctacagtaaactccttaacaaatgtagcttttcaaggtccttaggactattacctttcaatattattgggaagttctttgctcttcttagcagactgcgaaactcaactttgtgatgacaagatacagaataaatgcatattaactgaaattctaggctcacacctatgtgagcttttctctctctaacaagatgtcagggccggttcagggagttcatctccagccacctgtgctaatcatcgcccatcctttccaagtatctaatgacactcccaaccaaggtctctataatttccagccaaaaatgagttacaacatatggaacatctaattttctgtttccattctagttattttattcttatgagcttgtgggctccatctaccaacctctgggcaaatgctcatctgacttccatagacacacagcaagcagacaaccacacaaagaggaagagggagaatatttaccagccatggaacatctgctctgtgcttatatctcatatgcattatctctaattatcaaaagaaggtattattattattattgttccgcattcacagatgacaaactgaagatcagattggttaaatacttgtccaacattaacttagcatttgggcatcatagttggaattaaaacttgggtctgctcatctccaaaaacaccctaagccttaccacactcatgggacacagctgcagctgcaggttctgaaaggaaaactaaaacttcagaacccagttcactatgccaaaaaggcaaaaaaaaaaaaaaaaaaaaaaagccaaaagctgagtcatgcaagaagctgactttccttttgctcctaagtagatagctacagataaaaggttaaatagctccacaggtagctactgtatgttcaccttatcttacgtaaactgctgatttattgagcatgagacaaatacgtaattgactatcccctacctactccgtttcctttgcaacatgtggattcagtcatgtgaccatacactgcctttctcctctccagcctacttttccactttaaatatcaaagccctcaaaatcatctttggagaaaggcacagactagcgactgtttctgtgatttcgtgtctttttacttccagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgcggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggtgaggcctggaggtgatgtgcttgagattaccaggctcttctgaacctgggggaccttctcctatgatagccctgctcctccagacccagcaggtgatttccccaaaagccgcttacagtgaacgcacctgatagcaataacttaagcatcccctgagaatgacccttatggcaggtgcaggtgaatgtggtttggagttctgagctaaggaatctgggagtggccaacctggagattcattcctattccttatctatgaggaacatctgagctcctgtcccgtcctgtgcaacacggacagtacaggggatcaaggccctttgttttgggttaggtaaatgttgccaggtggacactgttgggggagggtgctaagtgaagatgctatatatgctgcaagctttttgtaagttgtgtggctctcctgcccagcccaccactgctagatgctctcccctgcatgtaagccccagtaaaactccatgtctccttcagcagccctgggtcctttcttcagcctctcaaacctgctgccatccccattggagtagataggggttcagcataacagcagccaccagctggggaaaggcgtggcatttggagctccctacatggtcttgactctaatatggagggaaagaaaacagattctgccctgctcagtaaagccccctactggcctcccaccctggactgtggacaaagcttttttttttttttttgagacggagtctcactgtgtcccccaggctggagtgcagtggcgtgatctcagctcactgcaagctccgcctccccggttcacgccattctcctgcctcaggctcccgagtagctggggctacaggcgcctgccactacacccggctaattttttttttttttttcatttttagtggagacggggtttcatcgtgttagccaggatggtctcgatctcctacctcgtgatctgcccacctcggcctcccaaagtgctgggattacaggcgtgagccactgcgcccggccaacaaagcatatttttttcctctgaggtctttaccctataactgcaagtggtttcatgacactgcacatgggttcttatctggggttggtagattcaactcaattccacaggtttactgggtgttgcctcccatgcttggagccaggaggatgcagggaaatggggctgccaccatacccgctcttcttatgatcccatcacatcattgcaccctttggggcctggcaccatgctctggcactttgcctccatcatctcctttaacctctgagctctgtcaggaaggcattactactatccctggaatacagacaggaaaactgagttggattgaggctcagagaggttaagtcacttacccaaggtcacaaagctagagagtggcaggccagcatccaaggccagcaacacgagctccctctgatccaaatggtgactctatgtttgatcagtgctctgagaactctccaaagatctttatcaactgtcatctcttcattgcccaggcccagtcagggagccacttggctgcggtcccgctgagatttaggggcaggacccctgatgtgaggtggaatgcttggtcacgctgttcaagcctccaccagtcactcctgactggttatggacactcaatgtgccccgtcctgtgtgcaatgcagtgtgggaaggggatcaaggaccttggctaatcccaggcatttccccagaatgtcccaggtgtggaccccttgggaggtgctgggaagcaggctggtgtcccacaggccttggttccatcccagctgtgctgtgctaagctgaaactctttgggcagcttgtttcacctcatgagacttctttttctgaactgttaaatgggatgattcgacctctgcttggcttttggtgacgattaaacgagatattagctgtaaagcatttcatcccgggtctggtatagaagaagcacttgataaatgaaagctctgttgagtatgatgatccgtcaccccaggcatcagtgggatctcacagcaggaacaatgcctaactcctaactgatgcccagtaaacatcgggtggatgcaatgtccaacaagacagatattcatgttcagttttacagaaaaggagacagaggccagaaaaggaagaaagtgcccaggtcagccggctagtaagaggcagagttgaaatttgaaccgggttctggctggctgcagctccactgctccactactgcactgtctgagagccaaaaggcaccttgtagtcaggcaggcagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggcctatgtctgcacgtggtgaggcccctgctgggtattgtaccacaccttcattgtgctcagggtggccagtggaggcccttcccagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggctataactgctgcaaagatagagaattgcaatgattaatatgcatttatgtatttccaaaaagttaccagaatatcaaactcatgattttgtctatagtttggttagattcaagctatttttatatcataaaacaacttaaaatttttttatttttaatttttgtgggtgcagagtgatgtatttatggggtacccgagatgttagaatgaagctattaaatgtgagtgtgaacgttcacctttttgcagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatgggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaatttctttgggctcttattagcagcatccaaatctgtgctggtttcttctcacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcccaggggctgtctaagggctcatctctcccaggagcccctgtatcatctcagtaactagaccagtaccatatccgacttcccctgactttgaaataattttcacctgcaatcaggtgcgcttccctagaacctctctcgctgttctttgcctttctccttcccccgccttgtatctccgtggtcctgccaaaaatcagaagctcattattaaaccagaagcttccttgcattatcccagagactacagacagaaaatatttgcttctatctcaactgaggactgacatagtaaagactccttgagatgttagctgtcaaggaggggaataaaagtttttcatctgcatgagtaattgtttcctgttttatccagagagacaacagatttacatcccagacacattcacactgggccaagagcagctgccattgcagattcgagtcacgtccttttttccttccttctccttcttggagttacaacagaagctggggaggtgagagtgcaggtgagagaggaggggggctctggaacatgtagcctgtgaggagggaaatcaggatggtgcttgggtggaggtgggagctgggccagggtcttggctggtcaggaaggctggtgaagcatgtactggggaggcagaggtcctgctttctttcctctctttccttcacacctacctcaacccactgtcgagtcctatcagctctgaaatagatccttcctccagcgccttctcacctctctctccaccattccagtccatgccgcctcatctcttactgggactttcacaacagcctcccgagtggtcttggcttctgctcgcaaatcctgcagtgccttctctgcggagccacaagctggatctttttaatccgctctcggtttctcacagcccttggaatgaaaccttggcctacagccctgtgtgacttgctgcctgtccttacctcctaacctcatctaatatccccttcccctcctcgtaccggcctttctgtttctcagacactccaggcttgttctgctcttggaccttcacgctgtctttctgtctcctgggaatctgtgccccctctgccagatcatgcagctggctctctctgcccaaataccctcttccgaggggtcttccttggccctgtgtctgacataggtaccctcctccatcactccagcccattacagtgccataacacttttattgccatctagagtaacatcagttggttttgtttatcatctgccaccctgctagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggtaaatttggtatcttagcaagtgggtgactaccactgtctgggggaaagctgatacacgaggacttgacaataattacagcagtaacaatcgctactattttgttttgaaatgaattttagtttctgaaattgtccaaagcacttttatcaatagaaacttgttacacatccctccaacagggagaagcagcacaggaagctgccccctcaaacactaaaggctcctggagctattcacagtgctggggaacaaccagaggaggaggaggacagagggagagaatactttttttaaaaatcccaaacaaaaccaaattctatacatgtatatctcgagtgagtaaatgtgtaacactcagcagtctcctacacttgccaggttttgtggcttcatgcagtaatataaaatgtgcttcacaaagctaggagttggcacagaatatagggttctgattcatattttagttttacttttttgtagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcacacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactagtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagtccagctaacatactatataagccagtgagaccagccagtgtctgttcattgcctctgccttgcccctatgcctgcccgcctcctatagcaggtccctatagcataatgaaaatgcgaacaaccttttctctggacactggggaatctagtctggtggataaagatggatggctgttaaacgatcacatcttgggctctgtgtgttcagtgaagcctcatttaccagatctctctgatgagaaaggtgaatggtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagg

SEQ ID NO: 12843 - DNA, 57280 bp, Human; identical to SEQ ID NO: 11796

SEQ ID NO: 12844 - DNA, 57280 bp, Human; identical to SEQ ID NO: 11796

SEQ ID NO: 12845 - DNA, 31718 bp, Human
ccctaaaatgtatttaaaacgaaactaaattacttttatacttggaaattctaacctcaccagcctgggaccaatgactgttaacataaatagcagctgcgctcccggaatcccagagggtctggaactcgaattcacaattcctggaaaggtgtttgttttcgttttaccagttgtcatgtgaatcggtaaagcacttcaaagtccgcagaggagccggataccaaaccaggttcctgccgccgagcccgtgatctttggacccgatctgctcacagctgggagctggctcttttggtctccagggggctctggtcttcagtcccaggcaccaggcactgagctagcagcagacactccataaatatttgtcaaatgaagcacacagatgattaaataaatgaaattggagcgttttattacttgcgtggtgtgggctcttagtcacccccagctgcggagctgtgtgccggagactgtagatggagaaaggtactttgctagagctgagccccgggaacaggacaggtgactcactttcaagtccattcatttttttcccaccaaaataataactatgtttacttccaaggtatcttcgtagattcaaaactccaattattttttaaaacattagtccaaatgtaagttacatttgtgacaagcttaaaacaactatttgccactccagccttaaggagaccaactttaatttccggagtatgtgggaaaggaagtggctccctggtccccccaggaggccccccgagcaagcatcgtcatgttgggatgtgtgagttccctccaaagagcggccggatgggagtggggaggcagtggggagacgcggctccccgctacaggctatgaaagaaggtccgcgcccgtttggaagggggagcctggagacactaggtctgcggctttcaatgcgctgacttggggcagcctctctctttccgagttactaacacaaaaacacagttaatgtcgttaaaataccctctcctttagctccgccctcctgtcttcattattaatctcctgtggccaaaaataagccttcactcaccgttgcgtctcaggaatgagtgagtgttttctgaggtgtggacgcgtgcgtgatctgtgatgcacttcggcctctaacccaaatatccttccaaggctgggaattttttttccccatatgtgaaaaaaaaatctttccttttcaaaccatctgttctacctgtaaaaagaggctgttatttaggaaaggatgagggaactcttgcatttgaaatggactttagatttgctgttgggtaattttttaaaaaaagttactttctgagaggaaactcgtgtaaaaaagcaagacgtgaacctgcagggaattagactaacgagtgaagaaagccaatttcaaaaaattaggcgctgtatgattcctgtatctaaacataacatttctgaaataaaacaattttagaaatagaggaaagattagtgatgccagggctccggggtgcggctgtaaaatcgccacaggagtggccaggtgggggtggatacgggaaggtacacagatgattacattgtgtaaaactaatacatgcaaaggaagacgagtaaaacggcaaaactgaataagatcggtgactgtatcaaagtcaatatcctggttgtgagattggacttttttttttggcaaagttttgcaaagtggtaacactgggggaaactaggcaaagtgaatgatttcttacaactgcatgtgactccgcaattaaggaaaaaaaaaaagcaaagaaaagcagggcagctgatgcgcacgtcgagacccgtgagaagcgtgagaagctctgctcacccaggggagagcgcagtgacccgcagcgtctattcatccgtccgcagtcaccgggcgctggcagagagggcgcccggggggcgggtaagtgggcggggcctgggggcgggacgacctacggaagtgacgtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacaggtgagcggcccgggcggggcgctggggcggctggggcccgggctggggtcggggtcggggtgctctggtcccggggtcctgcctctctctcccgaactcacccccggagcagcttcgggggggaaaccaattgccggcgaggccgcggggctccgacaatgtccactcggcctgtccgggccggaggggcgcgggggctttggcgagcccgggctcgatcgcgcacgtcggggccgggtcaggcggctcctctggggctcctctggggctcctcgggggccgcgtctgcccggacgtcctaaggcgcccagtcgtgcttcctgacactccccgagtggccctggttttcggggtctccagctcgccttgcgcctcggacccgcgcccttgggaggcgcgtccggcccgcccgggacccaccggggcgctgcggtctgcgcagggcttagaaaaattgccatgtgggcctctgggctttgtgagtggagttagcctccgttcgacttacttagtaatttacgttggaacacaaattggtgtaagactgtaattatttcggtcggaagcttcggcttggctcgggcgaggcttcccgggcgcccggcgcttgcgcggtggagctccggggctcgggcctggcagtggggtccggcacggggcccggggtgttgatccgtccgcccagcgcttcctcgccgcacactctcgttttagctgacttaatttcgagaccgacccgctagggaagggccttgcattcaagttctgtggccgtgccatggggccctcctgcaccccagtttcccagtccaaaagtcagaatggaacctgcctgtacctacctagcaggagtgttcaaggtaacaaagacgaatgggaaggacgcagagccgcccgtgttaaattcggtgggtcggttgtcgtctgtgcataatttgagaggtagggagaatgttcttgaacagtacctctttgttgttgtagatttcactgtttacagttgattttgatggttcatatgtaaggctcaatttagcacgttttaattatttatcctttaatgaagcttaccttctacatggaagctatgcttgtattttacctagagattccttgaacacatacactcagaagcgacacctttttaaaataccatttagcctttgctgcctggcagacctggtttcgaatgctcggctgattgagtgatggggccgctaagccccagcttttctgcagaatcgttgtgatgccggtgtctggggtggcagtgcgtgctgcagccccataccgtgactgtgacgcctctgtggatgagaggcctgtcctctccctttgcattttcgtccttggctaggagactacacagcagagatagtggtggctttttgccgtaaccctcaaatccagtgtttcttggaaacaccagtagagtggtgacgagtgtcatcaaatcaccactagttcaaaggtgagatgctggcccaggctgtgcactttttctcccctgcctcagattctgggaacttctcaggccaggaggggtgctgtggttattttgatgaaatccaaaccactttgaataccagccagtggttaggttctgaaagggaaccctctccataggggcattcgttttatctcttggggatgtgtgtgagctttaatcatcagcgaaaattttcacaccactttcttatattggaagagcaaagtaaacaagcacctacctggactgactcaccagctcacatccttaggatcttctgttatttctagcgaccagtcccttatttcttgggtggcctggttggagggaggctttctccacttaaggtggatcacttaggatattgcatagcttggttgaaaagtgttttgtactttaactggaagcctttcctaccctgcccaaagcagacaggtggtggcatgtcaggtggctaggtcgaggtcagcatcgcctagcaggaagcatttcacctcctgtgctctgctgggcctggtagagtaggttggggctttgccatgtgcagcagtggctgatctttctgagaagttggtcaaaccctggctctttgtgaagctgattcctttaggttaattattgactgtattgagcctgaggttcttgttaggaatgtacatcagtcccactgtgctccaggagctggttgcattgcagtctcacaaggttgtacctaggccttgaagtagtcgctgtgccacttgccctgccacatttctcagtgcttttctgacgagctgcctcccaccccagcccctcatatttgcaagatgttccctgaattggggcataggattctcctagggtctttgtgtgcagcccccggccctgtaccccttctgcctaagtcttgcttctcttctcggagggacagcccctctcacccctgacacacgggtctgggcctcttccaggctgctgggggtcagtgatggtctagtccacttgttacataggagccaccacaggtacaggtgcaggtgaggctgattttcactggccaacgctgcttgcctctcaaggtggtctggggtctcctggctccctgcagctcccctgggccaggccttcagccggcccttggccacagcacctgctcggggcttgtttgatgagcaggctgcgccaggccatgtgagcttgcttttctgtgcaggaaaggttggggggccgcccagcccccagacacttagcgaggctcccagggacaggaagtgcctgccagggggccctcctgggagttcacaggtgacaccccattgatctgagattaccttcatcatggggctcggtgcctcggagggtcctgtggggtggctttggagaggcagctggcctccctggctgaccctcattgtgggggtcacagggcctagggtggggtgtagggatgggtgccgtgaccagtttggagagaataaagtgatcccaaaggccccgttcctcccctaccagcccccagctaaggggatgctcagaagaagccagtgcctgcggggcgccggctgggagacgctcctgccacattcagccctggctggtcggggcgagcctgagcaaaccccaggtttgtaacaacagagctgacgattggacaagcccgtttcttgtcagttttaaaaatagccgtgtgggaacccctccgaggctccctgggaacataattggattggtgtgcagaaggcctcgctgagaggcatcagctaacagatgatgaaacacattttccggctgcgttttcccgaaggtagttgctaggtttctccttcggagctctttgttacctgagcggtctcaccgtctcccccacctccctgcttctcacttttcccttcgtttattgcttctccgcttgcacaagaccatgtcccggggccgttctttccccctttccaggatgcgtgcttgcaggggaaaccgcagctggcctggtccacaggtctttggaatttctgagcctggagaagaaccttgggacttctttagaagttccttttagagatgattggtgtgatgatatttctcgtatttctcgctactccattggcctccctgggagggcgaaatacactttggctagccctaaatgaggagaaaaccgaattcatctaagtgctactcaccgtatctttaaaaagttgaaccccaagttaatcctaattaatgcccagagatttttcatgtggaacccaaaacaggacccaggacacttttgcgggggagggggggcttttcccgttcctgcgtggaagcagaattagcaacgctttcaccagcagcgaaggagaggggaataggatgccaccccctctgaactgtgcctaagcgtagctgcgcttggagcaaggcacagtttttaggttgtgttttaattaacaccgacgagaggggcttctggtcaacccagaaacgttgacttcactgtcaacagtaagaaatgcgatttggagacggtgcgaatgtgactgtgtgatgttctgtgctccctggccgccaccccagcacctaggctggattcggcatctctccacgtgttaaaataatgataatagtaataaatctacagttccttttgtgtggtcatcagaataagccagaatcattaaaataagccagaaacactgcttaggagaaaaaaatgtattaaaaaaaatagtgccattgctcaaaagcaattggtgggttctttctgtgcttcgagtacctgagcacttcttaacctccctgatcagaaaagcctcttcttgcagcttgttgcaaagaggccctttcaggcttattgaattgcaaatgccgccgggcgacacccgaccccagaagggctggagcttcctaaagccgctggagtttcccagatgtgcgcctagggagcacctggagaggggctggaaggcggggtcgtgtgggttttggcccagtggttactggatggtaaacagtgtggaaagtttctgaggacatgctggtgcttctgagcgaaatccaggctggtaggcaagggagccgccccacccccactcctgggcctcagatctcccacagggcggtcccgggacccccttcctcagctggaatcctgtctaccccaagccagtttggatcatgctgtcacaacacttttgtccacggaaacaatgactttttttttccaggacagctgattttcctcgagaaaatgccctcaaatgtgtggcccatggaagggggaagtcgtgccgggctcccttcaggcagttgcgcaaagctggggtggactccgttaggagattctagccgggatccgctttcaggagccaactagcagcagtggcccttttttgtttgtttgttgtttcttttaaagtaaggtaaatggggtctccgttctgcagaaagagcccggggcagggagagtaaagtacttgctgaactcggtgcgctggggaggggtgtgcactgctgccagcccgtagctgttagagtcgccaatgagctcactctgcaatcagaagtcaccggggttttatgtattaagccctttgggcaaataaaagaaaacactatttgtggagtggctcagagcttccacttaataagctactcagccttcctttgattgacattgttctcagaatacgtgtttattatcagtcagctttggcttagagagttcactctcagaatgtctacttaatgtggaaaaatgacccttgcgaatggctggcctctaaacacccgaattgtcatttcctcaaaaccctccggcgaggagggtgtgcctcacacggttgcacagtggatgtgggtctgagtcctacggaaggactttcgccagcgccccggggcagagtgtccggaggagggaggccacactggtaggggaggggcggcaagctggccacatttgagcaatcggaaacagacaaatcataactctgattcttaacaagacataaaagagaagcagcagctggtaccatgtcccagtccgatggtttggaagttagtggcagttgccgggttggaagttgtgctggtattcctttaaataacaaatgagggcctcagccaaccggtgttcccagaggaggagaaaggctgggagctgagaggtgtcattttccttctttggtgaccggtttcattttagctgatgcttgacgttggcatcaggtcctcgtcttccttttttcccaatgctcactgagactggggacagggttgagagtcccacgatctgatctgcaccccccatcccttgatgggtcccagagcctggcccaagcctgtggctgcagggagagggatttcccctggagagggaggaagcagccgatggtatgctggtgatggggcagctttcagctcagcccagggacccccacaggctagcactgcacactggtgggcatcttgttttccattagttggtcatttaaccagagcgctaggaaagcaggccgtgctcccctaagttttgtctcataataatttcacgttcattcctgatacttgcttcacttgttcccaaggccagtgggattctttgctccttgagtgtattcagacacactcgacctgcccaccccccacaccccccagctgctcctcctggggtgctcccgcgtccaccgtagagagctgcctagtgacccctggtgcagctccagagaggtcctgcaagcttctcccctccacatgcagtcaatggacccatcctgcagattcttccaacagagtgtgtgtgctctgctggcttcccctctctgctttgccaagcccaaggggatccacagcgactgctccgctctgctggcctcccgggtgcccctggactctgcgcaggtctcagccttcccgattctctcaggggccctttcctatgctgacttctgactttggatctctcttgattctccatagctccctggaccttcctttcaagaggcttagatttttcaaccacacttctcttttgggggtagttcgccatcttcttccttagagggtacacgtaaacaccatgaagacgggaaagggacctcttgtccttagttctgacatatggtggattcaagcgagcacttgccaatacacagaactgcttaaaatataggtcaggtgagtgctgggagtactgaagtggtgattctggacagtagtagtttattggctgaaaatgcactcacttgatttacatcggggttattcaacttggcaccgttggcatttggggctgagtaattcttagccttggggctgtcttatgcattgtaggatgttcagtagcatcctttagttgtgacaaccagaatctctccagacattgcccagtgtttcttggggggtgaagttgcctctaattgagaaccagtgggctatgtcctgagacgcagagccctagctgcagggcttgcattgttggggggcagacaggctgagatctccgagcctttggtacctgtccgatgtatgggaatttccacagcaagagctaaacagtaggatccaggggttcctgctggcctttcctgcagggaaagtgttttcactatggtaagggaagcctaggaggggctgaactctcgcaggggcggtcagatcattaagaaatggatgcgttctgttggcactgttttggattcaccagcaggcgaggaaatgggagccactgagtgatttcccagcacctgctcccgggtttgtcactgggaggagcaggcctgtgtccgagctccagaagagccccctgctgtggcagcggacactgggttataggcagggacttgggctggacgctggattctgggggaattgtctggaggccaccccagccagctgccttgcgtggcctgtgtgtggacatggagctgctgggtttcctgctataggaggtcggatctctcctagtgtggttctgaacatttcctttagggagcttattatattattagaaagcagattggctgggcacggtgactcatgcctgtaatcctagcactttgggagctgaggcaggcaaatcacttgagcctaggagttcaagaccaccctggcaaacagcaaaatcccatctttactaaaaatacaaaaaattagctgagtgtggcacacctgtaatcccagctaccctggaggctgaggcatgagactcacttgaacctgggaggtagaggttgcagtgagctaggatcatgccactgcactccagcctgggcaacagagcgagactctgtttcaaaaaagaaaaacaaacaaaaaaacagattttccagccccaacctggaatgcattctcaaggagtgaggcctgggaaccagcattccagccagcttcctgggtgctttctaccatgtctgtgtttggggctgctgatctcgatcctgcatggccagcgtgcgtccgtgggattcagcctcttactctgaacgcattctgagacttttgacccatgatgccaatacagaccattgcactgggattctagtctgtgaaaacacaggctgcaccagggaagtgaccttagaccagaggttggtcagctttctccacgaaggcctagagaggcaacattttaggctttgcaggccgcagggcctctgttgcaaggactcctctcccctttgaagtgcaaaagcagccacagccagtgtttaaatgaatgagtgagactttcttccagtaaaagtttatttatacaaacaaggtggtggcacgctgtgggcaaccatttggcagtttctcaaaatgtgacacatagactgtgaccaagcaattctgctcctaggtatgtatcgaaaagaattgaaagccacgactccaggcgtttgtcccccaatgtgtgcagatgtgcagcattatccacgagagccaaaaggtggaaatggcctgcacccacgaacagatgaacaaaacgcagtacattcgtgcagcagaatattattcagccatgaaaaggaagttttgatatatgttacagtgtgaatagaccctgaaaacatgcttaatgaaataagccagacacagaagggcaaattttatatgcttatgcttatatgaatttgcctagaatgtagaaaagaggttactgaggatggggatgagggaaggagttattggttaatgggtgcagaatttttgttgaggatgatggaaaagttttgggtgtagatagtggtgatggttgtaccacattgtgaatgtgggtaatgtcagggaattgtacacctgtgaatggctaaaataataaatactatgttatgtctatttgactacattttctctctctctctctctctctctctctctctctctatatatatatatatatatattttttttttttttttttttttttgttatggagtctctctgtgtcgcccaggctggagtgcaatggcgcgatctcggctcactgtaacctccgcctcccaggttcaagtgattctcctgtttcagcctcctgagtagctgggattacaggcaggcgccaccacgcccagctaatttttgtatttttcgtagagacagggtttcaccatgttgatcaggctggtctcgaactcctgaccttgtgatctgcctgtttcggcctcccaaagtgctgggattacaggcatgagccatcacacccggcctatattttttattttaaaaaatggctggttggatttggctgttggcaaccccatgctttggacctatgctgtttcattagtttgagtgtgaggttggattcaggaataactgggccaactcaggtattgggcttaaacggagaaggtgagttgggttccttgaacataactagttacaactttttttttttttttttgagatggagttttactttgttgcccaggctggagtgcagtggcatgatttcagctcactgcaacctctgcctccctggttcaagtgattttcctgcctcagcctcctgagtagctgggattataagcatctgccaccatgcccggctaatttttgtatttttagtagagacgggggttccactatgttggccaggctggtctcgaactcctgacctcaggtgatccatccgccttggcctgtcaaagtgctgggattacaggcatgagccaccgtgcccggcctagttgcctagttacaaccttgagtggaacgtcaacttctcttccctcctcccaggagaagggattatcggcctgcacctgcagtctctgagacccccaagccttggctcatggctgcctgtggaattattcacacacgtggaccccccacatgtgttatcagtgctacctgtaaaacgattagaatttccctcctcctcacttgtgataaccctgtgatgcataggtacatttcagcagcctcaggactgagactctggaaagccctgcattcgtgatgtgacattgaagtgtgccccatgtgtgtgcacttgaggcatttgctcagccctctggagctggtcgtcttctggccagggtgctgttccatgtttgtggctgagtgaccattgcgtattcttcatgcctttgaactttttcagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcctcggagccattgccatgggatctccggttccgcatcatccacgagacggcggtgggcatgaacttcctgcactgcatggccccgccactcctgcacctggacctcaagcccgcgaacatcctgctggatgcccactaccacgtcaaggtggggggccgcacggtgcccgagagagctgggcagggagggcctgtgtcttggggagcagggtatcaaggggtcaagccctgaggtcaggacaagggcagaagaggaggtggttcttcttggaggaaagagcttgaaaccgaggccttttgcagcatgaggactccaggagcctaagcttgtcctggttggtatgaaaaccacacgccatgtagctggagggtagcttggtgaacatgggggctgttcccccaaatcttggcatatgactcattccggaaaaagattacgggtttgtgggttttggtcttatgaaatcaggttagaattcagcccgtgggccaggtgtgtccttgcgagaccttaggctctgcaacaaagggacgcatttccctcagtgttttcaggagctcggggtggtgggaatgtgggggtcctctgcagtggggtcctcaaagtgctgtggaaagaggcttgtgaggaggggctcgttgcctctgtctgcccctgcgtagagtgcggagtggcagcgtgttgcgttagtgcaacgcctgggagatggagcttgcttttgcttcgctgataggtttttgaaacacagaaaagtaagagagataatgtaactgaaaaccagtgttgcctctgggccttggcaggtgttagcatcatcacctttgcatcagggctgtatttccttgtatctcctttgatggccttcgtggctagggttgtactgtcgttgacatgtggtggttacacctggcgcgttgtagtttttccccacgtggtgatgttcacatgctcttgggaggcccagggtgataggctggtccacatgacactggtgtctgccctgggagtgagaaggagccgagagccatggtccggatccatgtagttcatgcaggggacaagcagaggagtcccctgcctggcttggctgtgctactgttcctggtggcacagcacttccaggcctctctgatggcctgaccattaattaggagagacctgaattcagggcccggccctgcccctgagctcttgggtgggacgggagcggtggctcgtatggcatgcgcacggccgctccctgtgcccagactctgcggacgagtgcatctcgcgtgccttgctcagccagggcggtggtgaggaggtcaatttttcacttcgggcagtaattataagttgtctcttaggtaggtgttgcgcagtaataagatttcagctagaagatgaagcaccgtcctgcgaagtgaagtaggaaattgagataatggagacaaaaatcaaatgacttggcttgaacgggctctctggtggtttcccgcatctgcttatgttctgggacccctgggattcccgtttcctgtgatgggcagggctgggcctcacatgcggaccccccattcccgccaacatttacgggcttgtttctaggtagcacaggctctggggccctaatgactagtaagctctgccgtccaacgtgcactgaataccggaaaggacatgctagaggcttcacctgcgggagctgccctcatcctcagagcagaggtgcagagtggacggtggcctctggttctcgctgagtctctgcttagagtgagtaaattagcagccaggatcgtccagctgtaagtcacggagcagagaccttgatttccacctggcctgccactgtgcttgacatgaaagaaaccaaatgaccactgcacgtagcagtcacttgggggcagggtgtgtggcccgcaggctgggcctagaggcggccctgtgggagggggtgggagtgctcctggggctgggccttcacacagggtggggcttttctgccctcaggagtcggggcaggcagcagcagagcctttaggtgaaggaaacagcccaagagacgcagagagctctgggccttcctgcaggggcagcaggcagcagggcttccctgtctttcaggacagctgcagggggcggatgctgcctggaactgctttctcagggaggctgctgtcgaaggcacgctgggtgctggccaggaagtgacaggacatctctgtgtggtgcccctgggacatcttagggccctgtgtaccctgacaggccgcaggaaagattgcttttgtgtggcgtccttcttaatcaggcatgttagtcaccatcaagaagcccaaaaacaaaccgaaaaatacctttacgtgacatacttattttttctgtgaaatagctactggtgtgcgtagagggcagcagggagtgtgtgtcggggttctgagagtcagcgcctttgttcctgaagacgaagtgtggaagctttgcatggactgaccactgggcttctgggcagtcctcagtagacagttattcaatgcaggaaaactgtaatccagaatcctgcaattagatcctaagttgccattccagtgctgccattcgcctctgagatgggctccctcagtgctcagggctcgattcaaactggaaatatcacagcaactgtctacttcatgaagcagttaaatgtaaatagtatacaaagtaatagtatcaaattaatgcttgatattattcaacattacatatactaaataccaatattaagatactagttggaatcaatttcaacttaaaaatgaaataacttggtttaaaatctcaggctgcatttatatgtccagttagcccaaaacagacgcttttcaaagggtcacacgcgggtcacgttctgctgtgtctttcttttagaggcagcaaaaccccggcaggctgctttcttagtcttgacagctggaccttgaagttgaagggccatgtgcttgggggcagctgtgagccctcagctcttggagatgcagagtcgggtgctgatgagagtgtttgtaactcttgaagcatttgctggtcagagtggatgccacagtagctcgctgttgaggacacggggtgaggggcagcttgggtgggaagatgaggaaaggcggaggggaaatgcagccggccaggagtccgagacatggagggaggagaacatagagggtcagtgaccctcctagaattctcaattccgagcttgcattttgttgccagaggttttacagagaatttctgctcgttttcttttcaccaagtatagtttggagtggctggctctatctgacaaagacaggaggagaaaaggctgcaggcctggggaagcaccaggctgagatctctgcacccctgtcgtttttcttttcttttcttttctttcttaatgatctcagatgtcatttaattttcacaacaaagctacaggatgggtactgctattgcctccttttatgaaaaaaggaaacaggcacagagaggctaatagtccagggccacggagctactaacttgtacaggcaagattagaacagtgagtctgatccttaactaaccgtgggagggagatatttttttcctacattcaaccatacagggggaggaggaattgcctagaaagtatgtgatgctttctttatttttattattattttttattttacttttagttccgggatacatgtgcagaatgtgccagtttgttacataggtttatatgtgccatggtggtttgctgcacccatccaccatctaggttatcacctaggttttaagacccgcatgcattaggtgtttgtcctaatgctctcccttccctcttcccctacgcaccgacagggcccggcgtgtgatgttcccctccctctgtccatgtgttctcattgttcagcccatttctgaatttgaaggctttcaagccactgatgactgttgaactgaaacttcctgtgctctggagctatttggagagttaggacccgttgttgtgtcccagcgtccagcagccgccggggtttgcagggtcgggtgatggcgttcctctggggagctggcgctttccctggagtgcagagtgtggctctcaagggcggtgcaggcctgaaggccctgggagaaatggaagtgggaggacatgagagccgctggagtcgaggccttgtcctggtgctcctggctgcagagaaggagggccggtccctgctcgcaggccttcccccctacctccctgcagatgtgctcaggatccctggaagcccgagtcacaggtcataaattctcccagctgtttggtgctgatgacagcagccctattggctcaccacatgggcatggccagcccagaattaaggcctgactcagcctcatttcctgtcactccatgggtgtgtttgagaggagctcaagagttaatgaaaagggtttttaaaaaaatccatatgccttgaaggaaagttgagagcagcactccccctggatcaagagtcccattaatgctgatgacttgtgtcttcatcccacatacggttttcagcagcttcaaaggggactgagttacactggagagggtaggacactggcaggaaaggggatgcccccgagagaggtcagaccgggggtctgtgaagtctccccagtgagctccaaggtcacctttgcccgaaggagacctgagacctgcctcccctgaatgcggacgttgagggcattcctggaggagctgggtggccggtgctccttggggcccgggcgctgccagcagaggtgtttatcagaccttcactcgaacacatgtgtttgaagcagccagccagtgtctgctgatcacaaaacactccagatggacggggctctgaggcgtgtgttttgtttgctttaaagtttaaagggcttctgaaggtgtgtttctgtgtttccctttaaaggacttgcagccacttgcccgccagcctccccagctggcaggttgcataacctgctccccgacttctctaggagcagacctggtcttcacatgtgtctctctttacctgaaccctcgaaggcttgtttttttccctttatgccggctcagccggctctcaaccaccatggcaaacatgatgctttacagaaggtggattctaattcttctgcagttctgtcccggataactccttccttacagtacgattctttcacctgcccgtcaaatgtgctgctcctaatgcctccaggcttgcttctgccccagaatctgtctccctccctgcctggggcagggctacctggagaggcacagacacggctcttaggggctcctggaaagctctcacccaccctctgagattgcagaagggagcttttgataaagcatcataaaatatcactgttgcaggctaatgagccccgctctgatggctgtgttgcagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacaggtgtgtgacatgccgccccccatcccctgtgggtgccaggggctctcaacctcaatgcttcatgccctgagctgcagctttcagaaaggcctcttgctgccagtcagaaatggggctcgggccaggcgcggtgactcacgcctgtaatcccagcactgcgggaggccgaggcaggaggattacttgagcccaggagtttgagaccagcctgggcaacatggtgaaacctcatctctacaaaaaatacaaaaattagcccagcttggtggcgtgcacctgtagtcccagctactcgggactgaggttgggggattgcttgagcccgggaggtggagattgcagtaagtcatgattgcaccactgcattccagcctgggcaacagagcgcgaccctgtctaaaaaacaaacaaacagaaagggggctaagtccacatagaaggggtgggtgcttgtagagttcagggatttctttgctgtgagtgttgctagccaaggaggaagggtgttcccaggtccacatttgggccaggctgacagccctgccctgtcagagccttggtgatttcatgacccgtgggctttatggcttgtctgttggaagaacctgctgctttcagtggtctgtacgcatgtgtgtttgtactttccgaaattcactctgattttgtgaggcgagcagctcatcttcttcatggcacttaacctttgttggtcagagatcaatccccaagtcacctagtcccttcctttttcaaattgtaaaggtcttaatcacacagacttcttggagaagaaaagtgggtgggagcgtgtgagcaggcactaagcctcccattgtggctgttatccagcagcactgtgactcggaccccgcatgtgagctctgccttttggtcactgccgccgccagcagcccaggctgactggtttgacagtggccattgtgcatgtgcttagctggggctttaagctgagagttgcctggaagtgtcactttggagactagtcacagcttgtagagtttggggagattgagatcctctccatttattttagagtttggagttccagcttttgaacctgccgtttgaactaattttcgatggtgaattcgttgtctataaacagccctcaccaactcagtgctccttggaggctcagttttcggacttctgtttttcttttcttttttttttttttttttttaatcaatttgggcactttttttggtgtatccagagtaatgtacatgaacgtatccctcatattatctatatatttctaagcagcccccgaaaaaggctttggggcgttcagctgtgttgtctcctacgttttctgcgcactttctttaacaaccctctaatgatgaactctcagtgagcctctgttaggaacgctgaaatctcagcaagcctacgttaggaacgctgatcagaaccagaatccgtgttttcagagaatgaaatcattgttgggggagggcatgggagttgcccatcattcattcatccatttcttcagtaaatgcctgcgcaggtgctctgtgcctggtgcttgcgagaagatatcagtgaggcacacaggcgctgttccccaggagctcacgccccgcatagggtggcaccctctttggaagtccctcaagctgcctgaagattgtagcccagttggcgaagttacttgagtctgtctgacatctgagctatcaacatgctgggcttcactatagagaattttctctttttaaaaacaggagaaatatctcggtgtcatggctctgtctttggaaggcttcagaacaggtgtcttcacgcctgttgctgtgcatgagtgcatttggctttgagtctctggctgtcagatgctaacgtgcctggtttctcttccagctttgcgatcgtcatctggggcgtgctcacacagaagaagccgtttgcaggtgagtggacctgtctttgaggtgtaatgtgcttgtctttcctggaataatggggggacaccttgttgtcctttctctatcctaaaacagagcctgtgatccacgctgccataggtgctgctctgtggtgtaatttgcatgcaggaaaagacacagatctgaaggggcctgttcaatggaatgtttttaggtgccagctagtttttttgtggtagtaaaatatatataacataaaattggtcatgttagccatttaaagtgtataattcagtgacattaactacactggcagtgttgaacaagcgttaccactgtctaattccagaacattctcatcatgctagaaggcaaagcccatggccattctgcagtccctcgcccttcctcctgctcaagccccagcaaccactcacctgctttctgtctccaggggtttgcctgtgctggtatttccagctaattcttttttgtttactttttaaaaaaatagtcataaaatacacagaacaaaacttagcatgtcagccgtgtgaagcatacagttcaggagcattacatgtacccgcgtgcttgcgcagccaacctccagagctgctcagtgccatggagttgcttgcaggagtggcacccctgcccagcttgagagctgtggtgtttgcttccccagccaggcagccaccattccgaacaccatcctcaaagttgtcacaccttgacttacttatcataaaaatccaggactttttagctttgttggacagattcccttttcctctaaagacatttctgggctactcatgatattttgtggtgtgaccgaaaatgtctaaaaatgaagatgagagtcaaggcctagccccttgttagtcggggctcagactaggagccgatgtatgggaaagtgctggggtgagaagagatcttccagcatcgcaagatcaagtatcttggcagctttaaaagaatgtcagtagaaagcacagaacgcgtcctgccaggcctctgctggccggtgtccgtctgtgttgtctgaccgcctgtcgcctttcttgccttctgtacgttctcccgcacagtggcctacagcccgaaggcttgtgaaatgaggcagtgtctgatagatgtgacacccgaagctaggcgcaggggacaggtcaaggctcaagcccttgtgctttattgctgaatatgcctagtgttcccttattggaacgctaatcatatgggaattattcgtgtcctactgttcaaggtcatcgccaaggtctgatttttcaaattcaaaaaattgcaacctcaggcaaaaatgggtaggagggggttcaaggtgcaggagaacaaggcctctccccagcttttccagtctgtgcttggcagcaggaaacattccgggcgtttacttcagtttgcttccattttatttagaggagctgttggttttgaagtctgaataatcatggaaatagcctgctaaacacttaacgatatttattgcacaagatttaatgggaaagtggagcaaaacattgtatggaatcctggcagccgtgggtgattctcggctgattttccacacctgctgaggcacatggcctctccaaagagctgccattccatgcgtgggtgtgtttggatctggagggcagagagggctgttgggaacaagaaccttgagggttccaggctaagcagaaaaaagaacttggcccactggatgtcaccctgggcccttcccagtcagggtagaagttgtggcaataataataataagctagagcccatgcatgctagtgaaggcagttggaaaggacaggtgcggccccacatggtgaattgaggggaaagagcccttccacacatcccagccctggtgcaccggcaggggaggccagctggggacctgagcttgggattggagttggaactgaggaagacttcttcgccattgtagagagagttgggtctctgtggatgtaggacgctgtggctcctccatggtgcgtgagcctcattccctttgctggcttgggctgttgatggaatgagcctcataagatattgttctcctttgaacctcatcttcctttggatgggatgcctagaaagatctgctctgtgaccaaacacactgactccttctggtagatcagaacccagggaaagaggtcgatttcaaaaccaggaaactagagagcatggcgcaccatgagggtgagggttacaggaagctctgcctttgaaacggagtgggggagccgtctccctggggtggtgtggggatggccccattgtggcccccggcgagtgtgtcgtttcctcccaagggtgagatgctgccacccagccctgcagagcccctgactcgcatccttcccttggcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaaggtgagcaccccggggtctccccgccacattctgtgggtgtcacaggagacagaggtgacagacaggacagggtgagggaccaggcctgggtgagaaacaaggcgtgtaacaggtgggccgaaatgagccctgcacagataggttggacccagcacctgcctgcggcctctggtactcacggctcggccacggcagctggaactgagttgcctccaaccatccgccccctgctccccaccagggttgggcttgccacccagaggagtctgtatgggagcctgaagttcaggtgcagccatgctcttcccggggacttacctggccggtggccggcggcgtcgcccttctcttgaggagttgacttcctgggacagatgtgtctctggcataggaaagtcaccctgatgagatggaaactgctgcatttaaagcttacggcaggaaacgggctgaatggggagctcatccgccaggtgctggcagctctgctccctgtgactggcaggtggcgctcccccggggaaggcttccgccttgagtctggtgaggccttcaaatgattaccgatgggggggcctgggtttggccagcaaattgtccatgtagggcccctgggcttgcctggtgagctcaggctgggccgaggcgtgtgagaaatcccccagctcgtgggggccctgcgtttatatggaacgcgtgtgtacgcagaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtaacgagtccttcccacaggggtcttttgtctcctcggcttccaggcaggagtttccaaaccactcctctttgcagagtcccccgccgcccggaccactctccctctcttctgagcccatcccgcacccaactccattagaagtgtaggtcccatgggggctcaggtccacctgcccgactgcatccccgccccacctcctgtctgattctgcgtgagtggcggaagggcttccctgacactaaatagccactcattggatgtgtgtggaccacggggatcagaaggcccagccccggccggggagggagagctggtgtctgagtgtctttgcacccctggctcggggatccagttcctttatagctgcccataaatggtctgcactctgatgagtgccacccaggtgatttcagatgtgataagaagctccaagtagcagggctggctaaatgccttttcgggtgatgaggctggagcagacctgtgaggcccagctgataagtgagctttataacgtgttatctggtgttgggcgattaatcccaggctgttggtgtgagctcaggagatcaggaaatatgtatatcaggaatatgcgcccactgcctcaacataaagtgcatgtgtgccagtgagcccgggagcaaaggtgcccgggggttgctagtacagaggcagacctgggccctgataagggaaagaaggcaaccaacatgtaggggtggctcggtacacccagcaacagtgcgggacctcgagccgtcccacaaagggtggggagttggggcaaacaggtgtgcctaagggaagaagcgtgaaatcccgtcagattccacttacccaccagaaacctgctgcccctgcagtccatgaagcgagactctttaaaaggccccatcggtgtatgtcggattggatcacccctcgtccctgtagccgggtccttcccctttccctcgtccccacacagcccccaggccagccccacgtggctccgcggggaggtcgcagttgtggccacgtgtgggggtcctgcccagttcctgtctgtcctctcgtttcctgccaacgctggcctgtgctgggcagctgtgtcccgccatacatgcctcacattctgcagcttgacaccgcctgccttttgtctgggtgacgctctgtgcagtgttactgagcagatggtatccagagctgcatgaggctggattttgcacttttatgaaggctatctttccttaagatgtctccgtgctgggtggggccagcgcaagtctttgtagctccaagtctttgagctccctggcgctgtgcgggtgcagagtctgagcatcccaagtgctgtgcgggtgcagggtctgagctgcccggcactgtgcgggcgcggggtctgagctccgcggcgctgtgtggacatggcgtctgagctccctagtgctgtgccgatgcggggtctgagctcggtgaccaataggttatctgcattgcttccagggtccgtcctttcctcccccatctccctcccgtggcccaccttgctcttctgtgtttgtgtcatgggcgggccatgcgggctatggcagggtcttcacccaccccctcttctgcatcttcgcaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcggtgagtggggacgcctctgtgtcccgagagatgctgggcttggcgggacagtggactggactcagtgagaagctaaacggaatcaaggggacagtttcttgacccagcaagaattcttctttgtgttctctctgtcttaagtaattaattttgtgtgttgggcatttggctccgtcttatgtcacttagcatgtgtggggaacaggccacatcaccagtctgtgcagcagtcttgcctgtgccagtgccatgggtggaggctgacctcaggtctacagattggaaaccccctccagtgcagtgagcctggcgagtagccgagccccactccctggcgggcctcctgtctcgggcgtggcagtcccgcaccctctgctcagacgctgctgggtacacacccacgccttcgcatatgtgggctccccgttcacggtagtccaggcctagtaatgtgttggttatccttggaggttttaccaccaggccacctttgcaaaccacctgatagggaggagcacttctcttttagctaatctcatctttttatgttaattttgatggcttttgtttctggaaggtgctttttttcctatccctgccccagggtgctggacctggtgcttgttctggcctcctttctgccggctgcaggggtaagatgtggtcctgccctgttcctgaaggggctgcagctctgatggaaaatacagggatttacactcagggctacagccacgggggctgagggccaaggctgcaatctcgggggaaggggaagttggcttttcctggtggattggaaacatcctcttggaggcaaagacttttcctggatcttacagacttcccgggatttttagattagaatattgggggcaaaggagggtgtcttgttttaaggcaatgctacatagacacagtggggaagacctggttcgacggcagataagcagtgggtgatgggcttgaggaggagagtcagggcaaagtctaagactgagcagaaagaaataccaccatctcccatggataagtacgttctagaacattctctttgggtctaatactctgaaatgacatcttgtcttcatgctcgagagagaattacttcactggctccacttggagtgccagtgttcagacaccaagcctgactgggagggttccgttttcttaacaccttcccaccgccgacttccaagtccccacgcgtttcacatgagggcggaggagagtctcgttgcagggtttcagcattccaggcactacggtaggatttttgtggtaaatacaacttttcatcctgagtgctggactaacgtcctcctgaaacgagaagctcggtcccttcaggattatcatagaaaacttccgacttaacctccccaggtcaggaggtgccacttcgaggtggggcaagagctggagcagccccttccagctctagtcaccatctctgcaggctgctaggcctggggcgtccgtgggtggcaggtgccaaggcttccaggcgaatgggagctctggcctggtctttttagtctgtgccctttttccttctttctttaatgaagggatgtttgcagtcactgccatctctaagcaccaagggggctcaccaccccgcaggatagggagagcgggttttattttgcaaaccgactaacgagcacctgggagacatttgccagcctgccccggggctcccgctaggactgaccttaatcacgaggcacagacaacgctcaaacacagtcgggtgaccagcgagcagcctggaggccatggcactcctccacctgagcgccacagccaggctcccagagacgccacgtccctggatgtgcagccacgctctgacctttgcctctcctctccctgcagatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctggttgagactgctttttcttatcaacgagctcgagtaatctggtttctgaaaaccaaaggcttgaggcagtgacggaagcttgcagatggccttctggaagggcccctgtgtcctcaattaacccaggccgcgggaccccgagaaagcagagggtggagccgggcgtcgtcctctgcctgggtccctccgcacacgggtgatcaggtgggggagagaagtgtgtcttgatggaagctcccaacactgaagtttttattgaaatgttatagttcttacgttctgtattttgaaataatttcagattacagaaaagtgacaggagtagtacatagaactctggtaacccttcagctagattccctgtttgcttatatttgattgtatttgcctttctcatccacctacctacctgttcgagagtaggttgcagacagtgtgccctgttactcctaaatacttgcctgtacatttcctaaaaacaagagtttctcctgcatcacccacaatttacccatcacattcaggaaattaacattggtaggatattaccatcaaatctgcaaattctcttcaaattttgctgattgtctcaaaactgtcctttatagaagaagaaagttgaaaaacacgcaagcagcacctcttttttttttcactctctggcctgggaccccatggtgttcaatagccatgtggcttccgtttttatcaatcgtcagttcctcagtcttctcttttctgactttgaattaacttatgacatggagctccttcatgggttcattcagaccttttgggaagtatggccagttatttggtggaatgtcctcagtttaggtttatctaattttcctcaagatatggtttaggttacgcatttttggcagaaataccaccgacatgatactgtgtaccaaggagggctttttcccctcccacttttgtttatttacatcaatatgcagtcttggatccctgtttaattgatgggatattctgattattttgatggtcaggttagccctgatttggccggtttgggcacctctacgcaggctcctgtgccccctcacctcccatctttctctgagtgattccttgctttctgacacagttccaggcccaccttgtacttatttccccagccttggaagaagccatttctccaaggaaaccgtttctctgagtggagaatggttcttagacgccaagatgtgggtgctggaggtgctcattgttactgggctgtcattgcttctaggccctcagcagacagacgtaggaagctgcatgcaacctatgtgaatatcacatacacgtttctgtgtcttactagaaactatgatttcacatccatgccttcggttacagcccagcatcccaggggtcactcttgctggtctgtatttgtatctcctttctgtggctgtgggagccattcccatcatcctcaacacacacacgaggtcaatcttggtgtgtgatgatctccctgacaacactggtggccttcttggctgcgccgtgcctagtgaccctgtcagtgggtctccctggccctgcagaatggtgactcacccttaaagatttttatgctaggtagcaatgcctaggaactgtttcttactaagactatcatttagcttaacttattttttttcatttaggaacctacattatttccttgcctgtcttgaaatagtgataatttaacaagcctcccatttttcttcttaatttctcagaaaattcaggcattttccttcccctctgatctctattctgtgttttttcgttcaggagcatcttctggtttgaggattgaatgcatttttatatcctccactttaggaaaagtctgcccctttgttcctgggaggaaacaaaagtgggtcttatgcttcacatgctctgcagttgttctggggccaagggtcttttagtacacccctggctattccctccagaaccccagccctgagcaatgtcagaga

SEQ ID NO: 12846 - DNA, 57280 bp, Human; identical to SEQ ID NO: 11796

SEQ ID NO: 12847 - DNA, 40546 bp, Human
tagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagccaccctggtgccctgtgctctgggacgctggagggactggaggctggtggggatgcctgcggtgccacccctgggagctggggctggcctcacagctgggcacacagaacattcctccccctcttctcatctccaggaattccatgagtacattcagagctctgctgaaacccagatccagtgtccgagtgcttttgagaggacaagtagcaccatcaaaaagggaaacccattcctttattcaaaaaccacccggggccaggcgcggtgggtcacacctgtaatcccagcgctttgggaggccgaggcaggtggatcacttgaggtcaggagttcgtgaccagcctggccaacgtggtgaaaccccgtctctaccaaaaatacaaaaattagctgggcatggtggcgcatgcctgtaatcccagccactcaggagggtgaggcaggagaatcgtttgaacccgggaggcggaggttgcagtgagctgagatcgtgccagtgcactccagcctgggaaacagagtgagactccatctcaaaaaaaaaaaaaaaaccacctgtcgggctgtggttgggtgtatgacgtgtcttggtccacgtcagttcctggggaatctctgcttccctttctgtgctcccctttcccatgggcccccgcctgccaggggctgcaaagcccgtgcccatcaatccccctgagcaccagcctcgcatgggaaccccccgagacacaggttctgggccacctcacctccagcccagcctcagatagaggagcgcattctctgggtctggagtgggtgcattaactcattgtccagctgtcacaagactggctgcaaacccaggtcccccactgcagcccaccaggccagggtcccctgtgctacctctgtctccattttagttctgaacagtctaaagcatgtgtatccaggggcctttctttggggtccccgtcccagcacccctcatctcccccatgaggacttcttccaagcccctcaagcctcctgccctcagggacccaggatggacctttcctccctgaccttcattcctatccccagcgaggcgacagctgctcttggccaaccacgccccctccacccccacagccacttccacatctccatcagttcctccttgtgggtccgaggcgctctgccgccggcccctcctcacttcttcctccctggggatggatccaagctattgtcctgcccatggcttcccatctcaggaccctctctggccgctatcatcccagcagtggagttcagcccactactctgaaccaggttagtccaccgcgggtcaggctctcccctctcccaggagggtggagaccacaaccaggccatgtatggagcttccctttctcccactctcgggcaccccctcctcccccttcccggcctcattcataggtgtcctggttcccaaccaggcgtgcaggcctgtgtgcagctccgatcgagggctggcccactgccgaagctttcattaaagtgtctgctggcctggtcctgcggagggaacagagccgagatgtggggcagggaaggggtctgcctgtcttccgtgcccccgtggagggcagcaccggggttttgggcagcaggtgaaggctctgtcccctccaccttcaactctggaagccccacctttccatccctaagaagggtttgataaaaacccttgtctgtaaattagagatgggaaatggctctgggaaaagtcagaggtcagtttgggcccgggagggcgacagatggaggcagctccggctggcaaggagaccaggacagaactgccagaggtgggggcaggggacaaggagggagatgaggggagaagacacccaggggtccccccctgctatctccaggagcaagactactctcttctctgagcggccctttccacacctctgcccccaccgaagccctccctcccctctcagaccccttccaggcctgctgagccccctgcacctctttcaggaagcctcccagagcccccgcgccgtgccctcagcaccaggggtcaggctacaaatgccccgcaaagcccagcgggactgtttcctcagccccactggtctctgccctaaagcaggcgagttctggagccaggcaggggtgaggaaggtgccagggttgtggcccctcatcgcccctctatgatctctgacacctctccgggtggcatcaggcccccatcacagcgaaggctgggtggtgggggcactgcgctcaggggggccgtcccgccctgtggcccgggggcgatttcccgcaccggagggctgcagggagggggcgtggtggcgccctcgagatttatgagaaccaggcgtcgacttcctccgttgcgacatccaggcctcctccaggctcccattgtccctgctgcggagagtctggccacagcggcggctcccgcgaagcacccgtcagcgaggggcgcttcgagggcgtccgcgtcccatacacccgccacgcaggacattcccccggccccacgctccgcgctcccggggccaccaccaccgcgggctcgaggggtggcctccacgaggaggagtgggagtcccgcgcctggcctggggccggctcggcgacatggggacccccgcccagatggggcgactcggagccggctcctaacccctctctccgggccccaggaccgggcagtctcggcaccgcagctgcggggagccagcaagcaccggccaccggcgccgctcgggctccgcggatggccgggggcggggcctgagcggcgcaagtgggggcgggagggggcggggccaggacgcgcgagggggggcggggccggggctcgcggcgggggcgggggcggggccggggccgggaggcgcgcgcctcgcgggcggaggggcgcgccgcgctggggctgggcttggagcgcgcggagctcggctgccagagagccgcgcgggggacgcgccgggaccgcgaggagcgcaggagccttcgaggcggtgaacgagggagggagcccagtccgcgcgggccatgagccaccgggcccggggagcccggccgcggtccgggcagcgctcagccggcgccccagcccgctcggccgcagctgcgcgcctgtaggtatggcctccttatacccagttcctcgctccctggtccttcccccgggacccctgtctgtccccggggacgtgcgctgtgtgcgcaccgctgcccgaaggagagcggccgcacgcgccttggtccgcgcgtgtcgtctttgtgtgcgcgggtgggagggaggagggcgcgcgagggaggggaggcgcccccggctgggatctgctccccgatccccatcccgggcggggcggggagccgctggaggggccgagccgcctctggagcagctgcgcccccgccccctgctagggccccggccgggtagtggggcgagagcagccgggtccttagaggaggggtctctggttgggggaaggggtgcccaggtctcttccctacgctgggagcgctgggagggggcgtcaacctagaatgagggtgagggccacgggatgggatcggggaggacctcctccaggccacaggcacgccctccctttggcccaggcccccctttctcgacctgcccagccggggagctccccggagcccccgattgccgggaggatcgtggagggtgcccaagaggccggcgcctttaagaaggggcgggttcgtgccctccattcaggcccttgggcctcggccattgatgaacctgcgggctgcgcgggccggaaccgcgccagcccagcgggctgaagccgggcagaggcagggacgcatcctggccccctgcagccccgaagtgggggccttcagggagggaagtctgcagtgactggagcctctcaggagccacgcaaggcagaccgggcagccccaggcgagactctgaacacgaataagccaggatctacgtgcacttcgagctagtgcaagggagagcctcaggctaggctgtcagacctgggtggagccctaccaatgcccccgagccaacatcacctaccctgtaaaatgggatggtgctgcctgcctcctggctaagggaccggcaactcccggcaggaattgcgtcccagagtcaggtccctggagctcctctgggaggactgggggcagggggtgtggtttccccaagaggttttgactgcctcttgagctgaagcccccactactgtgtcccaccttgaactctcccaacctcttccctcctggcctccccactccacgcaggaagaggttgggagagtgacctagaacttttcagctccaggagctttgggagaggtctggtggtggcggtggtggcacttcttttaggctagtgtggatcagggcatttttgggggtctcagagacagtttcccaccagctacttccttagaggtctgtcctaccaacatacaagaacagccccaccccgtggcaggccggcttctgatgctgcttggttgaatgcttctaggtaatcaagggttaatgcacacgcttttctttttacccttgttgtgaaaaatctgtctgaagtttctaaatccctcttccctacttagcgtgaatctcctagggaggacttctatacaaatacccaggggtgggcttcccttgggggtcttggaagtgggatctccacccaagtgatcctgggcctcccagggctgagcttttggtttcaaacttacttgtgccaagctaagggcatcaggatcgccgttcgtgtcatctttacaacaatcctgtgggtttagtgctattattatccccacacacttagggaggggaagtgactggcccaaagtcccgcagtcaacgagccaggcctcccaaccactcctctctgacaagaggctggcacttcttgccctgcctacccagcctgggttgcaaggaattgggggtttaggggcttcaggcctcctggctgctgtcttcccggggctacgctcattcttactgtccaagtgaggccaggggactggtcagagccctggggcctggggaggtttctcttccctgctcacctggctgggtgccgttttatggctatgctctgtctagggggatagcaggtgtgacccctcaacacgaggtcacagcccacacctgtttgggcagagcaaggcagggcatcgctgtgtgggcgtgcagcatcttttggttcctctgggtgaagcagggtttgggccccattctccacatacttccgggccatctgagggtagcgcccacctggggggtggggaggacaaccagccaggagctcacggttcggtggaagagacaggccacagccatgtggtgtggtggaggggcagggggcaagggtggaggtgggaagaggatcaaggggcgttcccgaggcctctgtgggcttgggggcctgcctgctattggggcagaacaggggaaataggcagtgcccagctgggtgctgaggctctgtgcagaggacaggcaggagttggaggaagaggatgtatttgaacttggatgtggtgagtttgaggtacctggagatcagccaggctgggagttgagctcagagaaaggcccagggaagctttattagcacctgtagtctccagagttcggggatgctcagatcttaggggtgccaccagaggtctcaggaggcactggtatgagtgtcctggaaaagccagaaggcagctgggtgggatgagttggtgaggggcactaagggggtatcctgcaggtttagggggctgggccaaggcccatgtgagagttatgacactgggggagtggaaggggctgagtgtctcaggccaaggctggagatgggaggggggaacctctgctctgcaaccccagaaaggcagggtggggtgggagtaaccagggccagtgcagctggaaccagctcagcctgtcctccacctgcagagcccatccaggaactgtccagcactgggtgctcctgaaggaggctgagtctgcctcttgagcccacaggccctggcttagcttgttgtcctggcccccactccctgcttatctgacccgcacttcctgcagagcccagctgtggattcccccgcccccccacccagccgctcagagtgccccatcctctaaaggtggtcatttcctttcctgaaacagggattcagtcttcccactctgcccttggaagcggagttccccagaaacaggtctcagaaagggaccagcctggaacttggctccatacccccctttttttttttatttttttgagacagagtcttgctctgtcgaccaggctggagtgcagtggcgtgcaatctcagctccctgcaacctccaccacctctggggttcaagcaattctcatgcctcagccttctgagtagctggggttacaggtgtgcaccaccacgcctggctaatttttgtatttttagtagagatggggtttcaccgtgttggccagactggtctcaaactcctgacctcaagtgatccgccctcctcggcctcccaaagtgctgggattacaggtgtgagccactgcacccggcctcccctcttgtccattctgcagccctggaccctcccacctggcgtctgacacacagtgggagctcaccactgcgtggtggccagagcatggtgggtagtcacctccctccccagaaccccatttcttcatctctgcaatggagaaacaactctttcttacagggaagatgtgaggggagaagggttttaacaggggcatggcccactgaaatgtgggttctagaacgctgaccttggccacattggaggctgggtttatgtgttggggcagtgggtacctctgcagctgcctgccaagagcagttggaggaaaagggaatgaatagagctgtgatttttaaacaaattgcttatttaatcttcatgacagccccttaagtttagcactgctgtcacctccatcttaacagatggggaaactgaggctccagagtccaaggggtcatttcactgggtagcaaggcagctgggatccaaacccagacagtctggctccagatctcagacttttaacactgtcccagcatgtcaaatgaccagaggtggccatagggagatgcccaggcagtggggctccctttgctggggaacaactgtcaaaggcaactgtgggaacccctgggactgagggtctgcagacgccggtgccagcagggcttgtcaagcttgggatgtctgcaaaagccggggggctcagcagaagggctcccaccctcccgtggcggtggcaaaggctgagcgtggcatgagaggcctggggttgtcctgggtgcagggctgttgcaatagctgcctccaagcgatgctgctcagggcgagccttggactagaaagttatctgcacggaagagcagctagggaaactaatgctcagaacagccaagaccactagtacctaatcacccatacagaggcatacaagtcccaagggctctgaatccacacctgtccccatcgccagccagaaggcccccacccatccactctgcagcaaagtcacagcaagttcaagggttaagttaagaccagaagccatgcctactttgccttctgccggggtggtggagtgagctcagatattctgggaggggagagttggggaattccagccacatctggcaggaggccctggttcagagcctaccttgtggggatgtggtctctgcggaggtgagcagtaacacgggcttgaaaaccaacgcccacgtattcagcagtgaagcagagactgcgctgtgtgctgtgttcctgaatctgcaggggagagagagactcatacctagtcagcgggtgggagtcactccaggccggagggatgacctgcccaaagagcatctgtgtcctgcccagggaggggtgcagagaggaggctgcaggggtggaagggactgccccaccgaggccaggagggtgcttgaggaacagcaggattgaaggagcctatgttgtccagagtgaggctgagtgggccaggccagtgctgctaaggtcctgaggacccctaagggcagtggacatgagaaggcatggctgggcaggttttctgaggatggtggaggtgagcagagtgaggccttgtctcttgtgtcaggcaaggaggtaccccaagaagaggctgcatgagaccagcctgggcaacatagtgagacccccatctctaccaaaatatcaaaaaattacctgggaccgggtgcactggctcacatctataatcccagccctttgggaagctgaggtgggcggatcacctgaggtcggaagttcgagaccagcctggccaagatggtgaaaccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctatgattgcaccactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagctaagtgagggtgcaggaggaagggggggtctcttggcagtggggcgcagccttttgaggtgctgcatagctagtttgacctgtgggaccactgaccatccctcctcttcccggtgctcctggcctcctgtggctgggatggtgctggggaggaggtggggggtgccagctggaggtgggcggggctcctgcctctccccgcccccagggccaccgcccactgtgccgcgcatcgattggtcgcgggcccattagctggggcggcgagtccgactcatcaatattttaaggaatgacccggccttggggtgcggaattgctgcgcgggcgggggctgaagaccggcttttttttttttttttttttttggtcctccaattgtcagcgctatttttaccgccggaaagccgccgccccctcccccatgccggctggacctactgtctagccgggctggtggctggggtctcttgtctgggttgctggtcgtggggttaggagaggccgtggcctggaaaggcgatgagcagggactccattagacttcccctgccctcctcgctccatcccccagcaccaaaaaccactctgaagcccccatcccatcagagatggggaaaaaaaaaacacattttttcaggaggagaaggcagacagcccagctgagcctagaaaaaccggaggtgggggggtgtaatggatggggggagggtggtctacccgcccagtgctccgaggagggccagcaccacagggggccctggctgggcttcctttgtctccaacgccagtcctcagagaagcagcctgtgagggggagaggcaaccccctacctgtccctagtcccaatggaatgacagcccagtcttcaatgtccaaggccatcacttctgcatcaaaatcaggagcccctagaagccacacacagctccagcaatcccattttactgatagggaagtggaggcaccaagagacacagggcccggcccaggatagagtccagatctcccagagcccagtccagcactgcctggcaccaactcagctggtctgtttggacaccttgggaccataggaggagagctgaccaccaagagagttaaagaccatagggtcttggagatcagagggggagagcagtatagggaagttttcctgggagaagagaaggttttgtttcggtttggttttttgagacagagtctcgctctgttgcccaggctggagtgcagtcgtgcaatctcagctcactgcagcctcaactttctgggttaaagtcctcctgcctcagtcccccaagtacctgggactacaggcgtgtgccaccacacctgcctaatttttgtatttttagtagagacggggtttcaccatgttgcccaggctgctctcgaactcctgagctcaagtgatctacctgcctcggcctcccaaagtgctgggattacaggcttgagccaccacatccagccagaagagagggttttgcacggtctaaagggaggggagatgttgaatagtcggaagagcaaagtccctagagagggcttgaaacaccaaccttggcagcaccaaggttggaggagctcccgccctgcccatgcctgcacatgggttataacattgcagacaccacctcctgtgccatcttgccagtgagtggtcagaaagtgagaagagtgggctcagaggttgggagtgtggtcagtgtcactcactcagggagcacccacggggtcacgtcttgagcccaggtcagccaagctccctacatggggtctcctccccagttctggtcccaaagatgggtggggacagtgcactcctgcccctgccacagccaggcccccttccctgtgtcttgcagcctcccctctacagagaaccatgtccgggcctccctctctccatctgtagccaggtgggggcctccctgctggcactgctgtttggagacttatacctctagctgctcaacctgcttcctctgcatccggggctggacctactgagggcttctgtgccaggcatcaggcccacaggctcctgggtggcctgcagggttaggtaggagaggtcagggcagtcccaacctcccagtgcctcccaggccagtccctgcctaggacctggccacacctgccatgcccttggaagattcctctctaagttccactcccactccagtgagggccacctgagacccacctgcgagagcctcccccagggccctgtcccccatctctgtgccttctccctaccaagggttcctccagccaggaggaagagctgggggcgacagggattgatgtctaggactcggcactggggctgacttcctgcctgccgctgcctgccccatgtgggggcataatcatctcactcagggaccccacacctacccttcccaggctgccaagtcactggctctgagccccctgggggtcctaatggtatagagagagaggtggccaccgtcaggagcactagcctactggataaatggatgggcttggagctcagggacagggtttcatgggttcagctgtggccccacccccaccccaggaaataccacccctgcaggtcatggcctgggcctgggctcgtgaccttccctggaggccatggtggtggtggtggtggtggcaggtgtgttcccgtctccacccctcagggaagaagcaagttccaggagcctggacttttgccctgcgcactctctgtgtcagatggggagacagccatgaggacagacacttgaagtaccctataactggcaccatgcaagagagacaggcaggaggagactgtgggagctcagaggagacacttgtgctggcctggatcagggagaaaggaggggtgtcgggaggcttcctggaagaagtggcttctggattaattattgaagtgtgagtaggagttagggaagaaaggaggaagcacggggcagggaaaaggtcaggcatgagcaaagctcgtgggttcctcagtccccatcctccccccaccttcgtgaactctaaccaccaccaccactacccaactgccaatgtcctgataagtcctgcccccaactcattgttcaggcccccagcaccctctttattttctttgcactcatgaagcccaacgcaataaccacctcttgaaggaaaccttccaaactcccgactcccctcccccagtaccaaggcaggagtctcctaggagaccgctggtttggaaacctgtccttgaagctaagcaggctcagccgggagccctgttctgtccctggggctgtcccttggttattgactgcagattgatggcgaggttgccccaaggagagagggaattcccacggtgccctatggcccagaggcctcgcagatgatctcacagaaatggggcagctatttttacctggcatttaattacatggtttggatcccagaggagagatgagatggtgatcccaggagctgcgagggaggggcattccggaaactgtggggaccctgggaggacaggcgagggcatgatcctctaactcatttccttggaaggatggtcgcttgtcccccaacactaagccggctccttagacagggactccccaggcactacatcaccgcactttatcactattggtaattttccccctggcttggatgggggctgtaagcacacagcaggttggacctgtgtccccagaggcaatggcaaggcccccaggtgatgggctgggcccaagccatgcagtttagccatccagagctgtgaaggatggaggggcctgggaataagaggatgaagctggggtgaggagacagctgggattcctggattggggattcaaaatcggatttgaatgggaattctgggggaagccagattccagaacgtgggaatgtaagtagaagcgtgcaggccattgtgatggaaagaagcaaggtcttcaatgtccgtacaaaaacttggtccctttagccaggcatggtagctcttgcctgtagtctgagctactcggaaggctgaggcgggaggatcgcttgagcccaggagttggaggctgcagtaaactgtgatctcgccactgcactccaccctgggagacactgcaagactctgtctcaaaaaaaaacaaaaaacaaaaaaacgcttggttcttatccacagctttgctttccaaggcttcagatacccgtggtcaacagaggtctgaaaatattaaatagaaaatcccagaagtaaacatacaaatacaaatgtaaattgcaggccagtctgagtagcaggatgaagtctcaaaccatcccgctgttctgcctgggatgtgaattatccctttgtctggcatatccgcactctggatacgacccgctcgccacttaggagttgtctgggttattagatccaaaaaaaatgtagcgggccaggtgcaagtggctcgtgcctgtaatttcagcactttgggaggccaaggccagaggattgcttgaacccaggagttcaagaccagcctcatcaatagagtgagatcccatctctacacacacacacacacacacacacacacacacacacgcagtatacagaggttcagtattagccagtttcaagcatctgctggggttcttgggacatataccccttgaacgagagggaactaccatatttgatccacactaggaggagacccctcaagtcctggagtcactgcagacctgggcgagaaccctggacctgtcttgtcactaacaagctgtttgtccttaggccccaagtgagggcttaggcggtgacagctgtgacatgcctggtgtgccaaactcattcatttgttcattcagtcagtgtttcccaagcgcctgctgtatgcccagcactgaggacacagccgcttctaggactggcaaaatccctgccttgtgaaactggcattctcgggggaagggggtggaggggacacacaaccaagcaactaaatatatgatatgacagccggcaataaggataatggtgaaaataggcagagtgcatgaacgcatcagagggagtattgtcatcagagggatttgtcattctcaagagtggtcagggaaggctatccgccaagccattggttgagcagaaacctgaagaaggtgagggaatgtggaggaaagagcattccaggcatgtgcaaaggtcctgaggtagaaatttggctgctatgcttctgggagggcaaggaggcaggtccagccagggaagagtggcaggaggtatatccagaggggtaaacagaggcagattatgtcagaccctaggggctgtggatagggctttggcttttactctgactgtaatacgaaccactgcaggattttgtgcagaggagggatgtgatctgtcttgtattttggttttgggtttttgtttttgttttgttttgtttttgagtcagagtctctatcaccaagtgaagtgcattgtcacgatcatagctcactgcagcctccaaatcctgggctcaagcgattctgccacttcagtctccttagtatctaggactgtaggcatgccaccacatccagattggttgttgttgttgtttttgagacagagtcttgctctgttgcccaggctgaagtacagtggtgccatcacagctcactgtagcctcaacctcccaggctaaggtaatcctcctgagtagctaggactataggcatgtcaccacattcagatcaactttttttgtttattttttgggacagggtctcgctctgtccccaggctggagtacagtggccccatcacaactcactgtagcctcaaccttccaggctcaggtgatcgtcctgaatagctgagactacaggtgtgtgccaccttgcccagctaattttatgtattttttgtaaagacaggcttttgccatgttgcctaggctagtcttgagctcctgagctcaagcaatctgctcaccttggcctcccaaagtgctggaattacaggccaatgtgtaagccaatgtgcccggccaagacaatttttttgttattactttttctttctttcttctcttttttttttttttttttttttttgagatggagtctcgctctgtcgccaacgctggagtgcagtggcgcgatgtcggctcactgcaagctccgcctccgaggttcacgccattctcctgcttcagcctgtgcctgcccccacgcccggctaattttctgtatttttagtagagatggggtttcactgtgttagccaggatggtctcgatctcctgacttcgtgatgcgcccgcctcggcctcccaaagtgctgggattacaggcatgagccaccgcgcctggcttttttttttttttttttttttttttttttttttttttttgaggtggagtctggctctgtcacctaggctggagtgcagtagtgggatctcggctcactgcaacctccgcctcctgggttcaagcgattctcctgcctcagcctctcagtcagctgggactacaggcatatgccaccatgcccagctaatttttgtatttttagtagagacggggtttcatcatgttggctaggatggtctcaatctcttgacctcctgatccacccgcctcggcctcccaaagtgctgagattacaggcatgcgccaccgcacatggcagtcttgagttttggaaatgactgggctcctgggaggagaacagactttagaggaagtaagatcaggatcccggggaccataaagcagctgctggagtgctgcatgcaggaaaaatagttatgcgaatcccaggacggcagcctggacctggaggaaggagctgagtcctcggtatatttcaaaggtccagccagcaggattccatgtgatttcttcctttctaccgggctttggggaacatcagaagaggtcactgaggaagtgaggtcaccagaggctcatggggaccccacttgaaagcatccatcatcccagcctcttctgccagccccaggaatgaccctgaggtccctgagactactatttggggagagaatgaatgcaggactgccccttctgcagacaccacctcctgcctccccagttgtctttctcttattttttgcagtctccctctgtcgcccaggcgggagtgcagtggcgcaatctcggctcactgcaacttctgcctcctgggttcaagtgattttcctgccttagcctccggagtggctaggactacaggcgtgtgccaccactcctggctaatttttgtatttttactgcaacctctgcctcttgggctcaagcagttctcctgcctcagcctttcgatggctagggttacagcgtgcaccaccacacccggctaaccggctaatttttgtatttttagtagaaacggggtttcaccatgttgaccaggctgatctcgaactcccaacctcaggtgatccacccacctcggcctcccaaagtgctgggattacaggcgtgggccaccgcgcccggccccagttgtctttctctttacacacatccatgctgcttggaatggctgcctgctgtagtcccacaacacacacgtgtgcatgtacacacacacccacacagccccagagagtcctaggggagctggaaggaggggacaggtgggcgcattgatcacaggcctgaaagtcactgcgcgctcttctcgcccgaagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagtgagttaccccataatcccacctagcctggggggaccagaggaggcacctgggcagcagctgagggtgccagggactgcctttggggaccgcgtggtctaatctggttgacagggtgaagtatttggtgccaggaccctgggaggtgggcctgtcatgcctcttgaacaagtcaccccttcaaccccggttcttcctttgcgaggaagggtcctctggctacaccaaagggttctggggcactaattttttcttttcgtgtgtgtgtgtgtgtgtgtccgtgtgtgtgtgtgtgtgtgtgtgcgcgcgcgtgtgtgtgtgtccctctgtcacccaggctggagtgcagtggtacgatctcggctcactgcaacctctgcctcccaggctcaagggattctcctgcctcagcctcccaggtagctgggatttacaggcacccaccacgatgcccggctaatttttgtattttaaggagagacagggttttgccatgttggccaggctggtcctgaactccttacctcaagtgatctgcttgcctcagcctcccagtgttgggattacagtcgtgagccaccatgtccagcctttctttcctttttgttttgagacaggggccgtcactcaggctggaatgcagtggtacaatcatggctcactgcagccttcacctcccaggctcaagcagtcctttcttagcatcccaagtagctgggaccacacacaccgccactcccagctaatgttttttatttttcgtaaagacgggatctgactatgttgctcaagtggtctggaactcctgagctcaagagatcctcccccaccttggcctcccaaagtgctgggattacaagcatgagccactgtgcccagcccagggcaccgttcttgatgttgttcaagagcctggctacctgccctcctctcctgcagcccaagggtgcctggcacctcccagagccgaggcctgcagggatgagggcaggagtgaccgagcacattcgcagagggctccctgggaggtctgtgtctgactccatggggctctgctcttccccagctcagctgccagactccagcccagcccctgcccagggggtccttttctggccagggggatgccaggcttctttctggctgtcaccaacattgttgctcactggcatgcactgacccttcccctcttaggggctggccatcaggtccctggcagtagtgtcacgtcttctccaaggtggcccccctgctttggaaagtgggaatagctgtaacaatagtgcccaccctctgagagcccacagtgtgtccagaccccagcctggtgggcatctgcacagacacactgtcatcctctgggtaccccaccccagcgaggtgagcacatggtccccagattacagaagagagcgcagacagatgctcagagagggaagtgtggcctgcccaacgtcacccagctggcgggtgccagagctggtctaacatggcaggacatggtggcgcgcacctgtagtccaagctacttgggaggctgaggcaggagaatcgcttgaacccaagaggcagaggttgcagtgagccaagactgcaccactgccctctaagctaggcgacagagtgagaccctatctcaaaaaaccaaaccaaaacaaaacaaaaaactgggggccgagcgcggtggctcatgcctgtaatcccagcactttgggaggccgaggcaggtggatcacctgaggtcaggggttcgtgaccagcctgaccaacatggagaaaccccgtctctaataaaaatacaggattacatgcctgtaatcatagctacttgggaggctgaggcaggagaatcacttcaacccaggaggcagagattgtggtaagccgagatcacgccattgcactccagcctgggcagcaagagcgaaactctgtctcaaaaaaaaaaaaaaatccgatctaatgatacctgccaccctggtggtcccaagaacgaaaggaacatggaagtggaggtccttgggcactgagaggtttaggcagggggaggttttgctggtgcagcagccgacagcacccccagggaccaccggggaccccacacccacctcccgcatcagggcccactctgtccctgggtgctctctgagtcacccgccgcttcttggctctctctccatctctcagtctgctggggtgcaggggtgtgggctccccaaggctcattgcccatgagccacatgggccctggaaaagtgacttcccagggacacagctactctctgaagagctttttccccaggtcccagcacccctacacttccctagggcttttttcctgcccaggcccctgcctttaattccctgggagaaatcctagacccctaagcccgactccactccttgtcagaaagggaaaccgaggcccagtgacgggtggggtggggcttacccggggtcacccagagggcagggacagaagcccagggctccagtgccttgggcctgagtgacagtcacagctgcccttctgtaaatagcagtgtctgctgccctcggagaaggggaaggagcagctggtgcccgcccccgccccactccaccgcttagtcccagcagagcccactaattttgctgctggcagagggcagcgttcctgcagggtcactgggcccttcccctcctttgtgtcatgcaaaggtgggggcatttgtgggtattcaggagtcattcccatgggagggcagctcctaccatgctaagaacttggttgagtttcccaaatgtgtctggtcccaggagacaggctcccagggtgagtgagccccctgggatgccctgaatgatacccccactgcctctgcacccacccacggtccagatctcttgcctccaagaggcctagatgcacccttggagcagtcaggagctcggggcctgcaggctcagaagccattgcctggcaccttagatttccctctcacacagcctttgaggtgccagccctggtgagtcaggtctctggcttcctgcctcctcacccctgcaggaagagcctcctgaaccccaggtcccctcattgccctatgccaggccaagccctggggacccaaggaacaatgaggccggccccccgccattagggaaaccactgggaaacctggtattttcaagatgcttgcaaatcttactggggtgagccccggaggaaaagcttgggctacctaagtgttcaccaggtggccagcaccctggaacagcacttttggaggttcaagctctgtgggcaaaggcctggagttgtaaacaagttgaccattcaggcatgtgggcacagtgcgttgtggctggagcaggtgggaggaagctggaccaggactgacggacctcagattccaaactggggaaccacagcatctctggccagcaggatacctgctgaagcttccagtccaggcctccactgcaggcctctgtctgctctgtccccagccccgctggccggcacgatggccacacaccggggttagccaggccccgttcatgcttcaagcctagccctgcacgcgctggacaggggccagttcttcctggaattcccatctgcctgcccatcaaatgtgtggcctttccatttcctcctaagaaagttcctgtcctggagacagcgctgctgggaatctcactcaggccagccccaagggggcctcaggctcacggcagggagctttgaggcagagcgagtggggccaggcacagagtggcggtcccacagagccctgccagctcaccttggatcaaccctgcccgcagcgttgttgggaacactggtcccttttactcactccaggaaacagtgagccccgttctgagtcgggggctccaggccctgctctggaaggtcgggtctgtagtaggagaccagcattttttctttaagcaaccaggttttaagacccatcattttttatttttttattttattttattttattttatattttgagacagggtgtcactctgtcgcccaggctggagtgcagtggtgcaatctcagctcactgcaacctccacctcccgggttcaagtgatcctcgtgcctcagcctcccaagtagctgggattacaggcacgcaccaccacgcctagctaatttttgtatttctagtagagatggggtttcatcatgttgcccaggctggtctggaattcctgacctcaagtcatcctccttggcctcccaaagtgcgaaattacaggtgtgagccaccacacccagccaagaccagcattttttaaaacgtgaactagaatagaatagaaaatatcacactctatcccacacaggaagggtaactattgtctggtgagatgtttgtttcagagatatttttacctgcgtatgtgtgtattgggccccagtgttaaatgtatttctcacaatgggtcaaggtcaaaaataagaaaaccacagatctcgtgggtgcattgggcagagggcagcccaggtggggttttctcctcagggcttggaggtaggaggctcagatgtcaattctggttccgtcctggacttgcaaggtgactataggaggaggtccttttttttttttctttttttttttttttttttgaggcatcgtctcactctgtcacccaggtgggggtatagtggtgccatcatagctcactgcagcctcgaccacctcccctgatcaagcgatccttccaccttagcctcccaaatagctggaactacaggcactcatgccaccacactcggctaagttttttggtctctttttgtttcgtttttttttctgtgaaacggagtttcattcttgtcgcccaggctggagtgcaatggcgcaatctcagctcaccgcaacctccgcctcctgggttcaagcgattctcctgcctcagcctcccagatagctgggactacaggcatgcaccaccacgcctggctaattttgtatattttttagtagagatggggtttctccatgttggtcaggctggtctcaaactcccgacttcaggtgatccgcccgcctcggcctcccaaagtgctgggattacaggcgtgagccaccgcacccagcccattttttggtctcgagtaaagataaggtcttgctatgctgtccaggctgtccttgaactactggactcaggccatcctcctgcctcggactcccaaagtgctaggattacaggcatgagccaccatgcctagccaggaaaaatttctttcttgtttcaaagaaatgccttcctcagcttccccctctgtgaaatggggattgggatacctctgtaccagggtggctgtggcagtctatttgagggccactctaacacctggcagcggggaggggatggaaagggtgtcgggaaatgctggggccactcactatccttcttctggcccccaggcctccaggcccaaggtcagcatcccactgtcagccatcattgaggtccgcaccaccatgcccctggaaatgccagagaaggataacacattcgtcctcaaggtgaggtctcacccctaacctcagagatcctccagctgccccaggccaccttccctttaggtgctacagctccctaggggagcgaggggaaggagcctaaggcaggacagtagtgggagggagccctggtgtggggggttcccagaccctatgacagatgcctagcacatagctaagacttgagtctgggctccacagccaggtgcctcgggcgtcgcccaacatctgggccccttgctcccatttacccctgggcctgggcgaagctcatcagtttcacttcctgccctcccttcccccactggagctagcacacacccacctcgctggtggccagccggcagcagttatgcaaatgttcctgtcccagggcactggagtgtgggaactgggcggtctcccacagagggcacaaaggcatcaagggggggcggggaggcaccccggtgggtctaggggcagcccagcctttcccaggccccacaccgctgccagggtggcctgcaggggtttctgaggacacggctccaggctgccagagctgtggtccctgggcatccgcaaaggatcagagggtgttggtgaagcaatgtccccggggaggcctggtcccacccactcatcctgcatgaagcccccaccctcttctcccagcttctggttgtgtttgtgtttctgcccgttctcatttgtttagtcacggactcacttattcatttagcgagtgtttaccaaccccggaccctgagtcatcccaggctgggggctggggacacagcccctgcccacctggtaccctctaaactgctgatcatgcatgacagccttgaggcagaggggctcacctgcctcagtttccccatctgttcagagcgggattaaaggcagtctccgagaaccctcccagctctgtcatcctgggagcccaacaactacattttttttgttttttttttttctttgtttggagatgggtcccactctgtcacccaggttggagtgcaatggcgcgatctcggctcactacaacctcctcctcccgggctcaggtgatccttccatctcagcctcttgagtagctgggaccaaaggcacacgccaccatgcttggctaatttctgtatttttggtagagacagcgtttcaccatgttgcccaggctggtctcgaactcctgagctcaggagatctgccctcctcagcctctcaaagtgctgggattacaggcgtgagccaccgcgcccggcccagcaactgcattttgacagaggcacaccaccggaagccaacagcacgggacctgggtgtcccagaaacctgggttcaggccctggccctgccactggctgctgtgtgactttgaccaagttccttggcctccctgaaccttggtcttctcatctataaaatgggggaaatggctcctctccctcacagggccgttgggaggagttgagcagaatgcagggttatgctctgggcctggccccagcagggatgtctcctgccctcttccccttcagaggcttcgtatctcaagcgcatggccatgccggtagaactccaggcactaagacatgcaagcccccctactcagtgtgcttggccagcctgtctctccactcaacttgaaccccacccctggggtgccagggcatgggttggggatgctgggccacccatccctccccctgccagcatggcctcctcagaggctgcgtctctaaggcagaggagctgagatcagtggggtgggacatatccccagtggggaggcccagaagggagggaatacagagtgtgagctgggtccctggcctgagttccaggtggtgcccgatggtgaccccactttctttcctgctgctcatgcccttgagccctgctgtgggagagggggatcagccatttgagccactctgaccctatgtcctgtggtctggagcccatctgctgaccgtgttctgcactcccggccaccttcctccccaggtagagaatggagccgaatacatcttggagaccatcgactctctgcagaagcactcgtgggtagctgacatccagggctgcgtggaccccgggtgagtgtccaagtggcccgaagatgggtggacaggctgggtatatccttggtccagccttcaccaggagcagcttcctagcagggcgggagctcagcttgagaaatgagcaattcaatgcgattcaggttggtgccagccaggatcaccctcctttaaaataccccctacctccaatcgccagcagactctgtgaggcctgctctatggggccagggcctggggacctggaaggaagttggaccaggtcttgtcttcaccccaagagagcctcagagcactgggagttgggcagagatggcagtgagtccccaaagggctgggggcctggtgcagtggctcacatctgtgaccccaacactttgggaggcccagctgggaggaccgcttgagccaggagttcaagaccagcctgggcaacatagccagaccctctctctctctctctctttttttttttttttttttttttgagacagggttttgctctgttgcccaggctggagtgcagtggtgtgatcttggctcactgcaatctccgcctcccaggttcaagcaattttcctgcctcagcctcctaagtagctgtgattacaggcgcctaccaccatgcgcagctaatttttatatttttagtagagacggggtttcatcatgttggccaggctggtctcgaactccagacctcaagtgatccgcccaactcagcctcccgaagtgctgggattaccggcatgagccactgtgcccagccaaccctgtctcttaaaataaaaaaaaatagagagagctggagagaggctcctaacccagccctgggctcaggtcagggaagagttgctgttaggcgtgctcacctaacccaaggcttaaataaagagtggaccaatgccaggcagaggaagatgggagagggcagagagaaaagcccagcaaaaagagtggaaatggaactgggcacggtggcatgcatctgttatcccagctactcaggaggctgaggctggaggatcacttgagcccaggagttggaggctgcagtgatctaggattgcaccactgcactccagcctgggcaacagagcaagatcctaactcttaaaaaataataataaaaatttggccggggccaggcacagtggttcatgcccatagtcccagcactttgggaggccgaggcaggcggatcacctgaggtcaggagtttgagaccagcctggccaacatggtgaaaacccatctctactaaaaatacaaaaattagccaggcatcgtggcgggcatctgtaatcccagctactcgagaggctgaggcaggagaatcgcttgaacccgggaggcagaggttgcagtgagctgagactgtgccattgcactccagtctgagcgacagagcaagactgtctcaaaatattaataataataattttaaaaggtgtgcaagtgtacaagcacctgggactcgcagggaacatcaaggcctttggggtagccagtgaggaggagattttgatgagagctcaggaaacgggtaggtcagggacaatgggagccatggcaggtaataggcagagggcagttacggtcagctgtgaacaggaagagcagcaagaaggttggctccaccatccaggagagatgccaggccaggagtaggagggataggcagcccgacaggctgagcaattggcagcagctctgctggctaatggggtgagccaagccccggggggaagggccgctgctttctaattaacagcttcatttaaagaaacacaattaaggtcctgggcgcctcccaggccctgatccacaaagtgattgtaatccctcctccaccgccctccggaccatctgctctgcaaactctttccccagccgctgtgaaggtgaacctcacttagtggaattttcgagctggcagggtcccagacacctcatgtcacaaatcgggagagaaaccttcccaccctctgagggtctgcacgggatcccaggaggagcccagcccctcaaggatagtgggcagggatcatgggccctcagtggggactgtccactcagtggtatccgggccaagagagagccttccccttggctttctgaagtttcagtggaaaatcaatttgcaaatggcagataaatgagagaaaaggcatacaaatttatttatttatttttattttattattttattttttagaggtaaggtcttgctctgtcacccaggctggagtacagtggtgcaatcaagctcactgcagcctcgacctcctgggctcgactgatctgcctgcctcagcctcccaagtaactgggactgtaggcacatgccacgatgactggcttaatttttttttttttttgagatggagtctcgctccatcatccaggctggaatgtaatggcacaatctcagctcactgcaacctccacctcccaggttcaagcaattctcctgcctcagcctcccaagtagctgagattataggcacctgccaacaagcccagctaatttttatatttttagcagagacggggtttccccatggtggtcaggctcgtctcgaactcttgacctcaggtgatctgacaacctcatcatcccaaagtgctgggattacaggcgtgagccactgcaactggccttttttttttttttttttttaagagacgggatcgggatcgtgctatgttgtccaggctggtcttgaattcctgggttcaagagacccgcctgcctcggcctcccaaagcactgggattacaggcatgagccacagtgcttagctgcacaaggcagattaataggagaaaaagcatgtaaatttatttaacgtgtatacataggagccttcagaatgaagactcaaagatacaggggagggctgggcgtggtggtgcacgcctgtaatcccagcactttgggaggctgaggcaggcacatcacctgaggtcaggagttcgagaccagcctggccaacatggggaaaccccatctctactaaaaatgcaaaaattagctggaggtggaggcgggcccgctgtgatcccagctactcgggaggctgagacaggagaattgcttgaacctgggaggcggaggttgcagtgagctgagattgcaccactgaactccactgggtgacagagtgagactcagtctcaaaaaaaaaaaaaaaatcccaggcatggtggctcatgcctgtaatcccagtactttgggaggccgaggcaggcggatcacgaggtcaggagtttgagaccagcttggccaacatggtgaaacctcatctctactaaaaatacaaaaattagctgggcctggtggtggcatgcacctgtaatcccagctacttgggaggctgaggcaggagaatcacttgaacctgggaggcagaggttgcagtgagccgagatcacgccactgcactccagcctgggcaacagagggagactctgtctcaaaaaaaggatacagggaaatggtccatttttatgcttaggttcagcaaagtatggacagcagtgtagaaagaggattggatacaaagggtaggatctaaagggaatagactgagcaggggacccagccaggcctgtctgtccagattcttcttggcctctctgagtagcattccttccttctgggtgtgggacagaaccctatcttgaatgggggtcttatgacctacagtcaaaccaggcagattgggtaatttctttctttctttttttctttctttcttgctttcctttccttcttccgtttctttctttccttttgtttttactttttttttctgctccgttgcccaagcaggagggcagtggggcatgatcacagctcactgcagcctccaactcctggactccattgaccctcctgcctcaccaccacgcccagctaattttcttttattaagatgagattctcagggccgggcgcggtggctcatgcctgtaatcccaacactttggaaggccaaggtgggcggatcacctgaggttgggagtttgagatcagcctggccaacatggagaaaccccatctctactaaaaatacaaaatcagccgggcgtggtggtacatgcctgtaatatcagctactcgggaggctgaggcaggagaattgcttgaacccccgggaggcagaggttgcagtgagccaggattgcgtcattgcactccagcctgggcaacaagagcaaaactctgtctaaaaaaaaaaaaaaaaaaaaagacgtgttcttgcggccaggtgcagtggctcacgcctgtaatccccacactctgggaggccaaggcgggcagatcaccagtttgagaccagcgtggccaacgtggtgaaaccccatctctgcaaaaaatacaaaaaaaaaaaaaaaattagctgggcatggtggcgcatgcttgtgatcccagctactcaggaggctgaggcaggggaatcacttgaacccgggaggcagaagttgcggtgagctgagatcgtgccactgcactccagcctgggtgacagagcaagactcccatctcaaaacaaacaaacaaacaaaaaagatgggggtctcgctatgttgcccgagctgatctcaaactcctggcctcaagtgatcctcccacctcagcctcccagaatgctaggattacaaacatgagccactgtgcctggctggataatttctttatgacaagtttttacatagaatatttttaggttggccgggcgcagtggctcacgcctgtaatcccagcatttttggaggacgaggcaggcagatcacgaggtcagtttgagaccagcctggccaacacagtgaaacctcatctctactaaaaatacaaaaaaattagccgggcatggtggcagatgcctgtaatcccagctactcaggaggctgaggcaggagaatcgcttgaacccaggaggcagaggcaaagtgagccgagatcgcgccactgcactccagccctggcaacagagtgagactccgtctcaaaaaaaaaaaaagaatatttttaggttttatgactacgttttgggaaaaggggttctggtttctgtgacccaccttgggaaaaagggacttttgtttctctggtgcctctggggagaagaggactgagagacaagtaggcaggagaaggtcagagaaaaacttttttgttcgaggctgctgctgaggactttgttttgcggtattgttttctgagccccaacagtggcctggtcaatcacacggtggccacagagccagtgtagggtgggacagagggacatggaggcagagggaggtgaccagagccaggaggcctagatgctgggccatgggactgccagccactgcctggccacataagtagcctgtggtccgagtccaagtcccacggcaggacatggtttccatttcttgtctccacagtgacagtgaggaagacaccgagctctcctgtacccgaggaggctgtctggccagccgcgtggcctcctgcagctgtgagctcctgactgatggtaggtagggggacagggttgaaggaggggcacactcagggtggacagataaagatacgtgcatcttacctgccacttccccagcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggtgccagtggggacagcctgctcttcccatcccacctctcctggacccccacccccagccatggccacccatgggctccctaaaccttgctaagcctcagaagctgtgacatctcatcctcctgggtccttcacacgtctccgaagtacttctggcttttgtagactggtctaggaacctggcccctcccactggacccagtttcaatagaaaatgttcacaggggccgggtgcggtggctcacgcctgtaatcccaacactttgggaagccaaggcgggcggatcacctgaggtcaggagtttgagaccagcctggctaacatggcaaaaccccgtcactactaaaaatataaaaattagctgggtgtggtggtgcacacatgtagtcacagctactcgggaggctgaggcaggagaatcacttgaacccgggaggcggaggttgcagtgagccaagatcacgccactgcactccagcctgggcgacagagtgagactatgtctcaaaaaaaaaagaaagaaaagaaaatgctcacaggggctgggtgcagtgtctcacacctgtaatcccagccagtgttttttgaggctgaggatcacttgaagccaggagtttgagactagcctggacaacatagcaagacgctatctgtacaaaatttttgagacaagagtctcactttgttgcccacgctggagtgcagtggcggatcacaactcactgcaacctccacccccaagtccaagcaattctcacgtctcagcctcccgagtagctgagattacaggtgcccgccacctcgcctggctcatttttgtatttttagtagagatggggttttgccatgttggccaggctgatcttgaactcctgccctaagtgctggaattataggtgtgagccaccacgcctggccacaaacatttttgtgcctgtagtcccagctacttgggaggccgaggtgggaggatcacttgagcccaggaggtcaagcctacagtgaactgtgatcacaccattgcactccagcctgagcaacagagagagaccctgtgaaaagaaaaaaaaaaaaaaaaaaagaaaagaaaagaagaaaggagggagggagggagggagggaaggaaggagctcacagaaaagggtccatagggttggaatcagggattgggaacaggcgactggatttgttcctaagtttgctgatgacttacagagtaactccaggatagtccttcacagctctgtgcctcagtttacctcatagacttcaccagtgggttgggtcagctccctgcccaactctaaaattattccagctgggcacagtggctcatacctgtaatctcagcacttcaagcagccaaggcaggaggatcgtttgagcccaggacttccagactagtctgggcaacaagactctgtctctacaaaaaataaacaaaaattagccaggcattgtggcacaggcttatagtcctagctacccaggaggctgaggtgggaggattgcttgagcccaggaggccaaggctgcagtgagctatgattgtgccactagacttcagcctgggtgacagagcaagaccctatctcaaaaaataaataaataaataaaattatttggctgggcgcagtggctcacacctgtaatcccagcactttgggaggccaagacgggcggattgcctgagctcaggagttaagaccggcctgagcaacatggtgaaaccctgtctctactaaaaatacaaaaattagcctggtatagtggtgcatgactgtaatcccagatacttgggaggctgaggcaggagaatcactagaacctgcaagacggaggttgcagtgagtcgagatcacgccactgcattccagcctgggcaacagagcaagactctgtctcaaacaaaaaaatattcaggccaggtgcagtggctcacacctgtaatcccagcactttgggaggccaaggcaggaggatcacttgagcctaggagtttgagaccagcctggggaacacagcaagactccatctctaaaaaataaaaaataaggctgggcgcaatggcttacacctataatcgcagcactttgggaggccgaggtgggtggatcatctgaggtcaggagtttgagaccagcctgaccaacacagtgaaaccccatctctactaaaaatacaaaaattagttgggtgtggtggtgggcgcctgtaatcccagctactcgggaggctgaggcaggagaatcgcttgaacccggaaggcagaggttacagtcagccaccgggattgcagcattgcactccagcctgggcgacaagagcgaaacttcgtctcaaaaaaaaaataaaaactaaaaaccaaccaactttttaaacattattccaacagcattttgcatgtaaaaaaaccaacaagacgtcacctctcttctcacatttatttatttgtccccctttctccttccccccatgttcctcacactgtcatccccacctcaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaaggcaagtgtgtggggggcgccatgggggtgcagtggccagccctgagggagaggggtcatggtgaccccggtcctgaggctgtgccctggaagcagctgcaggcgaacaggtgtggcatgacttcccacgggccccactcaccccagccatgctccgtgagccacctgcgtccctcctacacatcactgagggactgcagtcagccctatttcagcctctgcattctccagaaggggaggccacctactggcggctgagccctcaggaggctgggcccttctaataacccaaatttgcaaatcctttcagctcctgcgcgcgggggatctcatagcactggagcttcggagggtctccacccagagatcgcccagtggggggtgggagccaaccaaggccctcagagccccaccttctgccccaccgacctcagacagcccctcttccctgcccaggttaggtcaccaacccctgaggaacacacacgggcaaaccctagagacccagcaggggaggaggagctgggctgggtgggagagctgtgcagggtctagggggtggggttcagcattggaggggacagcctgatcagagacctgcaggggagggagaattgtggaggggaagacagtcaggaaggcgatcccgacagcacccagctggatcagaggcatgatggtacacccaggcggtgtgctttcaaggaagaggattccttgctatattgacctgaaatgctttgtttttgtttttgtttttttttgagacagtctcgctctatcctccaggctggattgcaacatcgcaatctcagctcattgcaacctccgcctcccgggttcaagcgattcttgtgcctcagcctcccaagtagctgggattacagacacgtaccaccacacctggctaatttttgtatttttagtagagacagggtttcaccatgttggccaggctggtctcaaactcctgacctcaggtgatccacccacctcagcctcccaaagtgctgggattacaggcgtgagcccccacgcccggcctattgacctgaaattcaaaggaaaatttgacagcaaaggcaaatgattatgggggggtgcaatgtggccagagggggcaggaacctcagtgcccacccccgcatcccaggtttccgataaggaaacactcagcctgggctcctgccaggacggatttcctggcggcccctactagaggagggagaaccttaggactcctgctccaggcctgcagctgggggacagtgtctctctgcagggaccccggctgccctaacccctagtggctcagtgcagaacctctggtggcttctctcctcctccaggttggccccaccgtgcaggaggtagcacctccaccagggacatttccttggcaagcagccacccttacagttcctccgacaaccaggtgcttaaggccatccctggtgacgtgcaatttacttctcagccagtgctgctccaggcagcctcccagagggcctggatctgactcatgcccaagccagaggctaggatgggggaacaaagggtgggtggcaagctcctctccttcctggaacaagacccagccttgaacctgcctctcacctctctacccagctgctcttctcccagagtggagatgactgccccaggcctgataagtaaatggtgggacaaagcaggaaccccagcctccagcttacatacctcctgggagggaagatcactaccttcccagaggcaactctttccaccttcacagaataaatgtctggaaggtctggcagaagattgggatgcgtccaacttgcttcttctctccccagggacccagctgtgccctgcgcaggctctgcccagctatgaggctgtggtgggacccctctgtgctgtttctttcgggctgagtccctgcattgtcctagcaacttattctgctaagtggcagagctcacttgtgggaccgccaccccgctccagggattgtctgtatttttttgtttgttttttaaagggttggggggtatctcaccatgttggccaggctggtcttgaactcctgacctcccgtgatccattcccctcagtctcccaaagtgctgggattacaggcgtgagccaccacacctagcagattgtctgtcttttatgcaggtggccagaccagctccccctcctgggcttggggctatgcgtgtaccctcaaaccactcctcttagctcccctcttgccccacacaccccagagatagccacttgtttctgcagtgggatatatgttgagcaaaatagggcttaagtcagagacctgcagctctccactagacaccacaggcctatggtttcttaccctgaggcacctgcctcacacaggccctagagacctagagagaagccagccctgttccagctgttcccacagcgtgcggtcactcctccccagccagccctggggagctttccatgcctccgggttttggctctgcagggacagagggccaacctctagcctcctgggctgggggaaccacccaaacaggagttttcttccctgctctgtgctctgtgaccatgggccagtcactccccctccctgggccttggttttcctatctctaacatgggggcagtaatccctatcttctggcattagggaggggattagagattataggtgtgtagggcatgggcccatagtggaggtgctcccagcatggggacaatgcctgatgccttccatctcagcctgggtccgttgcccccattccccatctccagatggggctcatgtgtgaggggcccccggccctgacacagccccatacagcccctgtgagccttggtccttccatcaacccccaaaggcgcttacccaggtgcccagccccggacctgcccctgaccacacccacctgtacccacagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccaggtaagatgccgccacctggctggtgtgattactcaagaagacttcccgttgattactcaagaaggtggtccctggggtgggatgagccccaggtctcctgtcccatagcctcagccgtgtccctcccaccctagcctagccacagcaatttcaagcagtcacgtcataaggaatggaggcagaagtggcagcctagaggcagccaggtccctaatgattcctggcaaggggaagggggcgcccaacagcagtgcaggtgggtgtatgggggtggggacaggggtgtggattggggcaagtgggatgaaaggagctgggcatatggattcttaagccctgcactggggaggctcagagcaaagctgctgggaccgagcactaagggcatgggtgcatgtgcatgcgtgtgcttgtgtgtgtgcatgagtgtatgtgtgcatgtgcccgtgtgcgtacgcttacgtgtgcgtgtgtgcgcatatgcatgagcgtgtgcatgcgtgcatgggcacgcgtgtgcttgtgtgcctgtgtgcgagcgtgtgcattatgtatgcgtgtgtgtgcactcctgtgcatgtggctatatgggcgtgcacacgcgtggttaggtacatgtatgtgtgtgtgcttctgtttatgcatgtgggcgggtgtgcttgcatatgtgtccgaggacatgggctgcaactcggaaacctgagcgtgggccctggccccttgagggatcccggcctccctgcaggatgtggccagcccaggtccccactcacgccctgccgtcgccttgttgcagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcacccggctctcctgtcgtcctttctcccacggggaaggcggggactgcggggcagccactctcagagacccccgtccatcagggacccccgtccagcccagtgtggcctgacacctgccaggcccccttgcagctctgtctctggtgggacagctgagggactccccatggggcgtcgggcagcacctgaaagagggcccaacagcaagggttagggcttaggatcgggagggggctttactggagctgtgagggagagagatgggaggtggtaacaatgaggggtgctgaaaagagaggagggggcattcaggacacagtgagggatggggagcacgcccaagtcatacggagagcttggatgccaggaggaggagtcgaggcccggactgggagggtaaaggcgtttttagacagatctatgaagcctggcggtgtggacagggcggcagggcaggaagaagcctggcggtgtggacagggcggcagggcaggaagaagcctggcggtgtggacagggcggcagggcaggaagaagcctggcggttgtggacagggcggcagggcaggatgtctccatattagcccttaggggattgggcaatggaagaggctggatttcccagctcggtggtagacttaaacttggaagaagcttaaagagccctcccacccaccgcgctccacctcattcacacccagcccccaccccgtctcattcccaccccacacctacccacaagtggaattccagctgtgactcccatgaccccaggctctggagacactgcttgctggcagtcccaggaccccagtccccaggcagtgttcaagaaagatcctgttcctactaagccaaacctctgccttccccacaacaccccagacctggggtcacagacccacagtccccttgcccaagactggccttgcagggcttgggtcaatgatgcatccatctatttttctttctttccccttccttccttccttccttccttcctctcttctctttctcttctctttctctctttctttccttttctttctttttcttttttgagacaggtgcagtggcacaatcttggctcacttgcagtctcaacttcccgggctccaactatcctcccacctcagcctcccaagtatctgagactacaggcgtgcaccaccacgcctagctaattttttttggtagagacagggtttcaccatgttggctaggcaggtctcgaactcccgagtaatcctgggtgggaggcgatccacccacctcagcctcccaaagggctgtgattataggcatgagccactgcacctggccaatgatgcagatttcagatccctagacatctaaagctctcaggactgtaactaagacacagcctcttccccataaaaggggcatgaacacccttgggtggctcccagggctttcagccacccagtccccatgcacaacatcatcaggaagtgacagagtagggccccctgctaccaccatgatgagggaagaatacaaattcagcgatcaggagagcaccctgctacctctgcttctagcacctccattcggttgtggctggagtccttctgcccccgtgccctggtggtttggggtctatgctaggccaagtgcaagtccccattccactccaacaagaacagagcgggctctggactgaggcttgggctgggcagaggaacaggggcagacttaagacttagacccaccaggtgggggcagtggttcacgcttgtaatcccagcactttggggggccaaggcgggcaaatcatctaaggtcaggagttcgagaccagcctggccaacatggtgaaacccctcctctaccaaaaatacaaaaaaaaaaaaaaaactagccaggcgtggtggtgcgtgcctatagtcccagctacttgggaggctgaggtgggaggatcgcttgaacccgggaggtggaggttgcagtgagccaagatcgcgccactgcactccagc

SEQ ID NO: 12848 - DNA, 51620 bp, Human
  misc_feature (1)...(51620): n = A,T,C or G
gaccattccaagccccctccaatcccctctccacctcacagctcggaggatcttttcaaaactctaatctgatcatgtcgtatttctgcttaaaccaccttaatgacttacacttttagccctaactaccacttacaaggcctagtaaggtctgacccttgcccacacctcagggctcattttgcatgctgtactccttcactctctctggggccaaccacagtaaatttctctcattctttgagaggcatcatgctgtcccctaccccttacccccaaagccaccaaggactttgtacatgcactttcttccccacttcatgtagttaatcccatgcttctttctgatctcagtccacacatgacttccttggagaagccatcagagatctctccaacaaagtcaaatccttttgctatatttgcttatggaaatatggcccccatctttgcagcatacatctcagttgtgattttgtatttatgtgtgtgggattatttcacttacatctgtctgcttcactagactctaggctctgtgaaggacaagaaccctatgtgctcttgttaagtgcagtgcttggcacataatgagtgtgcagtaaatagttgttagatgagtgaatgggaagaccagagaacgctcttgcatgttattagctgtagtcacagtaagaaagtcctgtttctctggtccatccactgggacttggtaatggtgtggtcataggtaactcttctagacaatggtatttatgataacttcatcaggaattaaagccaaagtgctgaggttttgtcctggttctgcagtagtgtggcctcaggcaggttataactttttaaagtctaaattctaaatgtcacctacagatgagaagtctccttctgcctttggcctctcaccagctgctttctccatgtcctctcctccctccctttttgcaaagctaggggagggcctgatgcagagctggcttccctgtgggaggactggaaggaaccacacagcatggatactaattccatgagtccacattggtaatcagaaactaggcctgccttgctatttagaaactaatgctatattctatttcttcagataagccagttttgaaaaacaaggcttgaatatttggcaggacaaggagctactcccaaacacagtttcttgccagcaaggatgtcaatttatcaaattgaaagggtataacctaggagcctcggttaggtgtactggctccctttctcgtttgattagaatgacatacacgctaattgatctctttccggctcagtcatctccatgcagtaaagaatttcaagctgctattgtttatttcctatgtattatgtctaaatatttcatggtgaatgaagaagagtgactattttcaaactggaatgcttcttcagaagaaacccaaactggaatgtttcttcagaagaaacttcagaagtcaccaaaaaggtgactcctccatctttctgattcttggatcctaaagtatcttcagcaagtgaagcccagtttcataaccgaagaggtgactccatctgtcctacagacttgcagtgtgaagcttgcaatggtttctctgtatgttaatttctccatctctaggatggcctatgtggttcttactaacctcagagtggtatcatgaagccactgaaatgataccagaagaaaacaagagtgattaatcttctaggatgataaatctatattttcttcaaattcttcattttgcataaaaacctttttcagaaaagaatgttaacattggatatatctacacctgatttgacagttccaaactacaccccaaccacccacttctgaatgagaagaaaaaaaaatcagaagcctgcaattgtgtaacatgaaaatcttttctggaccagggcccgtcactgtgatttggcaacacaactggcacatctcttttctcatctcttgaaaaaaaccaacagagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtaagtatttcctgatttcctacattcagacccaataatgcctccctagctgccaggctggtagtggagagttttgtttggtttgttttatttaagttaattgggatcagattcatcttttccaggaagaaacaagttactagaggctgtttgactatttaggggttgtgatattaagttttcaattacctattgcatttacccacaaaagttgatgggaatggaagagaaggagtgagtgaagtgccttctttatttcaggtatttacttatactctaaaatggctttgtgatttaaaagtcagtcgttagtgttttcattgatcaattgatttgtaccctgcttgcttcctccaagcattggggtgactcagccacctggaataagcatcaatagtcaataaatatagttggcaaaaatatacatatggatggcaagaaacatctcagtatgacaagtacttgacaagtattgtgctgtcagatcacttgatttttaagaaattaaaaattgcactaggtagaaatagtgtaccaggcaatagtccagctttagttttgtgtcatttttggtctctatttaaagcaaagtaatctctaaatatctttggagatttacaagacaattacaagaaccttctagatataaacgagggacgacttctaagaacctcttgaggattgcccagagatttactcagctattaacaagagactggaaagtttacttaagtggtctgggctttcattttgctgcacgttctagcattctctgtatcctgaagttttacctggaaccaggccatttgtgaatagaaatgtattatcatgtggcaactattgatttcaactggttttttttatcctgcttaaggatttcctactccaggtataaataatttcattttccttaaagttatagagaatagcccataaactctgtgcattaaaagttctttgcttggggcaaatacataataatttagaagaataagcttggaatgcatcagctaagccaagaatgagaaacaaatgtgaactcaaaaaattgaactagtggaatgtgaagagagagtcataagttttctggtctctgagaaacacattagaccagattcgttacagtattttcagggagttacggacaatttcttgcactcctcatcttcccttggcattcattcctggctgctctgaccacactcactgtcataatgtagcaagacattatgtagtaagacattatgtaagtagttatttctaactaaaataaaagaaataaaagagagaagatgaaagtcagtgattcttatgattcccggtcactgcttactggaaaatctttcttagtgagactgagacccctctgtcatgttacttgacaatctggccccaaagaagcagttgtcaatacagagtgattacagcctcacagtgacgagtgagtcagaaaagtgaagcaaattcagttacaattcttagtgctctgcagaaaacagaggaggaaatgaactacacatctttttttttttttttttgcaaccaaaaagtttaaaaccctctgtatttcttaagaagaacctgtttcataatcccgtgctttctgtgttgaaagtgaaatttgctttcagcagttcactgttcaactggccttgtgtcttccccactatgcaaggtaggggctaaataaagaacatcttgatattgtctgttgaaaaattaaaacttgtatgttctggataaagccagtcatttcctgaaatatttaatttccatttatactatacatttattttctaaagtgaaccctaataaaatctgcaaccttgattatcatcttcagttttgttggagcttgtggggatgtataaacaaaaagttcctgcacaaacacaatttttttaaaccaagaaatctacatggttttgctgaaagtttatccaaagtaattttctgctttattagagaatgtgcattttgccttgtattttctagtaaaaagctttgtacattgataaggcaaagggaaggggaacatcgaaaagatggcagaggatataaaggactcagtctttcaaatatgtgagattgttttttttccgccaaccttgggagtctggttctattttttttccctcctttcaaaaactgctcttatggggagcatctcaaactaatctaacaccatggtataaattacgggtccccaacacatgggccacggactggtacaggtggtccctggtgctaaaaggttgggaacagttggtataaaggactgataaggcctactggtagcattaagagaaaagaaggtccatgaaaaattctttataaactacaactaaaaccaacaacaattaagtcataagccaaaaagctagctctaatttggccttttagtcattgggatacgtaggcctttcacctttactagtgtggggggaaagtttgcaatgcaaaaggctgatctcttccttgggctgaacttcagagaatctctagtcatgtctagtcatttctcacagggactatgctcactcctactactctatatattctcctctctcttcaaacttttcaggattctttgatacagagctcatcttattgaagatgctgaagtgaacaacccagcaagcagctgtatttcctcctgaggtggaaggacagctttccagggctggacttttgagtagataacatactgtgtagtcggacagatgctgaattcttttctcaccctgtcaagcttccgcattagaggtctaacttttggcatctcttagaatggaaaaaaatgcaagtacttctgctaaaagtagtacccttgatctttaccttcagtgccctgaaggaaatagaaagaaactatcctggaacacagactatggaggaaataggggagtgggcagtacaggaaggaggaaggaaggacagggatggttgattgtatgtgagaaatttcagacactgcagtgttcccttcttcctgctcctaccttccaccaggactgggtgagaaatcatccctccttgctggggtcacagagtttgtctctccattttgagaggattctcaatcagacatgctggttatagacactctagggctttaaaattattattacaaagtttgttcagatcttgaagtaggtctattctatcttagggagcttttgagacaaaagaatctatggtcaggatttagagtgaaatcagaaagtttataagccaaattaaaggaaacgtccactttgcagggcagaatccaggacaattttggtctagtacattatttggaatgcccaggtactggcaggagagctctgagataagggtgggcagatatcactggccctttttattggtggagaagctgagctcaggctgatgtaatcatgcatcccgggaatcagcccagagcccagttgccctgccctgggcacacactcgcccttggacttccactgtgctcttcccttgagcagcacagagtgttcgcttgtccaaattctcgttcctgtttgaatgtttcctgaagagagagaaaggagagcgatcaactgcattttgccagatggagagacaagtgtaacacaattaagagacttatcagcccttgaatgaaagagctgggcttggtatcttgactccagtcattccctaataccatcatttgatgagaattaactcctttcatgtgaaagcccaagcgaacttgacaaagtttacagtttaaaatacattagcagtgtcaaaagatgattttacagaacagacgtgatcgtggtggggatattttacaggagatctgctagcagagtcttgggatctcttcaccacctacaaacacattcaaacctcaggtaacaccagggttctgaggtggctcagtgatgtcttcagctctgataaacacattgaccaagcattgcactgtgtttttcctctagtatttctgttttctagcttttcctcaagaccactcttttggttcagagcaaaggacctataggaaagtgggcctcaagagaccccataacttctctgtcttgctttctggctcaacagccacctattctttctctgtttcctccatgcttggttcttctagcttgctattttacaaaaccatccatctctccaagtctagggtgcccaggactgagggtcacatggagctagagctgtcagttggccaacagatgctagatcagaagcccctactgtcagcagtgccctggattctgcctgtgggtggtttgtctgtccaagtcgtgcaccatcctcaggccctcgctcagaaactttggaataagatggtctctgttgcctgactcttgcatcattcaattgagagaacagacacccacagtcttgcagcattttatcaaaagctctttccaccacagcagaacatcagaggatgtctaccgtcagttttacctgcctcttgttattatgatttatgttcaatgctcagtccttcaaggattggtacttctgtacttgggagttctgtccctttaagaacgtctgaggttctaaatctgaacatgcagaagtgctaaacactggggattctccttagatccttgccttgaagcaagagtttaaagactcgaggctgtcttctgtcaaatatgatgacgaggacaagagagggcaaaggaggttaacactaagcatactctataccccagacactttgatccttaaactaaatctaaactaaatctaatgaggtaaagatactgctctcattttatagatgaggaaattaggacttagtatgtttaagtcacttgaccacaagcaagtgtgtggtggagctgagattagaatcaaatctctccagtttctcttaaccacgctacagttaacattctaatatatgcttttgaagttttactacagttgcctataagaatatatattatagttttatatgtttaaaaatttacatatatagcttcatagcttatacatcttctccaatttgagactttttcccagagacactttctgaaatttattaatttgggaacatgtatgactggtttatgtacccatcgccctctcactattgattacaatcaccaagactgctacattgaacatcttggtacatgtctccttgtacacatgttcacgagtttctctggagtatatacctagaagaggacctggtggtcctagggtatgtgcatcctcaactttatgtgtattataaaattgctctccaaagtgatttcaaagttgtacttccagtagcgacatgagttcccatttatcacatactcaaccatccttgatatcatccaacttttatattttgctaatttgagagagagaaaaatggaatttcactagtaattgtactcaattccagtgcagtgattatcttttcatgtatttactaaacgtttaggtgcctcttttgtaaattgcctgattacagcctctgcacctttctctttgggatactttactttttcttaattgttataggatatttatatttattttaaatccatacattaaggtattttgtgttttcttattgaggtttaatattttgcttttcatatttgtgtctttaaataattagaatttatttggtgtatgatgtgggattggggtctattatctatgtctgcaaggatagacaattgtcccaaggccagttttgactgtctatcttttctccactgattgtgatgacattcctatcatacacctgttcacacgcatatgtggttctatgcctagactattcagtgccattgatctgtttgtccaaacttgcactacctcatataccattttttttgttgttgagaacattgtttgttgttgttgttgtctttctacttttattaccaaggttatattagactcatgaaatgaatcaaaattttccctttttttctattttctggagcactttgtaaaatgggagttatgtatttcttgaagattactcagcatgtgcacgaaaaaagagagggatggacagatgacaagaaaaatttctttaaaagttacaggtctggccaggcgcggtggctcatgcctgtaatcccagcactttgggaggccgaggtgggcggatcaagaggtcaggagttccagaccagcctggtcaatatggtgaaaccccatctttactaaaaatacaaaaattagctgggcatgatggcatgcacctgtagtcccagctactcaggaggctgaggcaggagaatcgcttcaacccggaaggtggaggttgcagtgagctgagattgcgccactgcactctggcctgggcgatgaagtgagactccatctcaaaaaaaaaaaaaaaaaaaagataaaagaaaaaaactctactatacctgaggtgacatcctcttttcaatttttaaaaagaagtttgttttccatttcagtaatttctgctttgatcttccttatgtcctcctattgagttgatcagctttctttattcttgccttttctcctctgtgtgccctttctattaacgtatttacccttaggctgggcacaatggctgatgcctgtaatccctgcactttgggaggccgaggcaggtggatcacctaaggtcaggagttcaagaccagcctggccaacatggtgaaacctggtctctactaaaaacacaaaaattagccaggcatggtggtgtgcacctgtaatcccagctactcaggaggctgaggcaggagaattgcttgaacctgggaggcggagattgtgccaaagcactccagcctgggcaacaaaatgagactttgtgtccaaaaaaaaaaaaaaattacccatatatatatatattttttaacttaaagtaaatcaatttttcttctgaacaacacaaaaactttaaaaaattctaactccaatcaaccactctatcttacatgtcattgttgtctaatatttaaatttttccctcattattattgttgttactggtgttttaaaataaatatttttgtttgcttatttaaaaatgcattcctatcatttactggtttatttgctaatcattactgcatacacccactactttctcttgggttctgtctccttattcttgcagttcttcctttagaaaatttttcaggaagggtgtgtgacagatgaactttctcagtctttgtctgaatgtgtctatttcatgctcaaggttgaatgataaattagctgatacattttaggttgataattatttttgcttggcatttttcaggtgtctctgtcatttttccaatgcctctgttattgctgttcacaagtctctgggtctcatttttgtccttaataatctgaatttatctggtaactaataagagtttcactttgtttttttattttgaaatttcactattatgtgcctagaggtgaatttatttctagttcttaactcatttttcatcttcaatttaaagggttataatatttaccaattctggaaaattttcctctttattaccttgcctttcccccagtctgttttctccttttagaactcctactatattggtatgcatgttgactctgtcatttttttatgcctcaaccatttttttcatatttcttctcttattctcttaatccatgctgaattttgtatagttgctgtttgaaatctatctttcagttcaccaattccctatttggttctatctaatcttctgtttaacacgttcattgagtctttagtttcactatcttttcatttctatatgttttatttggttctttttttcttttagtttcttttcttgtgtgcttatttctttcatttccttaactcaccaaagcctaatatatttataatattttaaacctgttctgtcgtctcgagttgcgggggagtgaatcattctgcctattttatctactgactcttattcataaaggatcttttcctttagtgttttatacatctgtattataaattcttcagggagatttatttttccctgtgggaattccacgtggcctaaggtgtggatttgttcttccagagcaggtttgcatttgcttctgctgggttccccaggtataccgccagccagaaatgattgctgtggagtggcaaactgaaaagagaagcctgggggatgcaggtgcctgttgaagagcactctcccaaaagaacggcactctgtgacctttctcccaactgtgaccgtaaatgactaagagacctcgtgcttcctacaaatgaggccagctcttttgacatccttagactttgagtcactagcagctgagggagaattttcctacagacttccccctatcagcaatgaacgtggaggaccaggctcacctgggaaatcttacagtttcaaggcgcttgggagaaaagtccgttctggatcactgatctaagggctgcagactcctggagccaaacttgattctgccaaacaggattctgcttctgattgtgaattttaattttacccagaaaactcactgttttcattgactttcaaaggggaagtattttttttttctactttccagaagtgggtttcgtcagtttttctttagtgacgaatcccattgcaacatgttctcattacttgacgagaaaggaaaacatactaatgagagcagaagttggcccttatttactcatcagccctgtgaaagtgacctaacaacccacagatggttcaaatggctgaagcagttcaaccgtgaagaaattaggtgcccattatacctccagcaggcatctaatttcatgtctggggcaggattgctgagttcactgaaacttctaagcaaagcaagtgatttaagagaaactatgccagcaaagtgtgccggccctgccccttgcccttttctccatctcagtagcttggctggtcatgctaagatgtgagcctagaacagtcagtcaagaccataaacgacttgaaggcttagtccctctcagcgcacatgccttagagtctttctggaaattcaagctttcttatgagagtacctcccgaaaaccctatgcttctatcaacaggtgattggttaaaaaaatgggggtgcatctatgcaagactcctatttacccattaaatagaaggtttacatgctaatacaaaaatactctaagctattcaagtagaaaaagcaggcagaaatggtatgtgttaaataccctcacctgtataaacacatgcacacacacacacacacatatacatgcacacacacagaggcacatgcacactttttgacaacataccaggaagtattgatattagttacctgtggagaataatatttaaaatctggggttggaaggaaacacatttcttatattttatagtatacccttttgaaatttaaaaacttgtacatattcatatgtattttcttcacccccttcctccccatgagagagctcacccagtagagtatgtcttttcaaagcatttttgtagggagttgctcaaaatctgttctgaaaaacactagttccaaaagatgcaaacaagaattaagtgaaaaaaatacatgtggtccttcccaaatatgtttgggaaacactgggttaaaccaaaataagcagttttctcaactgcaggaattatcagagcctttaatgttctctgtaaatctctaagaggggaacagaatgtaaagctgtcttcagctctacttaaccacaaaccccttttttgaggagcatctaatggaactaatgatctgtgaaacatactttgagatttgcagaccctggaaacacatcagtcctcagaactcctccatatgcagagatctcccaggttgagagtgacaagaggcggccttggcactgttgggccctgtgggtagagggagaactgtcctcagcaacccccactcacacacagcccactcagagtcacagttatcctgatgcaaacacaacttaattaataaatgcttcattcatttcttattctggtccttgggatggtgatcaagttcccatccaggtcagcatttgggatgagttgagggatgtgaatgcctggtgaggtcagaaaaggagagcattgttcttttcagcccagtagagatagtggagttcaatcacctctcctttctgagctctgagttggttcttggtgcttttttctacttggagagcactgaggctggccatgttcccattcacctggctctcaaattgcagattcctctctttttatgagcctgccctaatatcgcctcttttcaagtacagctggttcttgggtgattgacctcttcctgatattctgtcaggctgcatgccaccacatattttatttttagccagaagatccaggtttcagtcttggttctttgtgactgtttttgttatgactgagaaagttttattttgcaattggaaaactaactgacaggaaagctgtgcataaatctgtactctgtgctaataaaggaaacaggctgacccacagaggcagcagcagttgtcacaggaggaacactgggatgggaatgaaagaatctggctccagattcagaaactgtcacctattagcaatataggtcttgtatcaagtcactcagactttcagtttttaactggggatgaagtattgggaggactcacagaagtaaagtgcgtgagagtgcctcaccatggcgcaaatgccatgtgaatgtttcctccttcacctattgctggtcaaaatcatgtgcagtcaaaccttggccccagcacgtaccacttatgggaatgtgagagcaattcttttaacttctctaagctttggtttcctagtttgtaaaatggagacagaaagagagccttagtcataggtcattgtgaggactgatgggctaatgcatggaaagtgctcaactcacaaaatttactcaatatagattagttgttattggtattattgttatcttcatatgttcaaaaggctatagtcacataagctgaataggagggaataaacaggtggagtaggatggatgggggacttctctaacacacacctatagcacaggctggagggccaaggtttgcagagagtgctgtgctgacagattgccatggattctccttcctctccagttacaaacttataggagcagggaagcctctggtaagccctaaatgactcccttctcaagaatggggattgtgttttttggaaacactatggccaccaccttagacaaagttttgcctataggcagtccttcctttgatggtagccacagatgctttctccaggagctaggactgcatcccagcccaggtgtgttatcaccatggtatctgcaaggccaggaaatcactggcaccaaaagcttaatggtttcctcttcccagaccttaagacaggagtcaacagctccaaaggtaagtgagaccgaacaggcaacacatatgagtgatgtgggcatggtggggttgcagggaaatggatagcgtatgccctgtctcagaggggcatttgccattcagacccactccactgtggccttaccccattcttgcatcaggagtttcaattacttgagctcaccacagcctgatggaaggtagtcgccatcgcaattaccttaggcatatacttcaccctcctacaagtttcagaatattccaaggccccttttactatctctgatggaatttatggctcaacattctttatagccacaggctttcatggacttcacatcattattcggtcaacatttctcactatctgcctcctctgccaactaaaatttcactttacatctaaccaccactttggctttgaagccgctgcctgatattgacacttcatagatatagtaagactattcttatatgtctctatctactgatgaggatcctactcttttagtataagcaataccattgacttccaatcaataagctttgataatatttgaaaaagagtaattagctttacactagccctagtgaccgacaccttactagcaattacattttgactcccataacttaatatttatatagaaaaatccagcccttatgaatgcggatttgactcattaacctctggccaccttcctttctctagaaaattcttcctagtggtcaccacatttctcctgttcaacttagaaattgctctactactgcccctgccatgagcccttcaaacaaacaacctgacactaataatcagcacagcccttatactaattatcattttaatcctaggcttgacttatgaatgaacccaaaaaggattagactgaattgaattggtagatagtttaagttaaaataaatgatttcgactcattagattatgatagactatatttaccaaatgccctttatttatatcaatattatattaacatacaccatagcattgctgggaatattagtctatcaatcccacttaacatcatccctattatgcctagaaggtatagtattatcaatactcattataattattcttataactttaaatatacatttcactctagcatccctaatcccattagcctcctattatttgtggcctgcgaagccacagtatgccttgccttactagtttcaatctccaacacatacagcctagattatgtacaaaatctaaatttacttcaatgctaaaagttattattccaacaattatactgttaccaccaacatgactctgtaataactccataatctgaattaacataactatccacaacctattcatcagcctcattactatatcttacccaattaaatgataattcatctaacttctcactaactttctcctctgacccactaacatcaccccttctaatcttaacaacctattacctcttgtaattctagcaagccaacatcacctttccaatgagtcacccccacagaaaaaactctgtaatagttctcttcccctacttatcacacttacccatactcaaaataccttgggttcactaaacataataataataataatatttaccacccaagaactattaacttcctgatctaataatcttatatgactagcatgtattatgactctcatagcaaaaatacctctatatggacttcacctatgactccccaaagcccacgtggaagcccctattgctggctcaatagtacttgcagaggtactcctaaagctaggtggctatggtattatacggcttacccttaccctcaaccccctaacagaatatatagcctaccccttcctcatatccttatgggaaatagttatgacaagctctatttgtctatgacaaacggacttaaaatcactattgcatattcctccataagccatatagcacttgttattatggctattctcatttgaaccccttgaagctttacaggtgcagtcacccttataattgcccatggagtcacttcatctttactattctgcatagcaaattcaaactacgagcgagtccatagccgaattatattacttatctgaggccttcaaacactgcttccactaatagcctcttgatgacttttagcaagtcttactaaccttgcctttccccctactattaatttaatagaactcttcatcactatggctttattctcttgatcaaacatcaccattatgcttataagacttaatatactaattacagatctttactccctacatatactaatcacaacacaatgagggacacttgtgtattacattaacagtattaaatgctcatttacacaagaaaatacattaatacttatataccttgcacctatctttctattatccttaaaccctaagattattatggggtttgcatactgtaaatatagtataaccaaaacattagattgtggatctaataacagaagtctgaaacttcttatctactgagaaagtatgcaagaactgctaactcatgctcttattataccactattataaaaacactagttcccttaatcttaccaattattactaccttagccaacccctgcaaaaaagattgatacccatactacgtaaaaatatctattgcatgtgtctttattactagcctcatccctgtaacaatatacatattcatagatcaagaaataattatctcaaactgacagtaacaattcaaactcttcaactcccactaagcttcaaactagactacttttccacaatatttatcccagtggcactatttgttacctgatctattgtagagttctcaatatgatatataaactcagaccctaatactaatcaatttttcaaatatttactcattttcctcacgataatattaattctagttaccaccaataatctcttccaactttttattggatgagaaggtgtgggaattgtgtcttttttactaattggctgatgatatggccgagcagatgctaatacagcagccctccaaatggtcctgtataaacgattggcgatattggctttattttagctatagcatgattcctcttattttccaacacatgagagcgtcaacaaatatttattctaaatcttacccccaattcctttccactaattactgttctcctggcagcagcaggaaagtcagctcaatttggccttcatccctgacttccttccactgtagaaggcccaaccccagtttcagccctactccactctagcactatagttgtacagtttttctacttatctgcttctaccctttaatagaaaataatctatgaatccaaacctttacattatgtgtaggggcatcaccacattattaacagcaatttgtgctctaacacaaaatgacatcaaaaaaaaaatcgtagcattctccacctcaagccaactaggccttataatagtcacaattggtattaatcacacctagcatttctttatatctgcacccatgcctttttaaaagctatatatgttcaggatccatcatccataatctcagtgatgaacaagacatctgaaaaataggaggactattcaagactctactcctcacttcctcctcccttatcattggcagcctcacacttacaggtatgcctttcctcacaggcttttattctaaagacctcattattgaaactgcaaacacatcatacaccaacgcctgagccctttctattactcttatcgcaacctccctaacagctgtctatagtacccaaattattttcttcgctctgataggacaacctcgcttcacaactgattattattaacagaaataaccctttcctaattaacccaattaagcacctaataatcggcagtatcttcgctggattcctcattaccaataatattgttcccacttcatccccctaaacaactatgccacttcgcctaaaactcacagccctaggtgtgaccaccttaggcctcttactagcaatagaactaaattttataactaataaccttaagctaaagtatcaattacagacttttaaattctccaatatactaggtttttactcagccaccatccactgtacagctcccccaactcaagtctatttacaagccaaaatctggcctcacttctactagacataatttgattaggaaagtccataccaaaaaccatttcacaaactcatataatcagcctccattaccatacctgccccaaaaggcctaatgaaactctatttcctctccttttttattttacctcttctaactctaatcttaattacctaatcatcaccctgagtaacttcaagtgcaacataaatactgacaaataacgttcaaccagcaactgccaccaatacccgtaactgtataaagaagctgcaccgacagaatcctcacgcaaccacctcgccccctcaccctcaaatattatgcaactccatatgctattaaaattaattataatgaccatcccatcatactcattcaccaaattaacaccaactctgttaataatcctaataataaagcccctcaaatgtcaatacttgaccctcatgtttcaggatactcctcaaacaaccattataccacccaaataaattaaagactattaaccccacgaaagtcccaccaaaattcaacagaataccacaacccacagcaccactaataattaaccctatcccctccccataaataggagacagtttcgaagaaaaacctgcaaaccctataactaaaagaatacttaataataaatcataagccattattcctacatggactataaccatgactaatggtatgaaaaaccatcattgtatttcaactataagaacactaatgaccaaaatatgcacaacgcacctgctaataaaaattattagtcattcattcattgatcttcccacaccatccaacatttctacatgatgaaactttggctcacttatttgtgcctgcttaattctccaaatcactaccagattatttctggccatacactacacatcagatcccttaactgccttctcttcaatcaccaatatcagccgagatgtaaactacggctgaataattcgttatcttcgtgctaacggcgcttcagtatttttcacctgcctcttcctacacattggccaaagcttatactatggttcatttatatttctagaaacctgaaatattggtattatcctgctactcacgaccatagcaatagcatttataggttacgtactcccatgaggccaaatcttctgagtttttacacacctattctacaaacctgctatcagccattccgtatattggaactgaccttgtgcaatgaatctgaggtggattttcagtagacaaagccacccttacacgattttttgccttccattttatcttacctttcatcattgcagctttagagacttttcaccttttgttcttacatgaaacaggatctaataacccttcagggatctcatcagaccctgacaaaatcactttccacgcttactacacaatcaaagatattctaggcctaattctcctcctcctcttcctaataattctagtactattttcacctgatctcctgagctacccagataattacactttagccaaccccctcaatacctcgccccacattaaaccagagtaatactttttatttgcatatgcaatcttatgatccatccctaataaactaggaggtgtactggcccttatatcttccattcttattctagcagttatttctatacctcacatgtctaaacagcaaagcatagtattccgtccactagtctcacactcatatgaatcggagggcagccaatcagctacccttttattatcatcagacaaacagcatccattatgcacttctcaactatcttcaccttacaccaattaccgccctaattgaaaacaaattactcaaatgaaactgcccttgtagtataactcaatgctccggtcttgtaaaccagaaatggggaattccctctccaggacaactcagggaaaaagcacttctgcttcactgtcaacacccaagctgaaattctaattaaactactccttgtacgtttttcagcacacactttaactgctatgtcagtattaacgaactaatactaatacattagtgcttttatatacttcatgcattactgttaatcccatgaataatatattgcactataattgtttaatcatatatagtacattaatacattaaagtacatcaagaatataatctgcatacatataaccacgtattaacaatcccccaatcaactataacacattcaccgtatcaactgtacaactcaaactaagccaacacgaatatcaacccatactaaaaatccttaacattacatagtacattaaatcattcatcgaacatagcgcatttcagtcaagaaactccttgtcaacatggacataacctcgcagcccagtaaccacagactgggcaggaaaactgcaatcccctgtaaatagcatgcagtttatatagcattttcacttaacaccctcctcttaatgactttcacctggcaaccttcatttaactcaaaactcagggcctcattcccctgtacagcccatgttgcatggaactggccagggttcatatgtttatcatagacagggaacaaatctctaggttggccacttccagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcctcctaaggggattaaatgagtaatatacatatcacatatatacgtgtgtacaaacacacatatatatgtgcatatatacacacaaatctgttgatttaaaatgtgttgccacagatgctcttttaatgcttacttctgtttttataaatatttgcatcatttaatgacaaaatatctacttgaggatatttttgattaataatttaaatgtgttcctttcctatatccaagaagacctgcagcagggtacaaggtaaagcagtcacacagaactcatgttcttgggtcatgttgctgctgtccacatagtacggagcaaatgtgctctgaactggcaccactggatttgcttcccaggaaaagtctttgaaagaacaataatgaatacataccatctgggtgagacttggaggtattggggcattttagaatgtccacctggcttacttttttgactttagctaaataaaatgtaataaagggggcaggtgggagttgggggaactgttcaactccctggttagtgcccccaaatgctgaccagtgccacagaaacccatgtggctgttgggtgtggctcatccgtgtggaaaaggccccttctaggcccatactcacttccagtgttaggcatgtttaatcagcgttagcggggagtgtgcattgataaccacaaaattggaagacactatgaggagaggagtgtgtgagagagaacaagagaggaaagggtttaactctacctttcactctagttttctaccggtgggtgcttgatcatctaacggaagttgtctgtgcaaggggagctagaaatcaagtgagcagaaaatcgattttgcataaattgaaaaagctggagataatcaccaaaatatctcagtcatctctgagaaaggaagggaaattggagctgaaaaggattttcatttctaggtccctgagaagctttgatgacaaggcacaagtgttgtatattttctgaactagggtgaccatacttattgttaccagaaaagcacttgtcctggtaaagaccaggaactataaggagacaaatagcttcatcctcagccctttctctttggactgacacatctggtttacaaatgaggccatttatactggatagattgggaacagatggctgctacctggggtcttcaagtcctcaccttcccagacagccctttgcttttcaacatgcagatagaaaaaccgatgcccctattccacatcctatggaaaacctagtatcctccctgaagatttccatggattcttgggggcattggttgcatctgatgacctcttgttccatccagtgtgtgacggctaaaagttcgggcctctgactaaaacagacctgtgatcaaatcctggttctctctccttacagtgatgtaaaattaggcaatttgctttgatctttctcagcctcaatttgctcatccatgagatggagataatactacttacctcccagaatgttataactgttaagttaataatgggatagtgataagggaatacaagtaaagcacttagcatgcaacctggcacaaagaatgaactaaatagagggtagctggtattcctttattcacactaccctaaacagatgagtcaagatggtaaattttttgtacagtatttattccaaagcgcatgacaatctttcccaaggagatccttttaactttaaaaattttcaagaactctatacactacaacattcttttagtattcattaattctgaaaatacaagatcacaaaaggtagatagaagacatgttattttttccatttttggacaatgtttgatgcacacaaggaatcacagacctcttgcggtaattctaaggttccctggtggtccctggccccaggttgcctgcattcacaaacacttcactacggaattcctaaacttcattaactactgcttttctgaaagggctcagttcttacatactcaccgaacaaatatttattgagtgtctgttatgcaccacatattctgctaggactatcttgttttacactttaaaggacataataaatataaaagagatttgagcagggttacgtgcaataaaacctgtgggctgattattccctctctccgttcccggcatttcagcttgtgataatcacttcaccatgtcgggttttacattgtgtccaataaacagcttgtcacaggggtcatggctcagttgagaactgcccagcagtcccacttggtatttcttagaaattatacctcccacttttcacatttcatatcctacccccaaattaagttgggttttttttttagtaagattcccgtctatttatcatttccacattgtttaaaggaggattattcagggtagttttgcttcctgcgcttctttttttattcatacataacagatgtacatattttgggggtacatgggacattttaacacattcatataatgtataaaaatcaaatcagtgtgattgggtgatccattgccttaaatatttgtcttttcattctgctaggaatattcaaattattttcttctggtgactttgaaatatacaatacattattgttaactatagtcatgttactgatctttcaagcactaggtcttatttcttctatcaaactgtatatttttacctattaatcaacctttcttctttcctccgccctttcttgacctctagtaactacccatctactctctgccttcatgagatccacttttttagctctcacataaaagtgagaacatttgatgtctgtctttctatgcctggcttatttcacttaacataatgacctccagttccattcacattgctacaaatgacaggatttcattcttctttatggttgaataatgtttcattgcgtatatatgccacattttctttatccattaatctggtttgtgggcatttaggttgattccatattttggctattgtgaatagtgctgcagtaaacatgagagtgcagacagctcttcaacatattgattttatttcttttggatacatgcccagtattgaaactgctgaatcgtatggcagtcctgtttttagttttcttaggaacctccacactattttccatagtggctatattagtttacattcctaacaacagcgtataaatgttcctctttctccacatccattattccctttttgataaaagctgttttaactggggtgagacgctatctcattgtggttttgattcgcatttctctgatagttaatgatgcttgagcatttttttttttcatatgcctgttggccactttctgtcttctgagaaatgactactcagatcttttgcccgctttaaaatcagattatttggattttgtttgtttgtttgctattgagttgtttgagctccttatatattatggttatcaatcccttatcagatggataggccaaactaaattttttatcttttcctgctttttcttgaaggcagagaaatggggtttcttttgtgcccttgcttaagtttagatattttaatatctttcatcaaatattattatttaagcatggaatataaagaattagggtaatcactctgtggttctccccatgtatacatgttaaataaatttgtatggttttcctccaattaacctgaaaaaaaaaaagtacttccctggtggacattatagtttttgggggtggggggtcggtgccacaagacaaggtggcaggtatataataaaatggcaatgtgcagacgtgatagagtaggcacagaaagccaatgagggcttttgttgtcagagaaagtcctatagagaaagcaggatttcagctcatcattaagaatagattgggtttagttggggaaggtgcaaggaaagggtgtttcttctgaaaggtgcagcatagcagatgtgcagggatgaaaataagtgtcatcagctcaaagggctccaagtgactaggatgtcagcatggctgatgcagaagatctgtgctaaagaatactggaaaggaaggtggctgggaatcatgaggtaaggcaatggagagccctgaggaccagcttgaggactctgggctgacatttcctgagcaatggggaggtggtgtgtggtgcttcatctggcatggtctctggatggggagagactggaggtggggacactgattggaggctgcagatgaaggctctgcaagatatgggaatgacagactatgggtggccaagggagagaaggggaaggaataacaggtattaataattccagaatgtttgctctgggtaatcgggaatgactggaggagttcccaccaattaaagttttgtaggaattctgcctttcaaatgtctttcttccttttccaatgaaagtcttttccttcttccatgtatggaacctgatagtaaaaaaagcatttatctttctattttctagcattgctttcctacaaaaagcactaaaatcctgccaattatgaaatggcccatcttcagagagtaatcataaatagtcaaaacaacttgaagatcttatcagcttcccgctttccctctctcaccaaaattaaaccccatgactagcaatgaaacagcaagtatttcaactagatgtatttgttatagatgtcttttctcctctgtttttattgccaggcagcaagttagcagttaagtccatgggtctgttttcttaacctattcaccctgaactggaatttttgagtttatactaaaaacaataatatcctacccttattatttctctttgttgtttaaatattgccttcattaatgttatctcatttgattctttatcaaaaagccatatgattcaaatctggcacatatcattattcccctttaatatatgagcaagctgagaatgagaaataatatgttcatttacattgccaacaagtgtcatccctggaaataatgtctaggatctgttattcaattacacccaatatactagaagctgttacagagaaaaaaaaagttcaacatattatcttgaaaatcttcttataaaattgagaaaatcaggcataaatatgtaaacagttaaataacattccatggctaagtgtcccaccagatggcaatagaagccatgagtcagaaggtacagggttaattaccgtgtcataatgtgatacacaaatatgggaagactgtgttcatttctgggctctgtgttttaagagggacactgacaacgtagagcttacccaggtgagactcactgggagtccgaggagacgcagagatcaaagatgaagggacaagtgtccaaacgaagagagaaccccgggagggcattatgcccctccacttattgcaatgcctggtatgtgaaaggcttattctccttggtcccaacagtatgcctgtggctaatgaacagaaattacaggaaggaagcctccaacttcatgtaaggaaggatgctccaaccacaggaacaatgaaaagtatacagaacaagctgcctaatgtggtaatgagctccctatccttaaaggtgatccattatgggttaggtgaacacctatttaggatgttgtagggagaatgcctgtatcacatgccttctgcgtgctgtcaagttcagaaccagcaaaatggtataactgagagatggcatggtgcagggtttaagagcacagtctctagatcctatatgatgctcagtcttggaactcagcaaccatattgtaaagaagccaggccccacggagaagccatttgtaagccccagctaaggtatcagaggacagtcaacatcaaccgtgagatgcatgaatatgcaagctttcagataattccagtgttccacttttcgagccactccatttgataccaagtagagcagggatgacgtgccaccccaaaccctgcccaaattgctgattcataatcaaaataaatgctatcatttaaagccactaagtttgggggtggtgaattcttcagtgctggataactgaaatacaaagtttgtgtgatattcagagttaccattggtcttcacatccattaataggtggtgctgagtcaactagaaggtggtgttatgtgcagaaaggcagttgggtgggttgtgccgatgagagaagagaaggcttggtgaagctattgagagaacatgaataaaagattaatgaggaactttgaagacacagtgaaggacacagtgaaggctagatcttcattgtgtccatggttttgtcattccctccatctcctatatggttttgtgacttttctaattcttcttgaggaggcagctagattgagcaagtgctaggtcctgtcaagaaggtagaagaaatcttaaaagtctgtaggcctgcagaggaggagtgcgtggtggacttcagaagcagaacacccaaggggacagaataaaatcaaagagactcacatattacagaccatgatacattagaacatccacaatgttaatatggaaaggaacccaagagattgttttctagataatgaaatcaagattatgcacttggaaggtaaataagtacttattgtagagtacaaacgctacaattgaacttcaggggagaaatattaggtttgttgagaagaatctgaatggacgacagacctaaaaatgctttctagatagggagaccaggaaaatcaagatagggtggatatgataacgggctgtttttgagtctaagaagggaaaggtacggcagttcttgaaggtgagatcagggaatcacgatggaactttgtatcatcaataccataaaaaacagttctctcatttttggaggaaaaaaaatacactgaacacacagaaggagagaaccagagtgggtggccagatctccagcaagcagcccatgatatattagaatgccaatggtctgctgtcccggtgctctgaatacaggcaagaggaggcaggcaagggaacaaaccaggaggcagttacctggcttcctcgttgcttttcaggctacaataaaacatttctaaattaagatgtaatgctggaaatctgggctccaatcttctgagtggcgattctgatgagggtaactgaagtccccacattgctcatcactcctcctatttcctgcagcacacagcattgattatcctcctaagaaaagccatttcagcatctagagtggaagaggggagtattaatcatagtgaaatttgacaaggcagaagcctccacggacccacttgagccatttaaagcttttatgtgccctctagactggaacaagtgcatgtacatcaggaccataaaagaggggagacgcttatttagaaagcattaatagctcaggactggcctctctcttttgcgtctcttcttagccctggttgtctaagtcaagtcatttcagctgtcagtattgttttattcctcattttaggagatactactaaaatgtcagttcacctggaagttgtgcccagagcatttaattggatttacattaaaatgaaagaaatatgccaatgtggttttaattccaacagttattataatagataaggattctagaaaaaataatgtcaagtctaggtgaaattgttaggctataaaatggactcaggggatttttttgaaaagagaaaggggacatgttcctgctgtaactgtatttaacattcagcgtagggtacaaagctctccaccttttctctgcttgctaagacaagtggatgtatcttagaactggggactagaagggacatgaaagcatcatctacgtaatttctctgctgtcagagaaatcattctatgtgtattaaatatctcttgtttgtaacttattctcctctaaaggacctcacaaatgagccctgagggagctgtttagaattaattcatcacaataaaaaaattgtctttgtgcaacctttcatattttagttttagactcttccattttcagctctatatgaaaagactcaatagtaggttattatcttcctgataaaaagccttcacattgttaatctctttttccaaaaatatatttgtttctgaaatatttcctcatatgctctcttttcctgcccctaaatagtatgtattgctcaatgccaagccctccctcaagttaattgctcttttttagttataaaaccccaactggagtccatctaatcatctaataattcctatacttatgcctccagggccacactagctttttaaactacagcatggtgaaagctggtggtcatttgctgtctcattttcctaccaaacttgtatgaaattgttctgtctttcccaagaaccgtccttcaccaagtatttcttcaatggactgtgattaaatggttttaactgattattcaatgaatatgtggggcccatttttttaaaaaaattagaaaacagatgggttttaaaaaagagaggatatactatgaaaagttctcttccaatctctgtcccagtcatgtgctcccccaacccattagggtctaaccccatttctgctgcttgtgtattcatggagagagatcatgtacataaaaagaaatgcatgtaatgtatttaatacaattggcagcacgttttagcactgctctgcatcttcttttattttaataatataccttgggggtctttccactttggtatacatggatctcctttattctatttttttgtttgtttgtttctatttttttcagtagactagcagtctactgactggatgtaccatcatatatttattgcaaacctttctcaatatggatttcattctccaaaatatcctctaccagctgaagattgtggaagactcactatcatacttcactgtgcaactgtttgcagaatgcttactatcagcacagcactgggcttggtgccagagggaatacaagaagcagtgagtttggcagcctctgctccctaggaaactacagccccatcagggagaaaatacatgagaataagggggtcctgattgccaaatctatccccctaaggttttcctttgttttcttgtacatcagacattttttctaatgcatggtacaaatggcctttcccctttattggatgtgtgtatggtggtttgtgtgcctggtcctgcttttatactgggagccacaagaacagaactgtcaaactcaaatacctacagaggccaggagggtgacctaaatgagtgaagggtagagaagtgagccagttgggaaggcataagctctgtttaaagggatccccaactgctactgtgctcgattatttccctgtgaacaaccagatcttttggttgattaaaaggaaccagtgggtaacaggtacatgggacttttctgtattatttcttacaatacatgtgggtctataattatctcaaaataaaaaatttaattttaaagaaaatcagatacctagatcattgtgtgaaatgtcctgatttataaatgtaggcaaaatctgagcattgtgcaggtgcagcaaaactcatctatctgtaagccaaatgcagccttgggtccaccattttgctatctgtgtatagctgaatcattataatttgatttgtataaaacccaaggcaacccaatccatgactttgctttaaaaatacttgctactgtgagtttccattacttttgacagtagccatccccacttacctgttgagttttcctctcattccaggtccttggatgtggctgtgttgcccaagctattctcagtcgaggacgttttggaggggtcatcactatcaatgttggattttcaatggcagttgcaatggccatttatgtggctggcggtgtctctggtaagcagtagaaataatgaatgctgctcttaattcagccactccaatgtgcccgcacagtgctggctgcttcacataccttaatttacttatatctcaaaaatcctgcaagagtgtgtattggatcccatttttatagataaaattaaaatcaccaaccaatggtaagtaacttattatgcaaaggcaacatttaacaagagacagaaatgggggttagagctcataaattattcattcctaagtctggccgctgcatcttattctccaccagtcaacgggattttttacttgctctagtccacatttggaatccaactcccagataccctgtaaatagcccagtgaaggtcactccaacagaggcaagtcctggacctttatctatagcaaacaggaagagtctgggtctcttgcaaaatggatggtgctttcatggacgtgcagatctgatctacaaggtcttagtctaatcctgctctgaaaagtaaactgattagaagccattcacatggttctcaaaagcaaaatgaaatgataatttaatgcagtctgggcacttaggaagcgactgtggaaatgatctggttaccaaagacactcagaatctttcagcagcctggtgtgggtcctcagagcattgagtcaagacttggtgagaagagaagaaagggaactgagaaaccatgcatgctgagcactgtgctaaatgccagactgcctttatctccctctcctttacaacagcactctgaggcgggtattactgtctccattctacaaagaaatccctcctgagagggagtcagtaaataagtggaagccctgcagctggtaaagaagaagagctgagatttgatccaggctcacatgatctgcatgacagtgaagctcacatcctcattttttgtttgtttgttttttgtttggttttgtttttttttaggagtcttgcttttctccctcaggctggagcacaatggcacgatcttggctcactgcaacctacacctcctgggttcaagcgattctcccgcctcagcctcctgagtagctgggattacaggcacacactgccacacctggctaattattttgtatttttagtagagacggggtttcaccatgttggccaggctggtctcgagctcctgacttcaggtgatccacctgccttggcctcccaaagtgctgggattacaagtgtaagccaccgcaccctgcctgttttttgttttttaagacagagtctcactctgttgcccaggctggagtgtcgtggcaggatcacagctcactgcagccttgacttcccaggctcaaacaattctaccttctgccacctcagccttccaagtagctaggactacaggtacgagccaccacacccagctaatttttgtattttttttgtagagacagggtcttgccatgttgcccaggctggtcttgaactcctggactcaagtgatccacttgcctcagcctcccaaagtgctaggattacaggcatgagccaccacacccagccaacacatccccattcttacacagcatttacaatgctctattatgagaagggcattacaagcaggttagttgggcagaggatcctgcagttaagctggctggcctcctagcaaacactgcctttgtagcactgaagaacgattgcttagactccttgggagctccttgggctgtgcatccggaatggccattgaccagctggcaccctttccatattacagccagactcagatccaagggtcgtccaggttaagacagagtcccactctgttgcccaggctggactgtgatggtgggatcacagaactttgcaaccttgacctcccagattcctatatatgtgatttgttagcatgcacagtgtctccattcaaacttttgtccagcttttgctgtgatcccagcactctactgcttaactcaaggcaaactccaagaagggcacaagaaaaaccaggggactgccctaaatatcccgaggcttaactgctccccctataagctcccactgagttcaccaggtaatgtaggtgtagccatattttcagcctttttttaggtagagacatggttttggagtattttgcctgcataacaccctgaactgaacatcatccaatagttacttagaattaattggccccagaccctaccactgctgttaacacccttcaccactgcaatccatatctgtttctgtccattgatatacctggggatttctgcagtcactgtaggaggaaaaaagggaaagaaccagcaggaagaagaaggagtgaagaaaaggtgtgaagtcttctgtggcctctaaactggggttgaatccctatagttacaagagtaagggccaaaactgatgggacttctttcagtagaagctgtttctgggtgagagtcaggacctgaccaaaatgtttacaagcaactatgagaccctaaaatacaaacagagtggtgtctgagactggctggaaaatagtagcactggcttggaaaggcagtccttatctttctatctctatttggaatctagcacagttcaggctccctaaggactggtggctttgggaacattttgggaacatgcagcacaacacactggcccatcatgacatctgtgtggacaacagcatcagtatcagctttggcaggtgcaggaataggggaagattgtgtgtgggaggtgactttctcatcgtggctgcagctaacatactggtttgtgggcacatactggcttgtaaggtctgcttgaagattccaaaagtaaccaatttatactgagcataaatgtgaatgggatcctattttgtggtcaccgactagtgaggtcagcagatatttgtcttttaaatataaaacatcaccttattgtaaagaagttacagcatcctgctcccctgggaatgttccagtcaaatccagtcagtcagaggtcataataccctaattatgtagcatcctgcacaaagcatttaggctgtctaatggcaattgctattgatgtagtattttatgactaaaataaacttattgaaaaagcaaatagacttgctttcattacaaaatatagggttatcttgatcacaggattgtgtatgggtggcgaggaggagaggatttgcatagaacagaacactgaaggggttccctctgctcacctaagactttcatcttgtgccctgtgggatccagctgtgcccgcgggccctttatgtgaataatctgattgtcccagcaacctcggcaaagccaagagttgagtgcaggactctctgactctagttctcatgttctttccaatacactgctctgccttgtccttgtgataagccagggtgaccactcatctctgcggggagaaatttctagcagccacttggcctctaaccagaggcatcagggtgccacttgtccacctctctttctgaacctttctgcctcctctccagcccttttcctcattgctttgcaaagcacccttccagacataccctctctaacccccaaacaactatttttctctgtagatcactgtagtctgagctatctaaataaggcctcagattatttcttcaactttcttttttttttttaatggagtcttgctctgtcaccaggctggagtgcagtggcataatctcagatcattgcaacctccgcctcccaggttcaagcgattctcctgcctcagcctcccaagtagctgggactacaggcgtatgccactatgcccagcaaatttttgtatttttagtagagacagggtttcaccatgttggccaggattatcttgatttcttgacctcatgatccactcgccttggcctcccaaagtgctgagattacaagcgtgagccaccatgccctgcctatttcttcagcttttatattgaatacctactaagtgccttgcatcatgtgagacccaaggtaaataatagttccagcctcaggatgcttaggaggagccaacaaacagaaacctacttatgggaaattttattttggaagacgaaattgttaaacaaagaaatctcccattggtagactaaactcaagggagttggactggaggtgatcacttacggcccccttggttttttgttgttgttgttgttgtttgtttttgtcgcccaggctggagtgcagtggcgcaatctctgctcactgcaacttctgcctcctgggttcaagcaattctcctgcctcagtctcctgagtagccaggatcacaggtgcgagccaccacgcccaactaatttttttttttttttgagacggagtttcgctcattgcccaggctggagtacagtggcaccatctcggctcactgcaacctccgcctcctgggttcaagcaattagcctgcctcagcctcccgagtagctgggaatgcaggtgcctgccaccacgcccagctaattttttctatttttagtagagacggcgtttcaccatgttgggcaggctggtctcaaactcctgaccttgtgatccacccaactcagcctcccaaagtgctgggattacaggcatgagccactgcacctggccccgcaccccttttcctttcacaatggctacctccaggcagctggaggcagctactctgcagcaagcctctgggagaagagaaacttcccactgccctgtgtgccccctcctccctcctaacccctgtttctagccttccctggtaaggtgtactgctagtctccagaactgtggctttcctggatttgaaaggaaaacacaacagttgaagtgtttataaggctttaggaaatcatctgtgcttcaatacactggcattttcttgctcattgtagccactgagtggcaggggcaggtgaagaaaggactcttgtggcttagccagcagccagaatcccccacccactgcaagtccattttgccctggagacttggaaaaagcatagctttctccacagggagtggtagaggcttctggaaacaagtgcacctattggttctgtgcaggatcatcatcatcatcatcatcatcatcatcatcaccaccatcatccctcctttgtttacgactaaggccacagcctgaaagtccacatctcaatgtggtgtctctgattccccctccacaaaaaatgtcatctgtattcctcaaatgaacatctgttttcactaggaagtgagcctatatgctcagacaatttttttaaattctttatttatttttctgcccacaaaagcagagaagcctttataaacacggtgaagatgggctggaagtggtatagcagaaaacataggctctagaattcagataaacctgaatctgaatcctggttcttccatttactgaccatgtagccttaagaaacttactttccgtccatgcctcagttttctcatccgttaactggagtagtactcatctcattgggttcttaagaggatcaaatccacctactaaccctacaatggtgtctggtaagtatttgataaatgctgctgttgttgttactagcaaagccagctggggatgttagagaccaaccacagagccaactctctatttgattttatggctggatgcaagtcaaggaagccgatttctctagctggagcttgggctgggctcaggaaagggttgctacatttctgtataggagagaaatgcattgtttatgcagaggaactgagaacaagccactcacactgtgaccacctcaaaatcaactatgcccccaccctcagcaacccacagtcattttcctttaaagatacatctcttttgagctagtttttatatcctctgggcatggccggaggaactgctagatatagatttaaatcttatacatatattggataagcatattgacttttaaaagatatcgaagttaatagctacatcagtctgtttggggtgattgctttatagatagagggattcaagcctattaaaaaaacagccacttgagcacatcaagtttctttttatacctgactctcttttcatcaagataaacattctaaactgttatccaaggatgccatgaaaatgatcattcctccttctctccctgctcagatacacactctctctttcacgtgcatacacacccctctttctcctcataggcagtagttctctacctagaagactgaattccacctgaggtctctagatggttttctgtatattcttcttcctaacctgccctctcacttctccaatcttcccttgcaggtggtcacatcaacccagctgtgtctttagcaatgtgtctctttggacggatgaaatggttcaaattgccattttatgtgggagcccagttcttgggagcctttgtgggggctgcaaccgtctttggcatttactatggtgagtaaagtccctgagtcctaaggttaggaagagctgggcataatttgaaagtcagaattacttggtaggcacaggtgagaaaaagcaaggacgggaagcattctacaagtgacagcaagttctaaatttgagaaaatgaggccatattaccattccagcaaattcgtgaatcctgttaatgaaaatggtcatatcttaaatggggagcagaacttaaaggaagcctgtctttgtgccaagccagcactgcaacatacacatccatacaacaagcagtaggccagtggcttccccactgctgtctctgatttggctgggaaaagaggtgttttctggtgacaaaggtgtgaccagtaagtattgagagaaggactctgggaagatgtctttgaaggaagagacacagcagagatgtgggctgggtgggagcctcattgcccttctatcaaacagccagggcttccactctgcaacagtccttgggaaaaacacagtattggtcatagaagaccagactttagctctagctgttcagtaaatacctgtgcaacttaaataagtcatctgatctgactagcctcagtttcctcctctggaaaatgagggaattgaatcagatgactctcgaggcctttcaaactaaaacaccttggtgttcccatgaaatcaactgttaaagcagctccttccttctaacccaaggtaagccttaatacattatgacttacccaaactgaagaccttaggaagtagaatttatgaaccaggccttatagaaatgggtcatggagggctgggtgtgtggtggctcatgcctgtaatcccaacactttgggaggcataagtgggaggatcgtttgagcccagtagttcaagaccagcctgggcaacatagggatacctcgtctcttcagaaaaaaaaattaaaaataagccaggtgtggtaactcacatctgtagtcccagctactcaggaggctgataagaggattgcttcagcccagatcaaggctgcagtgagccaggatcatgccattgcactccagcctgggcagcagagcaagaccctgtctccaaagaagaaaaaaaagaaaaaaaaaaaggaaaagaaataggttatggaaagggacttttccccatagagtgtctctctgagaattagagtctaaaagggctaaaatggaattcaagaacacacaggaaattcagagcccgctgctgtggcaagaatggcctggggtcagtgctagctgtggcagtggctgcaatacccctggctctaagggcatcttcagtatactgcaacaccctcaaattctggagtggtattaggggttactgagagccctctgggaattataaattattcctagagcaagaccaagccccactttggcttacagttgacctcgaaaactccaagaattcccccaaaagagaactcattcccaggaccctatcgaagaataatttgtccaagtttgcagtgggccattcagagaggccaaaggccttcttcctttgaccctccatcctgggattcacctgggcatctctaaaactatcattcctcggaagtagagagagacaaatgacatggctatgccaagctcaatctgagtgactggttgtttagcacaaggcttggcacaggcctccttcaactcttcccagggaacactaatgtgccagagctttctctttcatagatggacttatgtcctttgctggtggaaaactgctgatcgtgggagaaaatgcaacagcacacatttttgcaacatacccagctccgtatctatctctggcgaacgcatttgcagatcaagtaagtgtagattcaacaaagacttaactttggtgaaaagatatgctctcataaggggaatgcattggagaattagagaccaatcagaaaggagagattatatttccaaaggcagaggttgctgggcataacccaagctttcttgataatcgttttacctttacaaggagctgataccaccagaaaagttttctccttcctctttaatacgtacacttgtttaacattagttgagatccagaaaagagtgaatgactaaacatttcaatccctgtagacacaaatggagttcacttcactattgactcttttgaacaagtggtctaagtgtggaggccacaagagaagatatttctatttcaaatcaaagactgtgaagggtggtagttgagcctaggggatcatcaatcctctctgtctcaccatgtgcataggtttatttatttaaactctcaaggtggctagaagtatctctgcttattgacctttaaacaagcttctagcacccaagcatactgtggtgtaaccaatagcacacctatttggtcagcttatggcaggactaacattgtcaactcaaaagactcttcttcccttactgtgtcccaagaaggctgctggttatcttggtcagggcagtggaaggaaggctatatttttcagtatctctaagttcttcctctatgatcaggacttatacagcagatcagaatgggcatgtgtatcaaatggatcttccagttcatcagctatgcccacctccattcaatgtatggatgaaaaactatgccctcatgtcctcagcttttttactttccactttcatcaataaatcaaacaggcaacaagtgttcattaaaaactcactatgtgcttggccctttgtctggagcttgaaagactgacgagtaaatgtgagttgtaaagatccaagatgcagagtctgaatgcttgaattaaaatagctgttctgcctccaacttcctgcgtggcttcagcaaagtactgaactttttgggtcgcaagttattcacttgtaaaatggggataatatgagccttcatgaagttacttatgaggataaaaagaataatatgagaaaaacgcattgtaagcagtatctgcccagaaattttgaatctagttgaagagcattgaacaaggaaacaatgcaaaataagatataattagacagagctgggcacggtggttcacatcttactccctgcattttgggaggccaaggtggacaggtcacttgagcccaggagttcactaccagcctgggcaacatggcaaaaccctgcctctaccaaaaatacaaaaattagccatgcttggtggtgcttgcatgtagtcccagcaacttgggaggctgaggtgggaggatagcttgcacccaggagttggaggctgcagtgagctatgattacaccaccacacctcagcctgggcaaaaaagaagaaaattagataggaaactggagtatagcgaccatattataatagaaatttgaagcagagagcatagaagagcgaggacaattttggttattttggtgtttttctctaagctttttttttttttttttaagactgagcctgttgccccaggctggagtgcagtgacgtgatctcagctcactgcaacctccacctcccaggttcaagcaattctcctgcctcagcctttggagtagctaggattcccagtgtgagccaccactcctggctaatttttgtatttttagtacagacggggtttcaccatgttggccagactggtctcgaactcctgacctcataatccgcctgcctaagcctcccaaagctgtatcttgatcaatgctgacctgcataccatatcctgagcttccttcattgtgtccttgtctcagagtgagttggcaatttctctaaggtctgtggtttctaagcccattattgtgtatatagtcaagtagaaaaagtgaatattagaaaaccctgaggctgtaaccgtcagcaaaccctgaatgctgtccgtattcttaggctttggagagagttccaaaaattgccaattatcagtcagtcaacacccaacagagctcttggccatcatgaccatattttggggtcaccttatttcaagattactaaattgtttagctgtaaatactcttcaagcatattccttggtttagttaataatcaatcatttattcacccaataactatttactgggcacctacttagccaagtacagctctatactcttccttcttcaaggagttcagagtctgaggctcaatctaacaagtaagtagatactcttttgcagagtgacaaggacactgatagaagtaaagtcagaatgtcatggaagcccagaggagggagcttttactctgcaagagagagttggagaaggcattccagagaagagtgctcttgggggaacatgtgtcttttaatattaattaaaaattattttaacattattattttggaaagcagatgaaatgataatgaacttaaactttaaaatcagttgcctggttcccatcctgattcttctgcttacaagtttgacattggacaagtgtcttaaccttgttttactcgagttttcttatctataaactgagaataatagcaggatttacctcacagcattactgtgaagatttaatgagataaagcatatgaagtacctggcacataataaatgttcaataaataatagctatcatttaactgttaaagtaaaacagtagtttggaaaactaataacatagaaaccagctataattggccaattcaaatacctattatcatttttgtttattgtcttaaaatttttcttttacgtatgtttttaagtagagtcaaccctacatatccatgaattctgcatccatggattcaaccaaccatggatcaaaaatatttttaaattgcatttgtattggacacgtacagacttttttcttgtcattattccctaaacaataccgtattcacattatatcagatattataataatctagagatgatttaaagtatacaggaggatgtgcataggttatatacaaataaaacacaattttatattggggacttgaacatccatggatttttggtacttgcaggaagtcctggaaccaatcccccacagacaccaagggacagctgtataaaacacaaaacaaaacacaaacacaaacaaaaaaatacaaatttttttcacttaatgttataagtatttttaaatattactacatagcttttatgtttatagtttttaatggctatacagtagactaaaaaaagagtaaaagcttccagtttttcagtactataaattttgctaaagtggacattttaaaatgatttttccacgttttagattatttccattgtgtaattctcaaacatccagcagcatcaaattgtataaataaatttatgtttttgaatgcatattgctaaattattgctgaatttccttttaaaagcatagtacttgtttagatctattagaaaagcctgaaataacgggtatctttttcctaacatttgatattgtttggatttattttattactaatgagtttttaccactgctttcctaattctgttttccttttttgaattttctgttcacttcctttgcacactcatctattgatatctcacattgcttttctcaccaatttgaacaagcctttcattcatttttccagcctgcagcttgccgttctacttagctgagtagtagcttagcaggatagtgtggtattaagataacagtctctggagccaaactctctggatccaaacctgactgccacctactaagtgggcagggtaaccaatctgtaaatgagaattatattggcttctcctctagaattgctgtagaaagaagagagactggcacaattattcacccagtacatgccagttattactaggcatattgtaatataagtaaaatagtaatattgtaatattgtaaaatagtaagaagggatgattttgagacatgcaggtgagcagaatgcaggctaaagccctggctcaacttctccctctccaggtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcaggtaagtaacagtggtggggaagagagagacagagtcatgctgcgcctcaccagtggggcggggctttgacatggagatccagggaagttcagatgacagcgccaacgttaactgcacactctggtcataagcatgagacatttcactggtattttgtggtatgatgtgtgtgtgtgtgtgtgtgtgtgtgtgtgtgaaagagagagagagacagagaaagagaggcggctctaggtaaattcaatagagataaaactgtcccacataataataatccctcaattgctatatgattttatgtgaacattttagctgtataacttgtctgcagattcattgtgtgacaaagttgggctacaatttgcatcctatgatgccactacagggctcttcctcgtgaaccacgcaacctatgctgcacttattccacagatatttgttgggcattatctgtgctttagtcactgtgctaagcaaggaaatttcaaatcagcaaaagcactcaccttgagcgatataataagtgctctggcaacccctaaaagtgctgcaggaacacagataacgtgtgagtaactgccagggaagcagggaaagacatgactgcaaatgtgagagctgacttggttctggagatatgagtaagaacttccggacaggacagatgtaagattgagcctctgccccagaaatggcaagactccacactttctacttcagaatgtgctgaggaaatacgccaactgttggtacctatcttctaggacaaaatttgccccttcactacttcctggtttccctgcatgcagtcacagaggcgcatcctcatccacccatggcaacttcctatggggaaggagctcactttggttcatcaggaaacagggctctaccatggagaaaagtaggaaaaacatgtgtgagcaaattctactttaatgtttcctgtgagaacaaaggacgtgagtgttcccaaatgatgacctagacatagagtcatcagggtttggcctgcatttcaccagggtgaaaaataagttaaaataactggtaccattgagatcaccaccacagatagcactcagagcatctagagtgtaagtgccatgagtaccttgacagccttttcccctggtatatccacagtgcctagaacagggtgtagctcatagaaaggctcaataaaaaggtattgaataaaagaatgaatgaattctatgtgacggacacttcctaggagttgaaggatgcaaagcaactcagtcaacattccctgtcctcaagaaattgacaatccaataaatttcctagaacagcagttctcaaccagaggtgggcaactgttccccagggcatttttggttgtcacggctggacctgagggaaggggctgctactggcatctaatgggtagacgccaggaatgctgttaagcatcctacaatgcacacggcacacctcccacaacaaagaattattcagtccaaaatgttaataggtttgtggttgagaaattctctcctagaatgatcacaactagaacacgaaaatgtccgcaactaggatggatctcttgtatctttccaatggagcatcaaaaacatatgtcctaaggatctccttattcccagagcccagaattcgcccatgagtttcccttaattccaccatccagagtctcagtcttggagaccaagctcttcttccaccccctttgagacctccttggtgattcattcaaaagtcaaagagacatggtggttccaaaacagatggagatcttgcccaatgtccctttgctctgttaagtatatgttaggagaactcatgtgaaggaaaatgttggaatcacctaatgtcccatgtccttagctagcatcaggatcttttcccttccatggagtcatttattcattcatgcagctacttgatatcttactcaaggctctccactaaagatgataagacctagtttctgtccttcactgttgtgtttatattctacttaagaggttattccagaagctcttacacaaggtggaagcagtcaagtgccattaaagagatttgactaattaactccaggagtttagaggtctacagctccaaatttaagaattatgggagtggaagtgggaacatttatagtatttggatatgcttaaacaagcaacagaggggttatctcaggcagagagaaccgttattcaaagacacaatgttaaaatcacaagtgatctagtctagctggaagggtgcagaaagaaagttggaaagggccgttgtcagatcatagaggacctggactcccagaatgagaattttggcttttcttctgctccctgttttgtaggttatagggagtagcaaagtatttggggcagaagtttggcaggtttagaatgtcaatttagcaaaattaatctggcatcatcctataagactgattgaaaaaggagagagtggggaagtagaaacccattaggaaagagcagggttggctggtaatcctcaaccaaaaatttctccccaaaacctttgagggacaacaggcttccaaagtgttcttagagtgtctcatttcctcagagttctatattcaagggaaatccctcagtagatatcctagcttggacctacacctaaggtcttagaaaaaaaacaaggctaccttgttcccaggtccccatgtactcctgaacggcaagcagtggaatgatggcaggtacagcgagatgccagagggtttgatgagggcaagagtcaacagaccctggccaaagactcttggtttttcctttaaatgttaagatgtttcccatcaaatttctctccacttattcacattgttaatgacttaatcagtgaaagctctcaggagtattattaaatttttcaaatagttggcccaaagtattgaatccctaaagatggtcctttagacagttaacatacacatgttcctggcatctcccgaatcatagtgtgcaaatgatcactatttgtgtgcatataggactaggctaggcaggtaaccacatctgagcgcctccatttgtgacttgtgaacctgatacaacatgtccaatctgataaaagaaaaagcatccagccagtgaagaggacatgtaccctggctgatatcttggaccttcatctgctaaatgacaggaagaaatttgccataaaaggaaatgatggacccaacaggtagcttatactcccttcatgttttgacctctagagaagacttcaagtctttacagccaaacgggagaggcagccaccctccatgtgcctcccctagaaaaatccatctggatttggggcctggggaagggcactgtgagggcggccgagtacagcatcctcgctgccgtgtggtaagagtgacatctggtggctgccatgctcaggctcagtgctcttccatcaaccctgcaagggcaatggaggacttcggagaccacttaggtgccccaggtggaagggaccatgcagatgaaggaaatggagctcacgatggggaatgggggtttgatttgctcaaagaccttctagataatcttgagattagacttagtctcctggattctaggacagggttcttgtgtcctgcttatttcctttatcgttcttttctaatcaaagtttgagatatacaaaaggccacatggaacatatgtgtagttattcagcataatgatgaaaagaaaagctatgggtccttctagaatccaactagaacactgaaattcttacatgcctctgggtactcctcttgtctcccatcccctctgcatttatcctgaagttttgtgtttaccattcccccgctttttaaaaatacttttatcttaaatgtatatatccttaaacaatatactgtataatttgtttgctttcctgatcctttctaagaaattatttacatggattttctctctccaaagaagatggtgacaactcacaaagatacctgcttttccccagaactatagctttgctgtaatgtactaacattgaggatttctggaagagagagagccatggcatgacagccttatcagagggtagcctcaagctaagatcttaaaaaataagtactgatttaaattatatttagaaggcaattcacacatccaccttagattttttaaaaattcattcattcattgaaaaacatttcctgattgattagtttgattgtcctcatacactaatgatgcccaggaatctctccacattctgcttgtaatccacaggaatcattatttcaggatgagggaaaggcaattctgaataattgacctgaactttcttaggggccctcaatcttaacgatgggctcaggcactatattttataaaaagaaaataaataagacataatatctcacaaatattagtaggacaattaaatagatcatctgaaatcaggtgtagtggaaagtcaaggatggcagttgccatgctgcactgagccccccttatacttagctcttgctgagttaagagggaaccatgagtgtgagaaagactaacaagtgagtgaaaaaactagacagtaataccaggaggaaggccaagaaatgtatcactaatttcttgtttgatttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttggttgcttggttggtttttataagtattaagattactaagtacgtctagttcagaggttgtctattgtgtctacaaatttgaatttcctgggggaacttttgaaaaaatactggtgcccagttggtcctttgtaaacatctcaggtgattctaaaatgcagcaagggttgagaacattgacttgggtaaatcacacgggtctaaagtttctttgaccatgtccagtagtggccaggtaattcctagcaggattccagagtcttgggatcctcatggattagagcaatggttttcctccctccctacttctaaagggaacatgtggcaatatttggagacttttatggttatcacaactgggaaggggatgctaatggcctctagtggctagaggccagggatgctgccaaatatcctacaatgcaaaggcaaccctcccaacaggtaattatttggcccaaaatgtcaataatgctgaggttcggagatcttggtgtcgaggaaaggtagggaggggagtaagagaagacactgaaatcctgcaccttgattcaagttcagtcaggagcaaaggtgccagacaaaccaggaacaaaccctgggggtggactataattcttaaagcaagaggcaattcaaaatttgagttttgaggatgaactgtggaatctatgatctacacaggtgctcattaaacacaatttgatgattgatgactaggatttataaacaggaaatgtaccattatggaaatcaaccccaggaagaattttttcaatggaaaaaagtgcttttgttccaggtgctcacactcaaattctctccccacccctacccccatttacaaataagtggatttacctttgtggagttattttccaagagaatgtttatatggttgaattatctgtatccgaagtcaactagatagagccaacttatccattttttaaatagttgctttaagagttagaattgtaacattcctccttccctccccctcatgaatcgaaaaacttgatagaagcatttatcttaatgccaaaaatataatttctctgattctttaaccagttgagatctcagagcatgtcaaaggttgcagggcttttctaaccagtaacaaccagtcaatattcagctgttaaacaggatactccacataaaaatgtcatacgtaaaatgttatccttaggatataaattattatttcctttaaattgcttacacacacacaaacacacacacacacacgtcttactgtaaggtatattgatgttcaataatatcgtcatgggaaaaaaatacatcttccagttagagagaatggtttataagttttatttagccacagaacctgtcgttcaaataaaaccttatatgacacccacaagtgaaccagaattgctataaataaaaaaagggagggggatcaggagcttcattctgcttgtgatatcatcttaaaaacacacccccaatgcagcccctaaggggtctctgaagagaaattgtgtgtgtgtgtgtgtgtgtgtgtgtgtgtgtgtgtgtgtgtcagggctgggggtggggtttcagaacacagtgtcacagtttgaaaatcattgataaagacttgggataagttgttggtgcacacttttatgaaagtttcaaggatataacctacaaaagaccatattaacttaatctcaggtcttttccaaagactttttaataaatgaattagacagggtgaacagaattactcaatccagcaaacatcacccacaaagagatgtggtacatcagtcctcaaactgggaatttaagttctctgtgacaacatgtttactaatcacagcccatacacagaagcaatggtactcctggtcacacttactgtgttgactgtctaagtctgtataaaaataaatagatagatgatagacagacagataggtaagcaaccaaccatgctccaatctctttcttattgctggaaatggagtagctcttat

SEQ ID NO: 12849 - DNA, 253375 bp, Human
  misc_feature (1)...(253375): n = A,T,C or G
ggggcaagcctaaaaatagaaaggagaatttgtcacaaaaacaagttctaactacccagtccggtagcccctgagaaaatagataccgttatctatccatctgcctcccaccaagtacttactattgtggcaaccttgcttgcattcaataaatctgatctggtacacacttatcccccgtgttttagaggcaggaaagcatcactggatttcacctcagaggacagcactgtaagggaccttgttcctattgctctgtgccctgcctgggtgctcacagaatagaggattcagtttaaaagaagattcttagagctctttcattcaaggatgtaaacttgaattgtgttcagtgtaatttaggtaggatcagagcaagatattaccagctggaaaggcagatgagtgaatttaatttcaccctagtgcctgatctgtaatcttaagtgtgactagcaagtagtgaaattgtgacctgagaaaagttcacccttctgagtcatagttttccagccagtacagatagaaagttgttcctgaagatctcactctctcagctggaagggcactggaaattgtaactttaagaataattagttattgtaaaatttaggatgattgcacatgaatcttcttagaggtgtttagctaggatatgatgaattacagacccttcaggtttctttttttttttttttttaagatggagtctcgctctgtcagtcgcccagtctggagtgcagtggcgcaatctcggctcactgcaagctccacctcctgggttcaagccattctcctgcctcagcctcctgagtagctgggactacaggtgcccgccaccacgcccggctaatttttgtatttttagtagagatggggtttcaccgtgttagccaggatggtcttgatctcctgacctcgtgatctgcccatctcagcctctcaaagtgctgggattacaggcgtgagccaccgcacccagcccccaaacccttcatgtttctatttacctcatttcaggaaagtctttcccattttcccagctccataatgctaattaatatcaactggcttgttaactcatgttccctgttgatagtaagtatatagagaatctctgtcatagtggtgggacatgtgctgagatataaacacctatcaaggcatatttgtcaatctggtctatatgcagctttctaattttaaaatgatttatgtagttcattttttcaacaagatcacaatggcttcgtttctttatagactaaaatgttttgctgagaatggcccctatttctttccactgaattcttccctctttaaagctagcgtgagtatttggtacatgttgaaggaagatactttgcagtggatggtctcttgtcatttttagtttgctctgcatcaattcacagaccaatcagagactcaatatagaccctaaatccgaaccattttgagacttgagttctctatctcttttcactgactcctctccatctaataataaaagcagctatacttgtatttagtgcttcagagaagatgcagaatccccggtagtgttggtaataacaatactctcattgccagaatgttactctaactgtgcccctcccaacttctagcctttctagcgagttgccactgcctgcatcctcagagaaacccattaccacagtattatttgcaaagctacaccttaactctaagatgcacgtggtcatcttagtgtctgccacacttagcatacttagcacacttcctggtgcatattaaatgcctaataagtgtttgctgaatatattgaaataagatatacttcttaatattacatttgtcaaaacatcttaatttacttgactttatactggtcctatggtaacgtaatttttccactgaagttaatggcatccggtttatgtacaagaataaagaagtatttatgctcaggtagatgaagtgttttcaaggcacttccaatctgtcaattgttaaatttttactgcctgggaaggtgtcaggggacatttggatgtactataatttcagcccatgctttcccagaaatgtaactgattctgtttctcaggttaaatactaagaaaaaagaattattgatactgacttttgcttttgattatatttcaagggatgtgattgtccaaagttaaaaataaatccttgaataaaatattaaatatttcaaagtcatagaatagtctctctgaaaaagaaattctaaagcagtacttcctccttgagttctaaaatagatatgttgacaagaacattagaaatagtgaagaagaccctgggtttctatattagttgaaactagcctgaaaatgtttcttcatgtcatataaaaatatatcaattttttcatttttatgtcaaaaaattacaagttaattgaaaatatttatttagattaaaagaaggaccagtaatcatgaaatgccactagctttcaaaacacgagagaatatctttgaaggaaagaatgttttttacagttgcaaagcattctgagaacatggagggagcatcttttgttttatttttctccctctcctaaagtttttacactacattgtaaacctcatttcccttgccaaattagagatctaaaagtattatggcaaaaatcacaattgttgttgcaccaacctaataaatgtcgtatgcctggttctgttgaagagtcaacaaaataggctcaggacagttttattttagataattgctatgtggttccaagtgctaatggtcagaatgttgtctgctttttctcctactgtttcttaatgtatgttggtaatgctcacatctaatttttttttaaatagctctacatcagttagacacaaaattaccctatagctgtcaactataaccatctttaattaccctccttcctcaaaggaaagataaagataaaagaagttattagtgttttgtaaattatgaatattaaattgtttcaaacatgtaacatcttataagaagcatataaaagcacctttgtatgtttgaaatcttttttttttttttttttggagacacagtctcactctgttgcccaggctggagtgtagtggcgcaatctcagctcactgcaacctccgtctcccaggttcaagtgagtctcgtacctgtctcctgagtagctgggattacaggcacacgccacctcgcctagctaatttttgtatttttaatagagacggggtttcaccatattggccaggctggtctcgaactcttgacctcgtgatccgcccacctcggcctcccaaagtgcaggattacaggcatgagccactgcacctggccaaaatcatattttatagtaggttattcagtatctaccaactggaaagtcaagaattctctcatgtattcatagaagaaatattcgtaagtggtgcatgatagaaagaaatacaaactatgatggcgtaatatgcagaggtcacatatcctatttttattcaaatatatgagagttctggcattaagttatgatggaatagcatgcattggactaagccttctgctgggaaaagtcatcagctctggacaaaaccaagctgctgtaagttccaaattatttataacatatcatacataatacccagtatgtaattttaaaattactaaacaaagtcaactggaaaatatgaccgacagtcaaaagaaaagttagataatagaaacaaacccacagatgactccactgttgaaatttgctgaatttaaaataactaagataaatatgttaagctataggagaaacgagtataatgcgggggaaagaaccagatggaaatcctaagattgaaaaacacagtatcagaaatattttaaaaatcattacatgggataaataacagattgaatacaaaggaagaaaaaaattggaggacttgaacacaagtcatagaaatcatccatactaaagcacagaaagaaaaaagattaaaaataaaatacactgctatgtcagtaacctgtggaataatagcaagtcgactaaatctatacaatgtagtccaacaggcaaaggagaaagagaatggggcataaaataagtttatatttacttccaaatttgatcataaactgcagcactcaaatcaaggaatcttagcctaccccaaagaggataaatacaaagaaaaccacacagagtcatatcacacaaagagtcaaaaaatcaaaaagaaaaaaatttaagtagccagagaaaaagacatatcatgaatgggaaagacaattataagaatgttatctgacttctcatcagaaacactgaaggtcagaaaatgatgggccacctttaaagttctgaatgaaaaatatctagcaatctacttacatagattgatataaatatctagtaaaaaaggtatttatatctactaaaaattatatttacataataaaagcaaaacaaagactgtttcatacaagcgaaagctgacataactttgttaccatcaggcccagacgaactaaaatactgaagaaatttcttccatctaagggaaatgataccaaaaagaaaactggatctacataaaggaaagaacagctaggagtaggaaatatgtggatacaataaaatattattcttcttaagttctttaaaagtcaattgttgaagcaaaatatcaatctattgtgaggtctatgatatgtaatagtatgtagaaataaaatatatgctatagcacaaaagataaaactaacagtgtaaatataattataatatggcagaattcttgttatacataaagtggtatattaattcagtatatatgtaatattaatattactttataatatactatttatataatgaatactatgtattatatatactatataatatagtatattatgttatactatattatactataatttattatgatatattatctatactatatataatatatagtgacttttgcttttgattatatatagtatatatacatagtatatatacatatactatgtatatatactatagtatatatactatgtatatatactatagtatatatactatgtatatatactatagtatatgtatatatatagtatatatactatgtatatatactatattttatagtatgttatatattatatgttgtatagtatgttatatatgttatactatattatactataatttattctataatttactatattatatatactatataatatagtatatatacatagtatatatagtattacatatactatataatatagtatatatacatagtatatatagtattacatatactatataatatagtatatatacatagtatatatagtattacatatactatataatatagtatatatacatagtatatatagtattacatatactatataatatagtatatatacatagtatatatagtattacatatataatactatatattaccacatatagtatataatatataatatatattacagtaaatactatttagatatatactatatcctctatattatatataatatatactatatacactctctattatatataatatatatgatatacaattatcttattacattatagaaattacaatttgtaatattataatattcacactagtaagttaaagatacacattttaatttataaaacaactatccccccaaaaaaaattaactaaaaaaatcagaagacagccaatgatatatatgatgtttcaatgattagtatactaaataattccagcacaaaaggagacaagcaacgagggacaataaacacaaagaacagagtggaaaactacaatacaaataacataagggtgtgttctagtctcagaatgaaggctgtagttttccaagtagagaggacacaaaaggattttaccttattttcatttaaacatataggcggtatggcagtagaacaaggaagctaattaatgtattttccctcctatatataaaaggcagaaatgaactcttaatcttaaatagaacattgactgcttatattttttgaagaggttgcttggcatagtagaaggaacccagtccttccaagggaggcaatcctgaatgtaaattctaattctatctatttactctatgtacttgccatgtgaccttgagtaggtatatgaatcccctggagaagttttctcatctataaatgtagctactgatgcttttctcatagaattgctgcaaagattaaataagatcacaattataatgtgcctatatcatagaggacattcaaaaaattttatttcacctcttaggctatctcgataactgcctaacacaaaaaaaatgaggacacagtccaaatttttggtgaaaatgccaatatggaatagctttgctggctgggtgcggtggctcatgcctgtaatcctagcacttttggaagctgacgtgagaggattgcttgaggccaggagtttgagaccagcctggccaacttggtgaaaccccatctctacaaaaaatgtaaaaataactggaaatggtggggcatgcctgtaatcccagctacttgggaggctgatgcatgagagttgcttgaacccagaaggcagaggtgacagtgagctgagattgtgccattacactccagcctgggtgacaacaagactttgtctcaaaaaaaaagaaaaaaaaaagaaagaaaaagaaaaaaagaaaagaaaagagcttagctattagactgtaagtgatgccctttagtttgtctttcactatcatcatagctctcttctcttgaaggactctctacatttttttcattgttttcagtttttaattaaagattatatcctgttctacagccatgatctatctgcagagttctctctgcttgaattccttttctttctctagagtgaggagtttgtatttatttatttattttgctggtgaaaaagaaaagaaagagtatcctaaaggatacaaatcaaaataaatatgtctcttcttgaaaatatttcccaaaccacgaatttgtgtcacttcagtgacactgagcaaatttgacctgctaaagacacattctggtttcatagtcctaggtgtgatgccttaacatcctgcttcatgcttttcagaaaaatcagaccggaaagtcttttgaccttcgcatgtacaaggatttgctcttaggctaacatgagagcattctgtccggcgagtaacgtgcagttcccctcctcactaataagattactgtcactaaaatgagatatgagatctggactagccagtttgtgttgctttagaattctgcccaagggaaacttgttcattatgtgagtgctttaaaaatcaagggaattggaaaatattactaaccccatgcaatttcatttcccttccgtaatgttactatggcaactcagcatccctctcattctctcctgtccaactgcatatgttgcctttcttgaggcaccccctccctcaatcccccgaaattgcctttgtctagcatttttcaactggagatcaacactattctatgcagttgaaaaactgctttttggtctccagctcattctaagtgactttgttcattaattatacatttctaggggttggaggcaagtaagaatccttattccgcttcaaaaaaaaaaaagcgtggctctaattttagggaaatgaatatgccagttctctgctacattgcaaagcacagtatcaaccatagctcttttattacgcttattagtattctgagtagaaaaaggaaatcttatttagaacaaattctgaaagctaagagacttagtcacatccttaaatcaaatcccaatttacaagtcacttattctatcgagaattttacttttctggaaaaataaggtattttaatagtgctactgaagtagacaaaatgagtctactcttaaacaaaaaggataacaaggaaaataattttaaacaactaactagaaaatattttttttcactagcctgaaaacacattcattcactcactccattcattcatttactcagtaatttttattaggcaactttcatggacatagtactaagttacctcctctgtaagattcatttatcccttaagctggtaatcttgtcctcagagataaactagtgttaaattaaaaaattattcatgatacttgtaagaaaacagtaaagctgactttatccaaagggggctactacaaaggaattttatagtagtaaagagatctagctcaactctgaatacagcaaggaaaggtgggaatttatagccaaggagtagggttgaggtcagtaaatagaaaattactaagaggaaatgtcaagggtaggggcacttctggctaaactgacttgccaagattattgccaaaggcaggtcagattgataagagtggcagggtgggagataaggaatttgatctaatagaaagggttgggattttcattaaactgatccagtaggagtcttgctaaaactgaactaagcagacactaacatatggaaagccaaaagtctagatgagaagagaattcagagaagcttgactagagttaagtcaaggaagagcatctttgtcactggaaatattcatgtgtgcccacaggtaaagaaaatactaggtaaaaagttacaggtcccccaaaagaggtatagaaaataagacaggagtctggaaggtagaaagattccatttaatttgtgaaaagatttcaaagaaatgctctgctctaagatagtaaggatcctgtaggaagtgggaaaggaactctcaggtacatgaaatggcgtgggcaagacagtaaaacaagaaaaggagggactcttatcagaagctgcagagagtttgttaattgcagtataagttaagggaatcaggaaaggccaagttggaccaagtatagcaggaactgattttagacgactttgaatgctaacttgaagaatttagacttgactgaggagtaactgtgaatgacagttagtgaagatcattttgaacagaatggcatcctaaatcagaaccgtgtgtcaggaaagtgagtgataggccacaccagcttcaaagccaaagaaatgagttcaaaatttatttttttaaccaaaaagtggagtgaagtggaacaaatgcctgctagttttcctcctctttttttttttttttaactgaattaagtgtgaatcattaaatggcaggtacttttcagtcccactgtggatcagctggtcttgcccatcttcatgactgcaagaactgtgatgctaattaaagatcttacattcaccctaggcactcgttttccactgacctgtcaatgtcccagcagctgggccagcgctgcctgtgcagccaggcagtcgcatcattgatatcttgtgcagcttcctgatgaggcatccctcctgcagcaattttggctacttgaagagctacatgcctttgaaaagagctagactgaatctgtagaagatccaaaggagactgacacttgaagtcagtgttcagaatactacaaggaaaactacagttgaaagagttgtgcttcaggtagctctttgcagttcagctagaactgatgagttgtaccttggggaaacagctgactttgtcatggaagcaaggtgattaaaggaacaatggctaaagaatataatacttcacagctcttccactggtgaaatgtcacctttccctactgagtctttagatgccacatgttgttagtaaacaaacatcagagatcagaggtagcagcttctgaatgtagctaagggaaggctaagagtggctgcaagtgtgagcacagggactttgccttagtaacccctctgaagacatgccttgattgtcttgtagagccagcactcatagtccaagcctcgttctaaatttggtgcgtgcagccttgaatgagtaatttcacttctttgaaccttggaatctctatttatcaaatcaatattatactcttatagcactaatcatgaggatataataatatgatgtcttggatttgcttcaaaataatacaagaaaagggtttgacttttggtcagtatatagatgagtcatgactgaccatggggtgacaattgtggaagctgagttaggtacccagaggttcgttataatattctgtctatgttaatctgcaatatgtctgacattttttataattaaaacttcttttgaaaagacaaaaatcaggccaggcacgatggctcacgcctgtaatcccagcactttgggagactgaggtgggaggatcacctgaggtcaggaagtcgagaccagcctggccaacatggtgaaactcagtctctactaaaaatacaaaaattagccaggcgtggtggcaggcgcctgtaatcccagctgctcaggaggctgaagcaagagaatcgcttgaacccagaaggcggaggttgcagtgagctgagatcacactattgctctccaccctgagcaataaagcgagactccatctcaaaaaaaaaaaaaaggcaaaatcaacaaaaaatatgtatctgtaagaagaaacagtatacctcaaaggattaaggagttgatggatgagatagattttgctcttagccaaacactttgcattcagtatgtagcattttgctttgtggaagataattttcaaggatgaatgagtgcagctaaaatagttatttttctgtgtgagcacagtttgaaattcttgatgaaaagagtcagacactggtaagatatttgaatagatttattctgagccaaatatcagtgactggtggcccgtgatgtagcccttaggagatcctgagaacctgtgcccaaggtggttcgggtacagcttggttgtatacattttagggagacacaagacatcagtcaacacatgcaagatgtacattgcttccatctggaaaggcaggacaatggaagcagagggtcttccaagtcatcaatggattcaaagattttctgattgaaagagttattcaggttgaaagagttattatcaatacaaaggaatatctaagttatgataaggggttgtggggaccaaggttttatcatgcagttgaacctcccaggcttcagagagaatagattgtaaatgtttcttatcagatttaaagagtctgttctatcagtaattccgaaaaggaggagggcagaatgaggcatgcctggcttcccttacccatcatgacctgaagtagttttgcaggttaattttggaatgcccttggctgagaggaggggtccattcagatggttcggggccttagacatttatttttggtttacaaacatctctatgcatattttgtcattttttacttagaatctgcagaagagaaaatgaaacaattttgaccttttagttcataaaaaaaaatcactgtactgcagtctgtatgaaatgttttttgtgtaggtggtggaaagtggatgtgattattgtatattatttctccatcagatgtcttcaggttttacattatgaagtagacatttggacattattttttgtatgtttccagattttattttaatagtaaaatgctgttttcacttgaaaggctgctttactttggtttataaaagcaaatgttttaaatcaacataaaaggcagaagatataaacgtgctccaaagaatgttcaaattaggccatgtactatttgcaattcaaatgttatttttaaataacattaatactattgagatttggctagtagtttagaaatagggttgtatcttgttgcttatacattagaataattaggcttactttcaatatctgctcacacaatccagaaagttacatgaacgtattgaatcaaattttgttgtattttttaatgtgattatccttagggtaggtattaagtaccagtctcagggatcttcaagttggggaactcttaaaccaagaacacttgtgaaaacttctccagcgggattggggccacttagttttaagtgaataactctctacttcctcaacttcctgcagagtctcccttcccactgatcctttaacacacattccttctgccctagtactaagaaaagcctagctctctctcacgcacattgcccaagggtgcaaaaacccctgaggtggcgggggcaagcagaaaaattcaaaatattggtattctgctgataactgcctgattctaatgatctgataaaccccttgctgcccacaaaaatgaaagacctaataaagttgtcctgtgacggatcattgagaagaattttgggtgaaagatcattaagtatggaggatcagatggacagattgacagaagtaggcttcagaagatgggtaataaaaaactacactgagctaaaggagcatgttctaaaccaatacaaagaagctaagaaccttgataaaaggttagaggaattgctaactagaataacctgttgtgagaggaacataaatgacctcatggagctgaaaaacacagcgtgagaacttcatgaagcatatacaagtatcaatagctaaatcaaccaagcagaagaaaggatatcagaatttgaagactaccttgctgaaataaggcatgcagacaagactagagtaaaaggaatgaaaaggaatgaacaaagcctccaagaaatatgggacttcataaaaagactggacctactactagaatatgagaaggagatggggagaatggaaacaagctggaaaacacagttcaggatattatccaggagaacttacccgacctagcaaaataggccaagatgcaaattcaggaaatacagagaacaccattaagatactccatgataagatcaaccccgagacacataataatcagactctccaaggtctaaatgaaggaaaaactgttaagggcagccagagaaaagggccaggtaacctacaaagggaagcccatcagactaacagcggacctctcagcagaaactctacaagccaagagattgagggccaatattcaacattcataaggaaaagaattttcaacccggaatttcatatccagctaaaaactaagcttcataagtgaaggagaagtaaaatcctttacagacaagcaaatgctgagggattccattaccaccaggcctgccttacaacagctcttgaagccagtctccctcatcctcatctccctcttctctctcttctcctctccccttctctctaccatataaagactaatgaaactatgaggaaacagaatcaactaatgtgcaaaataaccaaatagcagcatgatgacaggatcaaattcacatataacaatactaaccttaactataaatgggcgaaaggccacagttaaaagacatagactggcaaattgggtaaagagtcaagacccatcagtgtgctctattcaggaagcccatctcatgtgcaaagacacacataggctcaaaataaagggatggagaaaaatttaccaagcaaatggaaagcaaaaaaaaaaaaaaaaaaaagaaagaaaaagaaaaagcaggggttgcaatcctagtctctgacaaaacagactttaaatcaacaaaggtccaaaaagaaaaagaagggtattacataatggtaaagggagcaattcaacaagaagagctaactattctaaatatataggcacccaataaaagatcgctcagattcataaaacaagttctttgagacctataaagagactaaactcccacaccataatagtgggagactttaacatcccattctcagtattagacagatctatgagacagaaaattaacaaggatagtcaggatttgaattcagctctggataaagtggacctagtagacgtctacagaactttctaccccaaatcaacagaatacacattcttctctgtgccacatggcacttgttcgaaaatcgatcatatgattggaagtaaaacactcctcggcaaatgcaaaagaactgaaatcaacagtctctcaggaccacagtgcaatcaaattagcaactcacgattaaggaaactcgctgaaaactacacaattacatggaaattgaacaacctgctcctgaatgactcctgggtaaacattatgacattaaggcagaaatcaagaagttctttgaaaccaatgagaacagagagacgatgtaccagaatctctaggaggcaactaaagcagtgctaagagggaattttatagcactaaatgcccacatcagaaagcttgaaagatctcagatcgacaccctaatatcacaattaaaagagctagagagacaagaacaaatgaatccaaaagctagcagaagacaagaaataactaagagaagaattaaaggagataaagacgtgaaaaccccccaaaaaatcaatgaacccaggcactgtttttttgaaaaaattaacaatatggatagaccactagctaaactaataaagaagaaaagagagaagaatcaaatagacaataaaaaatgacaaaggggatatcaccactgacctcacagaaatacaaactactatcagcaaatactataaacacctttatggaaataaactggaaaatctagaaaaaatggttaaattcctggacacgtataccctcacaagattaaccaggaagatattgaatccctgaatagaccaataacgagttctgaaattggggcagtaattaatagcctaccaaccaaaaaaagcccaggccccagatggatttacagctgaattctatcagaaatacaaagaggagctagtaccattccttctgaaactcttccaaacaattaaaaaggagggactcctccctaactcattttatgaagccagcatcatcctgataccaaaaccaggaagagacacaacaaaaaaagaaaacttcagaccagtatccctgatgaacatcgatgagaaaatcctcagtaaaatactggcaaaccgaaaccagcagcacatcaaaaaacttacctaccacgagtaaatcggcttcatccctgggatgcaaggctggttcaacttaagcaaatcagtaaacataatccatcacataaacagaaccaaagacaaaaaccacatgattatctcaatggatgcagaaaaagcccttgataaaattcaacatcccttcatgttaaaaactctcaacaaactagggattgatggaacatatctcaaaatgataagagctatttatgacaaacccacaactaatatcattattgaatgggcataagctggaagcattccctttgaaaactggtacaaacaaggatgccctgtctcaccactcctatttgacataatgttggaagttcagaccagagcaatcagtcaagggaaagaaatagcatattcaaataggaagagaggaagtcaaattatctctgtttgcagatgacatgattttatatttaaaaaactccaccatctcagcccaaaaactccttaaactgataagtgccaaatcatgaatgaactcccattcacaatcactacaaagagaataaaatacgtaggtatacagccaacaagggatgtgaaggacctctgcaaggagaactacaaaccactgctcaaggatgtaagagaggatgcaaacaaatgaagaaacattccatcttcatggatagaaagaattaatatcgtgaaaatggccatactgcccaaaataatttattgattcaatgctattcccatcaaactaccattgacattcttcacagaattagaaaaaaagtattttaaatgtcatatggaatcaaagaagaccccatatagccaagacaatcctaagcaaaaagaacaaagctggaggcatcatgctaccttacttcaaactacactacaaggctacagtaaccaaaacagcctggtactggtaccaaaacagacatatagaccaatggagcagaacggagacctcagaaatctgcaatcatctgatcttcaacaaacctgacaaaagcaagcaatggggaaaggatatactattcagtaaatggtgctgggaaaaccggctagacatatgcagaaaactgaaattggaccccttccttacatctaatacaaaaattagcttaaggtggattaaagacttaaaagtaaaacccaaaaccataaaaaccctagaagaaaacctaggcaatagcattcagcacgtaggcatgggcaaagatttcatgacaaaaacgccaaaagcaatggcaacaaaagccaaatttgacaaatgagatctaattgaactaaagagcttctgcacagcaaaagaaactatcattagagtgaacaggcaacctacaggataggagaaaatttttgcagtctacccatttgacaaagggctagtatccagaatctacaaagaacttaaacaaatttacaagaaaaaaacaaccccatcaaaaagcaggcaaagaatatgaacagacacttctcaaaagaagacatttatgcggccaagaagcatatgaaaaaaagttcaacatcagtgatcatcagagaaatgcaaatcaaaaccacagtgagatactatctcacaccaggcagaatggcaattattaaaatgtcaggaaacaatagatgctggggaggctgtgaagaaataggaatacttttacactgttggtaggaatgtaaattagttcaatcattgtggaacacagtatgacaattcctcaagaatctagaaccagaaataccatttgacccagcaatcccattactgggtatatacccaaaggaatataaatcattctactataaagacatatgcacacgtatgtttattgcagcactatttacaatagcaaagacatgaaaccaacccaaatgcccatcaacaatagactggagaaaggaaatgtggtacatttacatcatggaatactatgcagccataaaagagaatgagatcatgtccttcgccgggacatggatgaagccggaagccatcatcctcagcaaacaaacacgggaacagaaaaccaaatacctcatgttctcactcataagtgggagatgaacaatgagaacacatggacatagagagaggaacaacacacaccagggcctgttgggggctggggggtgaggggagggaacttagaggatgggtcaataggtacagcaaaccaccatggcacacatgtacctgtgtaacaaacctacacgttctgcacatgtatcccatttttttcttttagcagaaatttttcaaaaagattttaaagacaaaaaaagatcattaagtaatttttcacatggaattcagagaattcgtaactctactacaacagtctacatgaacaaggtttctcagcactaatatgtataaaagcaaaaatcagggctaatattgatgctgaaccctgtcttattctagcaataactaatcttcattagcagatacataaactagtcgtgaaaaaagcatatctaattaaaagagaaatttttaatacattgtttttgtggaatggtcacaaaactttttatatatttttgctgttttgattggttatattcaaataattataataatccagtcaggtgatttgttttttacacttagaggaatgtattgtcaggaaatatttcaacctttcttaaatttaaacttatataatttcatggcagagaaatatgtagtaatcaataaaaaaccttcaagcataaaattacattaagataaaattatgtaggggaaatggaatggaaaaagaaccaatgtagaatttctattacaaatttctattttagagtttattcatgtgtttttgttaatggtgagcatcaaattacttgtagtacttagattttattggctattcaaaagactagtggaaaagttatatatttaaacgtcaatattcaaacttgtgggaaattacatactttgcagctacttaaacttatgaaaaaatgtagttttcaacctaaaataaggaattattttatgaaataaatgagcaaatgtttgaagcccgcttgaccacagcatgttgggtgccatgctggatcttgaagaagtacactgcactcatagaatttattgtcaaatttaattggtgatgtttcctttgttcaacaggatggtctgacaccactgcactgtggagcaaggagtggccacgagcaggtggtagaaatgttgcttgatcgagctgcccccattctttcaaaaaccaaggtaatttcttttcaggtttctggacattggactgtatttattttgatggttatatgatctagccttttgaatcacatagaaaatgacattttcaatgtagcagtcagagtagttatgttcaccagatctttatagaacctcagaataagtttgggctaattaagattttatgtagaatgtgctataccacaaagttgtttgtgtgtgtgtggtttttgttgtgtttcaggaatgcttactgcttgattttactctgtgaaattttcatagctcagaaataattgcttgtcaggttaagaaagactaaagttctacactctctaacgtttgggtgccggctatcttcagcacctcagcttacttcttgagagttcatagacttttaaggaggtcaaggatatcacttagctgataaagactggaaactttggaaagactgcaccttgattgggcttttgggaatgttgacatagctgaaaggaacacatgatgattgcctgaaaaaaattaatggttgactctcttttagacttttttttaatagtaaaaccatttgacatcatttgaagaggagaatatttgcaaataaattttgagacatgtaaaccacctcattgtcactactacttttattaattaaaccagtgatttttttggaaatgatactaagctttactaagagctttaatctctaaacattatcaaagcaacaaaagcacatattatttctgtcttcactctggtcagtgtttcctcaacaatattaggaaggctagacagggttgagatggtctggacaattccatcactcatttaaaacgtagggtttagattggtgagctgttgagggtattgtctaacagaattaaacagccatgatgttttcattgtatatgatgacatcttggccttttgagtgtttcttatcttgatgattctatttgttcttttccttttacataccccatatctattttctttccccctccactgctatcttctaagccacattatcatctctcacctaaccactgtagtagcttcctgttggtccctcatttccctttttgctcctttacaaatcagttcccactttgcagtcagagtggccatataaactgtcatccaaatcatgtcagcctcctgcttaaaaaccctcccattaatccccattgttctctttcaaattgattttcattttctcagagcagtaaggaccaatgttaaaaatcagagagttgctcatattttttctcctattcatctcattgctttggattttttctgagaaatcttcttaatttttttcttccaatcttttaattttcaagaacattttcttgttatcagatagcttcttttcttaaagtatcctgttcttgtttaatgggtacatttttttctgttacctttctgagaacatttgagataacttttcttttaatttagtttttctgtttcccaaatgtccctaattcctcagatttcctttttttcctttttttttttggctctgtattttacaatgaaggcttcccacaatggctgtacctaattgtgtcaggcacaaacatgtgagtggcagctctaaagagtgtaggcagtgctgatcaggtggcagtggttaagaggggctctttaatgtcacaattaggttccctttaccttaggcggtatagttttttgagagacaaatccaccaacctttgcagtgcacacatgtgtgaatacattctgagtaggggaaagaggctgccagtcttgtgctttatgcatactttaatcataataatgataagcaatattttacatagtgattactgcttatcaggctctatgttctttacacatattaactcatttaatcctcgttaaatgagatactggtattactgttattcccttttcatagatgaggaaactgaaacccaaagaggtaaagtagctttctcaaaatatcccaattagtggcagaacaaggatttgaacccaagcagcccaactccagagaccacatccttaacgcctccattctccttcctttttctgtgatcacctattcttggtccagatcctcgtcactgccctctgttctgcctgggcccttgagtctgaatctctctctagttcaccttctccagacactaattctggtgtccttcaggctagcaggaggcagttacctgactttgctgagttgggaagggcctggagacctgacggctccatacacagtctttgaaccaatcttatttgcagccccaagtctcactttatcttctgaggtactacgcttccacagcctttgcctttttgggatttgagaggcaaatcagcttgtctttttattcccagcagtgtgctggatcctgattgtatcggctcatgagctggttgtgtacatctctttccaattccccattcagtaacatcagatggacggcttgaaatgggttattgtggggggatttacagcatggaaattgggtagtgctacacactggggcttttctttttccaggagttgggtgttaaaacatttgtcagcacagcactgattctactgcttcagacacttaggtttcagcctctctcttcagctggatgaattaccacactcaaatcctcttttcatattctgaagtttggagacaaccctcatctggttttttatttcttccccattgtgtgtgtgggaatggaaaaggaaacacacatgtgtgcccttctagattttaccctttaaatccattactgctttttggtggagttttgggagaggaaggatacatatatctattacacctgctgtgtttgatcagaagtctccctctgcactgaggatagacttcttaacagattctgaccacctctcttcctcatctcctccggttttgctccttccttgccatcttttagctaaccagccttcttttacttcctagaatacgcctttgttctcatttcctgtttgcttggtttgagttccctcagcttgttccagatctctgtggtccccgtatattcttcaactcaaatgtcttcctcatagacaggcgttttctcacgatttacccctcccatcttcaccacctcctgccagtgccatctggccatattttattttctttagagcttttaacaccatcttgaaattatatgcttgtttacttgcttgctgtctggttctcttcaatagaatgaaagcaagaacttttccttgttgagtgcaatacccacaagcacctattttcatgcgcagaacacagtagggcttcagtaaatatttgttgaatgactattaagtgaatgagtacattcctagccttaaggccatctgacccgttcttcaagaatttcatcttactgagctaagaaagcccatcacattggttccatattttcaggcaccatatgtaataccacctctttccatagggcagatgatcttttctttactgttttcttgtccttctccaattatctttaagtttcccatccacacaatcattgtgtttttgcattgctagagaatttttttttattgacactgcctcccatttttactctccactattacttgttctctcagattttgtgggatttttttgtttgttcacttgtttacttcatgttttcctctaagactgtatcaaaacataaagcaaaagaatattttggcaggaataaagcagtccatatgctcgtgggtagcagtatctcaaatgggaaatgttcctaccttttcctgcaccttaatttctacggtttaaaatatttgagggaaattttttaggcagaaatatcctgatgggctgacagtgtacgaggcctttaaattgacctagatatttgctgagctctttctgtatatgcaaagctctcttctgggcaatgaaaaaataataaccatgtacctcttgccttcacggaacacaaatagttgaaatatatgtcagagagtggataatgccgttagaatggttaacaaggagcttatactactttttcttatcttgaactccttctttgtgtcatccattgataaattcagagcaaataacttggctcagaggattcagaaacctctggttccttggtacatatttgatctgtcattgtcaaaattcattgatgacaatttttttagaaactgaatttgctgtcaaattacttttccctaatatatgttaaattatgttacaataattgatagagcctctcttgataattgaattctctaggaatttcccaggctcccccacttcgccatcatagttaaaagaaaggactgacatcttcatagcttgttttgccttcattaggaaacatattgagtgccagtgtcattctaggttttatttacctttgaccctatttatttattctctctgctctttaaatgaattttcaactcgctcctactgcacgtgattaactgtgttattgaacccagttgatttaaactaacaagtcaagcattagttagtggctttgtcaatgccttgcctttcctcatcatagacacatgggggcaccagattgatagaaaagggaaaagttttcctttcttctttgatgtgagatgaaatgcgttacattcagaccttttttaaagtcaaatcagtatagtcttcaatattgggtgttagtaatctctaaggacaaaattaataccagtccaatgaataccactgttcttaccttcattttttcttttagtcttaaatattaagaattcctatctggccaaattacagtggctcatacctataatcccagtgctttgaaaagctaaggcaggaggatcgcttcaggccaggagtttgagaccagctgagcaacagagtgaaaccccatctctatttaaaagaaaaagaaaagtaaaattcatatgcctctaagttatgacccatgctgcaattctcacttctattaaattgggaaaagacattatccttgacaacttgttattgactggcataagcagttgggaggaccagttttaaaaatagctgtagttcaaaatagttgtcaaaagcttttacaaatagaaggtattttcatgtgaagaactggagtttttatctgtttatatttgcactttgtgttctgcacatttgtgtttaaaaggtaaaagaatgaactctgatttctttatgtgttccagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctggtgagtggctcaaccagcgagtccagcctcagttgtcttgctcacaacgtgctgcctctgtatgtgaagggaatgctttgaggaggttaaaatagaaggtgctagttaaagtgtacttcttgtcaattttttcaaatatccttcaggaaagtctacaaaattttctatttctgacatgagaaaggctgagggagccaaactgttaatgtttttatggtcacataagtgattcccgtatgaacccaaagactatacaattataaaaagactaaggtggccaacgtcgtcttattgtggataaacttataattctgtgaattaaaagtttattctgagatctgaaaacaaggcaaagttatcaaaaaactctatttgaaacataagtggtctaggaatttgtgagctaaaattttatatatcttaaccttgtaagttaatgaaatattgcctgtaatcttctgtttccgtttgccaatcagaattttggtccagtttataggcttcactttaatttgttcttttaacctttagctatgctgtactttggttttctcagcaagatggtacttgttgtctttgcaaaaataaatggtcccaaattagtaagctgtctatttcagaataagtacccaagtttaggaaaaaataagtcacccaattttagggaaaacatgtgagtttactagcaattttgaggtaaaggttgtcatcatccaattgacccttttaggaagggtttttgcccctttccaaagagtgcggtcatcctgtctggatagatccgtaccacctcttgtactctgtgggctctaaaattcagagtggacaggaaagaatgacgaaagagaaactctccagaccccagacacctccttgccactataattctaaaaccttttaccaaagcagcatttcaagatcagtctgttgacccacccagtctatcaaatgtgtctgaattctgagaagggaggaaaggaaattagcagtcatgactcttttttccatacaagaaaaaaataagtcctaaaacagggcatgggctcccactctcattttcctctgactctgaagatttcacaacatatggaggttgtagccagtcatcctgggatggactgtggccaaatggtctgagaagcctcggtgaaagcacctgcagtgactttgacctaagcttttacagtggactctggtattttatagttctccactggcagctgaaatacgtgccacagtctcaatcggcaggcaggacaacttaggacataatttattaaaaagcagattcttttattagattaaatagtaaacaaaatgattcaaataatgggttatttacatttctgcatgcttggagtaaacacctacttgaagcataaagctagagaagaaatcaaaacgttttagagctggtcttgtagttgtcctaaaacacagcaaagagaacagaataaaccttggtgaagtggagctgtgaggacaaatgttggggccagacgttttcagtctgtatttgaaatgaggtagaggagggacatattattattatttattattttgaaacagagtttcgctcttgttgcccaggctggagtgcaatggcacaatctcggctcactgcaacctccgcctcctgggttcaagtgattctcctgcctcagcctcccaagtagctgggattacaggtgcacgccactatgcctgcctaatttttgtatttttagtagagatggggtttcaccgtgttggccaggttggtctcgaactcctgacctcaggtgatccacccacctcagcctcccaaagtgctgggattacacatgtgagccaccacacccagcctgagacatatttggaagagtgaattccaaaataaaataatgaaatgaatgatcatttttacctcagctaaccaggagagtgtaataaaaattcacttcctgttcacaattatcagggtaccttgggttcccagggcagctggactacttctagaatagaatctacatgctgcttaaccctggtactttctgttcatttcaatttaccacacatcattttagcaaaactatttactgcacacagtgaaactggattttgatggaatgtagtcaagcaggtatatgtatttgtcccttgcagaatggctttacccctcttcatattgcctgcaagaagaatcgaattaaagtaatggaactccttctgaaacacggtgcatccatccaagctgtaaccgaggtgagaagagttaagatttctgggagtcctgagatactgagagtatagccttagcagccagagccccagggccatctccagggaccagctagtttgtttgcatatcatggccatagactgcattctgaactctttaggaagagggctgccagtccctaggagaagcagacaaacatgttggtgggtgagtttgatgcaaatgtatcaccatgtcaagaaatgtaacctaaaacacatgcttaaggggaagggcaccttcacagaaagcataatttatatcaaatcctatactgtagtacttctctagtgggtgcagttttgtcccccaaggggcgtttagtcatgtctggaggtacttttagttgtcacaactggatagtactactggtctctagtgggtcaaggccaaggatgctactaaacagtttacagtatacaggacagtctcccgcaacaaaaagtcgtctgatttgaaatgtcaaatgtgctgaggttgagaaaccctgcacaagacgaccttggtgcttttctcaagtaagggttactctgtcttaaaactcagaattaatgaaacagctgctgaggttagtaaagtattagacctaagtttctctcataggaaccaactcagaactcagagaaatgatccatcagaatcagggctgtgccttctacaaagcaaaccaagcctgacacctaccctttcagacttgtcccagacccccaacctccacctcactacatcctagcactctgattgatctctgttaattctaattctaacccttggcacttccatagactagacactctcttgtttgcctccgtatgtctctgcctctgtgtgtcacacccccttggccaggcaaatcctgcacgtcctttagaaccagatctgggccaccttcttcaggaaacccccgctcactccccagcctggactacatgttccttctaggaaccatcacctcatcgtgtgcatatttccatcaaagcccttatccagctctctgacttatgactcagtggcacccccaagaaccccagaggctgaaggctccttggaagcagggctgagtctgactggtcttcatatacccacactgtctggcccatacacagatcattcagtaaagttttattgaatgcctgatgcttaactataggatttgaagcaaacataaacattaaagtctagtctagtgattgttgcttggcttcagtttcttgcctgcaaatggaatatttgcctagatttacacttagaatttttaaaatattaaatggttgacaatatgaatactgatttgccatattgtcaggcttatgggttcatattaggcaacctgttatttttaagtataaaatagaaagtttactttcagtgcataggaaccctcttagagataagaataggctctaaaataaaagtaaattcttggctgatgtttgagtaaatgtccagagatatcaaccagtaatccagctctctgttccctaagagctttaaaaggcagttcagaccaagattttgccttgcacaagctctaactactccccctgctgatggaaaaaggtgccaagactataacaaaattctcattttcctaattgtcctccattcttctcactttttgaattctggacagccggaattattccttttctgtcttttacctcactttgattgtatagaattcctttcatatatttttgacatttctcaaatttctgctgagattaattatccccttctgtcccttttttaaaaaacaggttagctttttctaaacatactaaaaaaaatgttttatcaagttatgatgttcatgttgtaagctaaattaaactgaaaaatttaaaatggaatcatttcatataaaaagcacgagtaaattatactctttaaaatattaatgacttgagatttttatctttcttattcactctaaatctcacaatcatggacatattcaatataaaatatcctggaatcaataaattctgctttacgctgaagagtattctggggtctatgtacatttatgtatatgtatgtgtgcataggatctgaagcaattcaagtctagtctagtgaccattgtaatatttgctttatttagattgctttaatttataatacccataaagttaaacaattaaatgtttgaaactattaatgctgatttgttcatttattaaagaaacagctttgtgttaggtaccctgctcttttatatgtgacataaatgggaatcctctttaaagcccagaataggatctgaaataaaagttgactttttactagtatgtatgaaatcacagctctcctccttctacacacacacatatggataaggaaggtttattagtaaaggggaaaacaaccttcaagttatttatcaattttttcaaagatctacattaaaagtatgaaataaattctttttcttttttaataggtatgacataagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaatcccccgtctctactaaaaaatacaaaattagccaggcatggtggcgcatgcctgtaatcctagcaacttgggaggctgaggcaggagaattgcctgaacctgggaggcggaggttgcggtgagctgagattgagccattgcactccagcctggccaataagagtgaaactccatctcaaaaaaaataataaataaaaaataaagtatggggggtatttttctacaacaaaaacattaaaaagtaccgcatgttggagaggttgtttagatactatcgtcgtttatacaaagaagtgattttagcagggcatggtggctcacgcctgtaatcccagcactttgggaggccgagatgggtggatcacttaaggacgggaattcaagaccagcctggccaaaatgatgaaacctgtctctactaaaaatacgaaaaagaattagctgggcgtggtggtgcatgcatgtaattccaactactcaggaggctgaggcacgagaatcacttgaacttgggaggcagaggttgcagtaagccaagatcatgccactgcactctagactgggcaacagagtgagactctgtctcaaaaaaaaaaaaaaaaaaaaagaagtgatttcaactaacttcaaggtagtctctctttaatgtgcttcaccatgttatagcaaacccatggaattctgtgttcatagattactcgatggtattcttttcccacactaaacattgctctgtaggaaccatgaggctcacttcagagtagctatcagagtggtaacttaccacccatgatctgcatgtggcatttgacattgttttatagaatttcaaatttgacatcataatattagcacaacagaccatagacataataacactcattggactcatgagcattaaagaagtaacaataaaacaagcaccatcctggcacagaaggggcaagctaggaggccctgcacgcttaccctgagagtggggctccccagtaagagtgcatcttccagcagccccaagcagtacaaccaaaagatagaaataggccagcttctgagatgaaatacagtctttcctagtactaattgcacagaatgttttcattcgtaaagggaacactgagtaatatactaaatgacatcctcagcacctttccagtaaacacaatccaccagtttcctgtggaatctgtcttcacgtgtccttccatggaagtaggtggcctataaagcaaagaccaatttataaaggcagtttaaaagtgagcatcacctatgtgagagaatatatttcatttttgttatttgtccatttcagtgtatctgtttctaataccattttcatttttaatcaagtaaagaagtaatctgaattagaatctatttggtgaaaaagtagggggagggtggtccagggcaaagaaaatgacccactgggaaaaatgcccaaagactaagatattgatctgttcagataaaacaagaaatgcaaaccggctgttgacaagccaaatccagcccttggctatgtttaggttgcccatgtagtgttttgtttttaattctgaatttatggtcaatatttaagagttagaaaatttgtataaaatccagactgccacttcttttgaaaagttgcatggtgtggcatggtaaggctggcatcttgcacagtgacagcagcgagctgcagatgtggggggtgtggggtggggggttggctgcctgcttcagcgcaggtgtgggctctctcaagcactccacacctgcccagctgcactcactcacccccctgcttggctcctatgagcactgacctttccagccctgagggaggccacattgtaggttactgagcagcaccccctggcacagtgggtgacaagactcccgaggcttatgccaaagtctttgcctcatggaccaggttcctgtgaaattctcatgcatttgatttcctatcttttcaataaggaagtgcttaggactattttttatttttgaaaaaagtccatcataagctttatgccaaataaaatacactactcttcttcagagctgcagctaatttactttggctcatgttccccagagaggagaaacagcactgcacatggcagctcgctccggccaagctgaagttgtgcggtatctggtacaagacggagctcaggtagaagctaaagctaaggtatgcgcaatacttgacaagtgtttgaaattgaggaaaaactgttggattttcataaaacttttaagtatatacatgcagtctttcaagaatactttaaaaatattgaaaaacctccaatgataaaagtccctacccaagtaacattgtaaaaaatcccttccctgcacatttgttcattctattatttaacaaaatgaaataggatgagatgagaacttgtgcctgaaactgtcagcacacggctagtccctaacagattggggactgaatctagacttggtccaaagttcttcacactccgtggagaagggcttatgcacaaagcttctagaacaatcacaacctagaagcataactgagcttttctggttgacttataagtcagctgtcaacagccacaaaaggaaaatgggggattttttttttttctacacaagctgtatggccacttcagaattggcctcgtatttcacctgcaggagaaacccacttatctgctgctattgggatagatagttcggtcaggctatcagaatggcagttcaggtccagaatcataaaccacttaatttcaacctacaatatgtaaatatacatttgcacaagtctgcagtctctagtttcaagtaaggggtggcagtagtagcagtatgtgagatttttccttggcacctattcgtttctgctttcaatattcctcttctcccttgcagcatctccctaactcctcatgcttcctactggttagatagcccctcttactttgacattgaccctcatcctccttattcttccaaaatggtgtcctctattctagcctcgtttctctacctttcctacttaaaccatttacctgaaccttatcacaattcagtagagaatttctatttagaggactaccacagggatctttgagcaaattaagatgatttgcgcctcccacttggggataagaccctaggggatcaggacttggtgagtacctcctgcccttgggtgaattgtagtgaggtggctctccagtttagacagatgcagcccttgccaggatgcacagcctggcaagcagagggcatcagcccctgctgacccttcagctgggagcctttgcacaggtatactgcgcaaccccacactgccttcctcacactctgcttttgtctatgggaaggcagaaccaacaaaataattcattccatgtgagtgcataataactggtgtggaggtataatatccctcccaggtatatgagttttactaggatacattctcttatctcccaaagaaggagcaattaaagttcaaatttgattctctgtggcaggtgtgggtggggtgtaatttatagacaactgcatttcatggttttcttattaatgagtcactctccacaggtatttaattagcttagagctaccatctcctcatttctgagcattgaagaaaaagacaaatgagtttttttagcattgactcaaaaagttgattgtacctcttacatcaagcagctaatattccctgaatttttcataaaggcaccattgtttcctcagctcatcagccttacatttctaccttgctgtttaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaaggtatgaaagcaaatctcagaatcctgctctgtccccccaaatacatcttccttacgtttccccgcatagtaacaggtccagaagctgcacaacagcatctattcttgcgatcccacagtagtcattaatatggccagcaaagctctgtggtgggagagggtaactggtagtattttgtggggggttttttgccttaagtttcttagtatgttatcttccaatgaaaccttactgatatccagagtcagatttcttgtaaattatttggtggccttaaatggtagtttaaaaacagagccacagattagcaaaatgctcaggccaagcacacaaaccacattatcacagctcggttggtagatgcttttataatacttgcaaaactggcagtgaatttttcttggggttgtttttgtttgttcttgttcttttttgtgtcattattgtcttgtctgatttatggtttgatttatttttatctcaactctgatgccttagagtaataccctaacataaacagttgttctgcatgtgcagaatgcaaaatttggagctcattttttttgtgatactacataagccttgcaagtgtgatagcaagatgaattggcttgtggcgcatcttccaaagctagtaactggtactgcactcttttatttggatgcagataagaaagattaatgtgtaatcaatatagaagacaattacaaatagaaaactatcgggataaatgatgactacctcaaatttcatttcttgtgattctttgggctcttcagtagagttgagatgcaagttcaggaagctcatttgatgtgaaacagaataatgggtgatagggtcttgagtattcaggcatttcaccataccagctgcacattccttttagtttgctgtagtctcatgaggtcaaatgtgctgatgaccctgtaatccctgactcatgattgggacccccacaacagtgtgctgattggctggttgatacacagattcttgtaggagttggaagttctgagggagccagccactcagctattaatatccaagtgttgcatatttgtccatgtgtcattattcagttcacctacagaataggcgtcgtcattctaaaaccatgtcattattcagttcacctctggtggcaaaggtgagagaatttctcactcctcctcctgaagactagaggacacataaggattgtgtatacatggagaaacggggaaagaagaagaaaagtggctggtctggtgatgtgagattgtgagaggttcagacttgccctggattttcccaagccctccaaactgagtctgggaccctataacttattcttcccacaatatgaaactctgaaaacagccctagaataagccccagatccagctctccaacttcatcctggtgagatacctgaagacttccagaaccaatagcatgtcatggctcagtcagcagaagggagaaagattaggtatcctggtatgttatgctcacaccctgtcaataagaaggctcttgaactcttatctgtgagtcttggactttaaatgcagacttcactgctcatcatcaatagaataattaatcagttctggaaagcagtgcccttatgtcatatctttttgtttgtttgttgtttggtttgggttttgtgtgtgttttccttatgtcatttctattgttcattatttttatgttttttttttttcagaaaggatttactcctcttcatgtggcagcaaaatatggaaagcttgaagtcgccaatctcctgctacagaaaagtgcatctccagatgctgctgggaaggtaagaggtcaccagccaccctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaaggtacctataattccacagcctaaggagactgatgggtaaggtctatcagtctctatctgcacatctacttctgcttcagcaggagcaccctcctagtttaggcaccactaaaaaatcacagaaatagaagcaccttaggacatctgtgccttcagtgatttagtctgctaatatggtagatactcaggaaatatttacttgtcagttgattgtctttggcaatccaggacctcctggaggaaggagagctggaacactctttagccagatgaaaaacataagcacagcctgaggaagtaagaaagttctgatttgtcagaattatgaaacatgtgttacatttttctggccacataattgccttcaagttgtttatttgcatttagtaaaataggttgagaggttttacatgtgtgtttttattattgctaaggaggatctttattgttagggcctttttgatcagtagacaacttagatttctgagaaaagagaaactgagtgggtatatagctatattattattttagtaatctaatttgagggacaaatcataaagaagagcttccttaaagacaggttaatagagtgctattggtttaataagcttcctattgttgagcaggtggctatgatcagagaacactgaaatgatgcaaaccatttcagtgttgttcagttatttcgctaaacactattggttggaggaccattgagtatcccttatgatccttctccttttttttttttttttttggagggagacggagactagctctgtctcccaggctggagtgcagtggcgcaatctcggctctctgcaagctccgcctccggggttcacgccattctcctgcctcagcctcccgagtagctgggactacaggcacctgccaccacacctggccaattttttgtatttttggtagagaccgggtttcaccgtagccaggatggtctcgatctcctgaccttgtgatccacccaccttggcctcccaaagtgctggaattacaggcgtgacacaccgcgcccggcctcccttatgctttttacatctttgatttgctaatccatgttggggcagctgcagtgctctcctttaaacctaatgtttagatcacatcattgtatacacagatgaatgaactggggttctagattactttagataccctaagagatcaagttttaggtactctctccatttagagagtatgttatcttcgacagatatttcttcctggaaactttcgatcattttctgccccatcctctccagaattatacccagtgaaatctaaaattcaaaatcaaactcccaaacttgcttttaatctaaatgtagctttcccctccacagtttctgaccctgacaaacattctttctattacaaaaccacaatgtgacttgataaaactttaatttaaaaaaagacagcagcattattcatgacagccaaaaggtggaaacaatgcaaatattcattgatggatgaatgcatatactcactgtgcatatacacacaaaggaatattatttagtctttaaaaggaaggaaattctgacatactctactataatacatggaggaatcttgaagacattgtgctaagtaagccagccacaaaaggacaaatgtatgattctacttatatgatgtatatagagtagtcaaatttatagagacagacagaggatggtggatgtcaagggtagagggagaagggaatggggagttaatgtttaatggatatagagtctcaattaggaagactaaaaagttctgcagatggataatagtgatggttggagaacaatgtgaatacacagtagttaatactactgacctgtacactggaaaatactttaaatgggaaattttgttatgtgtattttagcataattttaaggagaaaaatttgtaaggaatttaatggttgtacattttatttcatttcatttttacctctgtgcttttgggctacttttctttttctctttctttttctttcttttttttgagacggagtctcgctctgtcacccaggctggagtgcagtggcacgatcttggctcactgcaacctctgcctcctgggttcaagcgattctcctgcctcagcctcccaagtagctgggattacaggtgtgtgccaccacacccagctaatttttgtattttcagtagagacagggtttcactgtgttggccaggttagtctcaaactcgcaacctcaagtgatcctcctaccttggcctcccaaagtactgggattacaggggtgagctaccttgcccagcccctacttttcttatgtataaataaccccaagtccttcatagataacaagtaaataattagtaagtgaactattttttccttggatgagaataaaaattttggcacaaaaagcagtgtaaaattgaccaaagttataaagcagtaagtgcagcaaatgactccaatctctctttctactcacaaataatttttttttttttttgtnnnnnnnnnnnnnnnnnnnngtgagcctcatggttcactacacagcaatgtttagtgtgggaaaagaataccatcgagtaatctatgaacacagaattccatgggtttgctataacatggtgaagcacattaaagagagactaccttgaagttagttgaaatcacttctttttttttttttttttttttgagacagagtctcactctgttgcccaggctggagtgcagtggcatgatcttggcttactgcaacctccgcctcccaggttcaagtgattctcgtgcctcagcctcccaagtagatgggactacaggcatgtaccacctacccagctaatttttgtatttttagcagagatggggtttcttcatgttggccagctggtcttgaactcctgacctcaagtgatctgccctccttggcctcccaaaatgctgggattacaggcatgagctactgtgctaggcgcacaaataactcttaaacagggcaatagttggtacattcctagttgatttctcctttacatttgtcaaacaagacttagtattcatagttctctatctgcaaaacatcctttacaaagatttgaaaagaaaagcaatcctttaaataattctttataacattccattagcctcaggcatatttttatagtcaattaaacacaggcttttctaatgggacattgattctcatttccatacacaattgcctccataagagcctgggtaatgccatctctggcacatgtccaataatccctgtcttcagggcagtggtactggtcaggaactttttctagactttaatcttaagcaaagccagtcatataattttaggtattggctttatctgctaggaaaaaaaaaaaaaagtcctagctacaatggtttaaattgatgagcctccattttctcatggcacaaacaggaggtagacagggcagttgttgatgttgatatagggtgttgaggcaagttccctgtgactttttaaaaaatcaatttgggggtacaagtgcagttgtgttacatggatatgtcgcttagtgctgaatacagggcttttagtgaaaccatcacccaaaatgtgtacattgtacccattagagaattccttgtccctcaccccactcctaccgtcccacctttccaagtctccaatgtctattattccactctttatgtccatgtgcacacatttagctctcgctttcaggcaagaacatgcagtatttgactttctcagttattttactgaagataatggcctccagtttcatctgtgttgctgcaaaagacataattttattcttttttatagctgagtagtattccatggggtgtgtgtgtgtatttatgtgtgttggtatatatgtatacacgcacataaattgtatatattataattatatataattatatacaacttatttccagctttatatttgtcaaacaagactttatagctgagtaatagtccactcagctataaacatatagtatatacatatatatatatacacacatacacacatggtatgcaatatgtgcataccatggaatactactatatgtatgtatatatatctgtatacacacacacgcgcaccatgggatactactcagctataaaaacaaataaaataggccgggtgcggtggctcacgcctgtaatcccactactttggaagactgagacgggtggatcacgaggtcaggagatggagaccatcctggccaacatggtgaaaccccttctctactaaaaatacaaaaattagctgggcatggtggccagctactcaggaggctgaggcaggagaatcactgaaacccgggaggcagaggatgcagtgagccaagaccgcgccactgcactccagcctgggtgacagagcaagactcggtctcaaaaaaataataaaaaagaataaaatgtatatatcccacatattcacatattctttatctaatcatccattggtagacacaaaggttgattttacaggactttgctattgtgaatggtgctgcaatgaacatacgagtgcaagtatcttttttgatataatgatttatttcctttgggaaatacctaaccagcggtatctaaccagtggtaggattgctgggtcaaaggtagttctatttttagttctttgagatatctccttacaattgtccttaaaggttatattaatttacgttcctactaacagtgtataagcatttccttttctctgcatcctcaccagcatctattatttttgacttctcatagtagccatttggattggtgtgagatggtatctaattgtggttttgatttgcatttctctgatgattagtgatgacgatcattttttcatatgcttcttggccatttgtgggtcttctttcacaaaatgtctgttcgtgtcctttgccttctttttaatggatttttttttttcttgttgagttgagttcctcataaatcctggatattagttctttgtcagatgcatagttgtgaatattttctcccattctatatggtacctggttcactctgttgattatctcttttgctatgcagaagctttttagtttacttaagtcccatttgtctattttttgacttgctgcatttgattttgaggtcttagtcgtgaattttttccctagttcaatgcccaaaagagtttttcttatggtttcttctagagttcatatgatttcaggtattacatttaagtctttaatctatcttgagttaatttttgtatatggtgagagttatgggtccagtttcattctccttcatctggctatcaaattttcctagcaccatttattgaataggatgtccttttctctgtgtttgtttttgttaactttgtcaaagattagttggctggaggaatgtggcttttcttgtgagttttctgttctgttccactgatatatgcatatatttctataccagtgccatgctgttttggttactatagccttgtagtataatttaaagttaggtgatatgatgcctccaactttgttctttttgcttaggattgctttagctatttgggctcccttttggttccgtatgaattttaggattgctttttctaattctgtgaaaaatgaggttgatattttaacaggaattgcagtgaatctttggcttttccctccaaagactgttgactgggttgccaaatttactttcaagccacaggcagcaagaaagtcagcacaacaaggctttcccagaagttccaccaaaccacatctccttacaccccactggccacttctatgtgcaaaaaaaggttgagaaatagtgctaagcacactaccagagaagtttgtctgttttgttttgcttttattttttgtattttggtttgggggtttgtttgtttgtttgttttcactaagaaagaaaggagaataaatacagagtaggcaatctgccttctttactccagggaagctcaggcattcctgaattccggcagtggtgagagataaggtacagagcctcaatagggcatgattaccacatggatgtgacagcagcaacctcaatgttaactcatcatcagatcacatcctttgtcctttttcttagagcatgtgatgccttctccttaccctttcttctcctttcttctcttttttaaaattgccaatgtattgtcttactcatacatgtcctagaaatgtgatgaggtttcaggaaattggggtactgaaaagtagatgggcagctctaatctattttagtccaatctatttcctgtggcaggaccttatgctggcaagaggattggcttgagttcaggcataacctggatactaattgtagaagagatagtgagctttaagtattatttatcaggtttctcttccataaaatgtgcaacatatctattgatatggatcagtatatttgtgaaagttcttgaaaaaaattaaaatatgatttaaatgctatatattacttttgataatttcaaattgcatttgcttttattttaattttgaaatgcaaaagcacatgtggcaagcacttggtcctctacatcaagagggaaaaaaccctgtaggtcagaattattctacagttgaatcactccctgttgaatttttcttttgatagatgcatctgcctttcttagtatggcaagtgagaatcatttttacttttcacaaagtagaaacaacttagaaaatttagaaaattcattataagcctcaagataaatgtgcttattatttgaagatatttcttaagtctttctgagattaacttttcatactaaaataatacctgagtcacttttcccttgctttatactttcctttgtatctcaggtaaggagctcaagataaatccttgagcaataatagtaatttgtctgtaattggcatatattacagagctgagtctgtctctgtctgtctctctctctgtctctgtctctccctgtatctgtctctctgtctctctcagagttttaaagacaggctctccctatgttgcccagggtggtctcgagctcctgagctcaagtgatcctcctggctcagcctctaaagtagctgagactacaggcatgcaccgccatgcctgactgccacagctctcttgattaaaacatttttttaggacataggattctttttggtggcattagaagtaagtaagattttcatgtgtgagctgccttaccttgttagggggttgagaagtgactaacctgaatattatatcaatagcaaaagcaaaaagagaagatgcatgataagaagctaaattctgagtttatcttgcctttaccactcgaagtagttaggttagtgttagacacattgactaattatatttcctattttagtgctgctttgtgaattttctcttttatgctggtcacttattgtagcattgggctcagaccaaagctctgcatttggctctgcgggcatcagtctctgaagggtgtgtcccagcagagggccaaatgcttctcagggcagctggggttttcagatggcaataggtcaaaattaaaaatagggatataaaatcttcttttaccctggctcatccagtttggcagaggctagtttcagaagagtctagaagtgacatttccactttcatgggttgatataagggtttgtcaagtgaggaatgctgttggacttggacatgccagtgacttaaatgtgaggttcattgcagcaggatggctgagtactgggtgcagcagcccctcaaaaccctctgtgttgtttgtgatccttccacatggctcaaaaagattgtgactgatccattgtcaagatttggatcatacttccaaatataaattcttagattctattttctttttctaaatcttcctgtctatggaaaaaaatcattctgatttgtcattagcatattttacatactcaggtttatgtccatgtcaaagtgtaatcttacacttcttgtaagtgactgtgaaccagggcaacatcccccaaaactctttcttggggcagaagaccctgatggctcctgaggcacagctgactaacagtttatcaagggaatcttgattgtctctctctgggtatcaggggtcagccaagaaaaggatgccagaatatgctgaaagctctagtactcttgattcaaaacctgaggattcctttcttcatgtaattaatacatggcagttattgtgaggcactagagagatacaaagacaaatataacacaatatacgcccttaagaaatgtatatttagtaggaggggacagataaataaacaaaagagtgccactaaatatccccaggactttgataagagtcagtcagggttgggggtaggggttgaggcttgagggatgggaagaaataaaaaacctcatggagggtgtgacccttgagctgaattttcagctgacagatgctggctgctgggcatgttggggaaaagcattcttgtagagtaaggcaagacagagaaacatgagactatattctgtttgggggacatgcaggatgacagaccagcatgaagacaggttttgtaaaagaggaaatcaaaaggccaaatgaggagagatggtagtgtcttaacttccatgaacattaaaaatttcaacttgtaagcagtagatggcaattaaaggtatttttttaaataaaagaatgaatggctctgaacatgccctagtgataactgattgtttgttgcttcttcctcctgtcctcaatttaaataaagcaagtaattatcgagcatgttgtaacataatttcctgtaaaagggaaatttatattccttttggaaaaccaataatgctctaactctttttgattaaaatgtccatattaagccgggcgcagtgactcacgcctgtaatcccaacactttgggaggccgaggcaggtggatcacgaggtcaggagatggagaccatcctggctaacaccgtgaaaccccgtctctactaaaaatacaaaaaattagccgggcatggtggcaggcgcctgtagtcccagctactcgggaggctgaggcaggagaatggcgtgaacccgggagatggagcttgcagtgagccgagatccagccactgcactccagcctgggcgaagagtgagactctgtctcaaaaaataaaataaaataaaataaaataaaataaaataaataaaatgtccatattaaattatgttttccctacttaggaatgcaggatacatgagggcactatattcatgtaccacttggtttaccagtatttgcttacttaatcatgatttcttaagcaatcatagaaaaccactagaaagagacataaactatttgaaaatgcactgtgcacatttttatcttgttcctgggcatgtgaccaagtgatttgtgttgacagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataaggtaacccacttctttcttgacaaagcatgcagcacaccaaaacctcacccctcagaaaggtcactaagaattcacagaagatctgagtcaaataggatgtgtaaagtgtaatattgcaccaagttgtttaccaaagtgttacttaacagagcaaaaatttggaaacaatctgtttaaacaataagaaaaatggtcaatgcgccagttgctctggctcaggcatttaatcctagcactttgggaagacaaggcgggtagactgctcgagcccagaagatggaggctgcagtgagctctgattgcttctttatactccagcctgggtgacagagtgagaccctgtctctttaaaaaaaaaaaaaaaaaagacagaaagataatggtaaataaataattcagataattcagtcagacaatgagtatatatggaagtggctctatgtacacatagccataaaaatgaagtccaggaagtttttgtagtaacataaagttttgttataatgttaattcaaagagcaccattgttacttcaccataacatagcaaagaagaagctgcaaattgtagccctttgctttatttcacaaacatgtttggggtcctgctccttgctcatccgtttttaagttctaggttacaaagagaaatgggaaacattgctgccttcgtgagttcattttaataacaaatttagagtagctattttatggagtagataggagaagttgttggcaattttgaaggaacttgtgaagactgttccctaaactcttcaaacacccatgctgtcatctttgatatgctcattattcatgaagaaaagactagagttttgtcaagcaaagtgaaagttcagccgacaattaaccagaaacttgttaatgaagttactgcctctccctgtatgtatcaaatttaggtttgctgaattgctcattaagattgacccaaaacacaagacaggtgtttctaaatcttcagataataggaaaccacacaaaagggccctcagattctgataacctcccctgtctggcatttagcttctcttctgcctgctgggtgtgggcatagctgtgatatttctcaggcctagctcagatattggagtagggttgcaaaatagcaatagtcttatgttgacaaataacaagtaatttaaatactttcaacacgtgtgcctgtgttttgaaatcacagagagtttgaatcctaagttggattcttcctgtgtcatttaggcaagttatattacctctctgagcctcagttttgtcctttagtacatggagatagcaatactgacttcttgagttgctttgaggatacactgagaaaacattcaacacttttaagtaagaaaaaatcgtttttttaattttggagtttttacagttttggaaaaaggttactccataacaatctgaattctcaaggttattatttaacaaattctatagaccaaaagacatatacaggagaccagggatatctttttttagttttagtattgtgaaaatcttttttggtcattacagagcaaacacatttttttaattttatttttttcttgttaaacattccttttaggagtgcatgtctcagcattaatgggaatcaaaaagcaatttcataatcgtcattatagttaagatttgtttgatcttttgaattttctatagttttatataccaatttagagaccagaattgtaatggcttgcctcaaaactcaatttgtctttatgacaaagaggaccttgtgtttcccaaattgaagcacatgctggtatcagagtgtattttctcttgtgagcccataatattgtatttcatcatttcttccagaaacaatgtagtactttcacaattggtttaaattgaatatttccagtaggtttgataccaaactgcagtgtgactgactttgtttcttcaaaatcctgcagccaactggtacaatatatgcccagccttgaattcatcttagcctcatagggtgattttaggctaaaaatatttagggcaaaaattttctcagtgcttgttttagtagagtggaaattaacaaaaggaattctaaagactcaaagacatatagcaaaccagggaaacctggaaatttctggccactttcctgagtaaatgatacacaagcagagatattcctaaaggaattctaaaagatcaactggctttccattagcatgttgaacttaaggaacttctgagaacttctaatacttttaacttctaacttctcattagaaactatctaataagaaggcatttgtaaatccttgcatcctttctccgttgtcgttttcagtataaagcactaaatatgccctgatgtgaaaacagaaaagcagcaaaactttttattattcaataaggaactgtctctcagtttttgtcagtttttcctgagctgccagtgttttaagcatcaattactcactgttccctcctcccttctcctgcctacctttccctcttctcacataacactacattttatttccttgctaaaaaataactattaaaaaagatttagctttcataatttatgttgaactaaacactttattgtttttactttcttttttcttactagtaaccagcactttcccagtacttttaaggaaaaatgatcatgaaccccaagttattgttgaggtgctagtgttcgatttgattcaattttgcttttgatgttcctattttcccatataggttttgcagaccccaatgcttatattttttatacaactgaaagaatattaaacagagatgttgctattttaatttgatgttttctctgtttcaaataaatacctttttttttttttttgagacagaatttcattcttgttgcccaggctggagtgcaatgatgcaatcttggctcactgcaacctccgcctccagggtgtaagcgattcttctgcctcagcctcccgagtagctgggattacaggcatgcaccaccactcccggctaattttgtatttttagtagagacagggtttctccatgtaggtcaggctggtctcaaactcccaacctcaggggatccgtccgccttggcctcccaaagtgctgggattatagacgtgagccactgtgcccggccctaagtgctatttttaaaatgagcaatgatcaaaatgccataaaagattaacaggtaacttctgaactcaaacagggctgtggttaccttcatattgttttttaaaatcttttgaattataaccaagaatataaaaataaaatgttatttatataatttatactgttctacctaagaaaaatgtttgattttttttctctgatttaatctatgagtgagtggattaaatgctagatgctagacactggttatataaaaatcaaagatacgatacttgcctcaacaagctcacagtggtttgaggaagacaagcaagaaaacagagtttaaatgcaggattatgatatttgtaatagaagtgagcacatagtaggtttgcacataaatgtaataacttggccctttattgaaacgagaagagagaaaggccagggaagcctgaagtgactccatcagtgagtgggtaagccagctgagcagcaggcacctagacatgggagcatgaggggacaacatgtgcccacaacacattctcagtctttgctgagagctactcagtaaggtaccctcagtgtcaaaagtttcaaacttagaataggtgaccatgacactcacaaaatgttgtggctgacaatattatttcctctgaaggagaacacggaacatggttctgtgatgaggtcagtgtttgggtggtgccaattttggctctggcttatttttcttgaatttcaagtgaatgcatcagtcctccttttcacatttccccctttattcagttcaagtgagcttcctccaaaattctataaacattattaaaaagtcccagcttgactctctctgcattccataattgctctgatggaatagcaacccctgaataaataatgtttcacatctagaagactctgtgctcttcctgaaactgcctttgattacctcctttcctctgacaaataggacaggctgatattttcattgcacagatgctagagggggagaaaagacttccaggattaagatattaacttctgtgctcataatggatgaaagcaaaaaatctgaaagtactaacaccaactcactttctcttaaatattataaaaaatgctttacaatttaaagaggttttttaaaaccggagtataatcttagtaattttttttcttggtcatgagagcaaccatgtgttctgcaaattctctaatagggttagtttcaaatactgtatcagtcttgttaaatccatacatcatctaaatgacctggaaattgtcatgatcttgcattcacattacatttcacaggcgatctttcctacccagagtgacatacagaaaatattcattagaccttgggaattaatatggagaaaatattatcagcatatgtcagtgttcactttgtaaacagatatcatttaaataatttttggtaaagctagtggcattggcaatatgttaaaactcttgcataattttgtaaaaaaaaaaaaaagtctaatttttgtagatgaacactgaaatgtatgggggtaaatgttatagtgtctagatttgtgttaatattgccacaaatgaatgaaaaggaaaagagggataggtgaaacacatataggaaaactttgataattgctaagtctgtgatgagtatacaaggctcactccatttcttacactttcgagtatgcctacaatttttcatgcagcctacagatagtcatgttgccacagtgctaagacagtataacatataatttttttttttgagacaggtttcattcaaccctgtcaccaaggctggagtgcaatggcgctatctcaactcactgcaacctccacctaccgagctcaaacaattctcctgccttagcctcccaagtagctgggactacaggtgcatgccactgcacctggctaatttttgtagagatgggaccttgccatgttggccaggctggtctcaaactcatgggctcatgtgatccacctgcctcagcctcccaagcatataaatttattccataggttttttctaacatagaaattctcggcttaccatcttagaattcacaaatggtttctcaaacatggctatgtgtgtgacattccttcctgtacgatgactgtgccctttgaatcttttgcagagcggcctgaccccactccatttggctgctcaagaagatcgagtgaatgtggcagaagtcctcgtaaaccaaggggctcatgtggacgcccagacaaaggtatacggccctcccttgccacacggaaaagaatgtgtccatttggtgactgcagtaaggaagaaactataattgtatcaggagaacaaaccctttaatcatctcttttctacgtagtattttaaatgtttatttatgcaagggacactaaagtctccggttgccgtattccagggacttttgtctttaacggcctgggtacttgattctagctgcacagtaatttccccctatattaacactgttgagcctccttacaacaaatgtgtccttcggggcagagtgtgaaagcttgtacctttcttagtttttgtgatggatgttttaaatgcagacaaatagacaaatagaaaaacttgtaatttgtgacctctacgttcgttcagcatgatttatgaaacaggataaattaaggcttatttaaatattactcacttgctaaattcctaatggtctgtgcggtcatgcgtgtgttctccctctctcagacgagaaagctctcatttcaaaaagaaaaaaaaattgctaattaatcttatataatgccacaactcaaacacacacacaaaataggacttctcatgtcatcatcaaagatatagcttcacattaatcacatttctttgaaaattttctttatatgcttaattttgttatttcttcatatcagatttgtgtcatttgtgtcatctactctaacatgttttttttttggtttttttttttttttttttgagacggagtctcactctgttaccaggctggagtgcagtggcttgacctcggctcactgcaacctccacctcccacgttcaagcaattctcctgcctcagcctcccgagtagctgggactacaggcatgtgccaccatgcccaactaatttttgtatttttagtggagacggggtttcaccatgttagccaggatggtcttgatctcttcaccttgtgatccacatgcctcggcctcccaaagtgctgggattacaggcgtgagcccccgcacccagccacatatgctttctttctatatgccatgtttgacatgaaaaagaatgactactaaatattgtgaataaaatttttatatgtaatataggcaggttctgaggtatatgggcatattgaagtaactagtaatacagaaatattaccccaaattagccagataaaagggtattgacaccaaaatgagactgaatttagcttattttcttatgctgcttgaatactttcatcgggaaataattcttgactttggaaatttgcaactttatggtaaatgtcttcattccataccgctttattcacacacagagagagagagagacagacttaaacactttcttaggttctctctcctttttatagatataaaactctagaaggcaaggtctgggtcaagtttctcaacatttttctgccccagcacatccaagccatgccctaaaattcagccagggagtatggtgaggattcttaaggccaggtcggggaggagagaaacaagtactgtgctgcctccatctgttttccatttgcacacacagcccctcgatgtacgagtctcaggactccaccacagtttccttctaacccagcccaactcaggtcccagttggtagtctttttttttttttttcctccaagagggagtctcactctgtcactcaagctggaatgtaatggcttgctgcaacctccacctcccggattcaagcaatcccacctcagcctcctgagtagctgggactacaggcacatgccaccacacccagctaatttttgtatttttagcagaggcagggtatcgccatgttggccaggctgatctcaagctcctgacctcaggtgatccatctgccttggcctcccaaaatgctgggattacaggcatgagccaccgttcccggccacgtagtcatttttgtaccccgtatgatatctggcagcatgtaacctttcctgccctttacaaacggagcagagcgtctcacttcagaaagcatctctctgtcctttacaagttattttcctttcctttctcttctctgcaaaggtcacagccaccaaaaggaagtgaagccatgattgtcccataactagagcacagcagaagtgcagatagctgggttgcttgcatttgctgcttaattttgtgaataaggaatttgttgtatcccaggaatgttcacattctcactggtaaagaagacatccccaagcagcccacaggtgggatgtataccattcaactcattggcttacatgcaaaaataattaataataataaaaatatcaagacctcttctccctgatgaggagaagactagaaaatcctggtaacagcctttgcagtcctctccccccgcacccctccagtttgctgaccctttataccccaccccccttttgcatttgaagttcaccaaatgagtttaagctaaattgtgccacagggtataataatcagtgttgtttgatagagatgaagccactgcttttgcttttcagaaggataatgtccggaagcattttatttagaccacccctgaaaggcattgattcttagaggacactaattagggatcaggagttacactggatttctttaaatgtgtgtaaaagcataaaaagctttgagaacttatgtgatacttacctatttcacatttatgtgtagatttcctgctggtcaccaaattcttacctgggagatatattccttgccctcatagaattcatagtttagagagcaaaactcatagtattataataacaaagtcatcatcataataaaataaaacaatgtattacccattttctctatgccgggtactattctaagtgcttttcatttattattttgtttaattcttacaactaccctatgaggctggtaaaattagcatcctcgtcttacagatgaggaaactgaggcacagaaaaagtaattacttgcataaggtcccaaagctaattattacaaagcctgattttaaccacaggtctatatctagaaatatatatataattttagagtattcggtaataactaagatttttgacaaaggtgggtaggatagaggaagcttgttcaatatcatgggaacatgtgaagaaaaatggggattatgtcttaagatgttgctagaaaattaagatctcagagggccttaatgtaccaggctaagctgtccagctttttatcctgtttgcactgagaagccactgaaggttttaaacacaaacgtgataagatcaacaatctggtttacaaagatcctgggaagcaatgcgaagaataagttgattttaaaccttgcagcagggtcagttaggctattgtgaaatccaaatgaagaataaagaaggcctgaactaagtggcagatgagacactgagaacaagagagaaattagagagataattaaaagacatacaaacagctaagatttgaagacttttgggaggccgcggcggccagatcacgaggtcaagagatcgagaccatcctggctaacacggcgaaaccccgtctctactaaaacaatacaaagaaattagctgggcatggtggcgggtgcctgtagtcccagctactcgggaggctgaggcagaagaatggtgtgaacccaggaagcagagctcgcagtgagccgaggtcgcaccactgcactccagcctgggcgacagagcgagactccatctcaaacaaaaaaaaaaaaaaaaaagatttgaagaccatgtgtggtatggggactaaggagaagcaggaaattcaggaggaaactaaggatctgacctgtgcaactgggtgatcacaagtaccattcaatgagacagggaataaaggagagacaaagccagctggggaaagaggactatgagtttcctattgggtgtgttgaattgtagattactgggggccaatcaagtaggaaaacccaagaaatgactcacatattgatctggacacagaaaggatggctggactaaagatgcagatttcggaatcatcacagtcaaggtattagctgacactgtgaaagtagatatgatcctcaaggaaaagtgtggcgcaaaccaaagacaaaaccctcgggatccactccattttacagtggatggaggaggcaaaggagggctgtccaaaggtagaggagaaatcaggaaagaatatgatagggctgtcaaattatgaaaaactgtcaaggtgtttcagataagagaagctcaaagtccatgcatgccatgcatggctgggcacttgggatattaaaaagcagttttactagagcagtggagatggtgaaatgtagggaggatgagctggaacagtgaatgaagattatttttttttccaagaagtttagttttcaaaggatagaaacctagagaaaaggagaaatatttgaaaggagtgctttttgtttctaagatggaaacataaaaatatgtctataagctgagatgagcatgccagaggaaagaaaaatggttagcaaaattacttggttttttttgtttgtttgtttttgtttattttatttatttatttattttttgagacgaagtttcgctcttgtcactcaggctggagtgcagttgtgtgatcttggctcactgcaacctctacctcccggattcaggcgattctcctgcctcagcttcccaagtagctgggattacaggcaccgccacgcctggctaattttttgtatttttagtagagacagggttttgccatactgggcaggctgatctcgagctcctgacctcgggtgatccgccggcctcggcctccaaaagtgctgggattacagacatgagctactgtgcctggcctggttagcaaaattataaggggtatcagaagcggaataggctgagccagagttagaaatgacaatttctttttctttctggtttttttttctttcttttttttttttttttgggagacagagtctctcactctgttgcccaggctggagtacatgggcatgatcatggctcactgcagcatcagcttcccaggttcaagtgatcctgccacctcagcctcctgagtagctgggactacagacacatgccaccacgcccggctaattgttttttgtttttttttgttttttttttttttttgtatttttagcagagacagggtttttgccatgttgaccaggctggtcttgaactcctggcctcaagtgatctgcccgcctcagcctcccaaagtgctgggagtacaggcgtgagccaccacacccggcctgatcttttcctattttcagtcattaatttaccaaagatttaaaatatttattgagcactgatgatatgccaggcactgttttcagcacgaggtaataatagctaaccctatgtgtcagacactgttgaaataattgttaacagttaatccttatgacaacacaatgactttggtactgctactaaagtccattttataatgcataagccaatgtacagagaggttcaataacttatccaaattcacacagatagtaagtagcagagctgggtcccaaacccagtctgcctctgaggcccgggctcctggctgctgagcccctccttcccccgttctcatcagtcagaagtgcagtcttatcagtgaatggatgtaaacatctactacttggtaatcaagagaggaaaaaaggaaggaatgctgttaaagactcggatgcattttgcagggttttgctgagctctatccagtgttgcccaaaggaaggaaggaaaaacctaatcagcttgtaatgatgttatcagtgaggcagctatgacaaagaggtagaggctgctctgttccctgggctatggctctttatttgtttgcttatttagctactcaagaaaaaaatagggagtctttgaaaaatttgttactgctgattggaaagaattgctcatgtcccacctctctgagcgtatttatgcgaggtgctattttgtatgggaatgctgttaaccccgatgaatggaggagcccacatctgatttctctgaatgcaagttcaatcttcttggccatgcccatgtatttttgaaaaaacactttagtgtttgtgtaacagcaggaagaccagtgtcctggagcacagcgaccaagggagagaattgtgggaagactaaaagatgtatggatgggggatgaggaggataggggagactagaattagacagctcctaacactgtattataatgacttagggttttaataagaatgagatgggaaactatgaggatgaatagaacctgtgcattaacatatttaggccaggcatggtggttcacacttgtaatcccagcactttgggaggccaaggcaggaagatcacttgagcccaggagtttgagaccagcctaggcaacatagtgagacctcatccctacaaaaaatagaaaaattagccaggcgtggtggtgcatgcctgtagtcacagctacttgagatagattgagcccaggaggggaggctgcagtgagccatgatcccatcactgcaccccagcctggtgacagagcaagaccctgtctcaaataaataaataaacaaccctgtctcaactatatatacctaatcaacacatccatctcaacaactattagaaatggttgtattataacttaggcaaattgactaaaatctcaaagaattttttaatatttagatttttaaaaaatattgggtccacgtggttttgacttgtaaggggaagttctttgaacttggaaataatgttacttcaatcagttaaaccattgtactgagcactgattggacacattattttcaagcttcccttattaagcagtattctgatcatgggtgcagtatctgagttcctctgtattgaaaaggagaaccctgcaaagcaggcaaatggattctggtcaccaaaaaggaatatcttccatcgtgtattcagtagcgttagaggttgtaagtcagtttcctatatgtggttatggtgagctttccagggacagtctggtcagtgtgggtgcactgacagtgtgtttagtgagacaaagtctaccaagagtcaccgctctagggcagcacatccctggtaaggtatcttcaccttctgcagtcaactgtggtttgggcatctctttttcaaattcaaatgtattcatttgctggggtcaccataaagactctagtgccatcatataagatacagacccttgaaaatatggatcacccacccccattcctgtttagaaatattgtgataaaaggtcaatgttctccctttcagagatctggtactgcctgtgtcattatgaacaggggctctgaaattgcggggtagtatgttataatgaacacagccatctagagaaggatctggaatatccttattttaaagaaaataattatctagattgtatacacatacatacacacacatatacacacacagagaacttatagcccctcaggggtcagtggatactaatttgagaaacaaaccatttcttgtctaaatcagtgaatcagtggttttcaaactctgggactctaggtaggaaggcaaaagactaacttgatataccttgttcaagttcatacttctcagaccacctgagctctcaccagcctccctcttccttttagtgtttctgtgcttcttcctatctctatcaggcattctgataatcacctcctgccatgtgttattatttagccacttcatttttgcctagatttaaagctttcagaaagtattcaataaacaagtcaagtctccataaagtgctcttctgaccccgaataagaagccactgaatcagtttgtctatgctgtcagttgttccatctttcctttgtatcttgaaaagttctaagaacaagatgacctgataaaaaataaagcactttggggagctaacaattttatgggcagtggtattttaatttatacctaagtcttatgctgagaattatcaagggcaatttttttaatatagagaagaaaaaaacctacttttgccagctcaaaaagaaaggttaaataatgattttgcttctgtttaggatagctgttagtaaaagtgtaattatgatgcttcttttttaaaaaaataataattacagatgggatacacaccactgcatgtgggctgccactatggaaatatcaagattgttaatttcctgctccagcattctgcaaaagttaatgccaaaacaaaggtaagctccttccttttttgtttctgccagaatcatttatttttgcttcaaaggaattaagaatcatctcttccatcttccttctacagaatgggtatacgccattacatcaagcagcacagcaggggcatacgcatataataaatgtcttacttcagaacaacgcctcccccaatgaactcactgtggtaagcgctcagggccagctcaggagaagagggaggagatagatgggcctggactctggtgtcttcttacgtttttcattgtactttcatgaagaggcataaacagagcattcagtagaatgaggaaagaaggacaataaccatattgttctgagctgttcagagagagagagatgattagtgttttatatgtgaaaactacctactgcattgtcacctagtaggaagtacacatgtaagaaaaaaaaattgtgttggtttcattgattgcttacttagaacgttaaaaagcctcttggattgcatgtgtagctgcccagactttgctgtacaaacaggttaggtgggttttgtgcaaggtatgtctctaatgaaacacttatttgtgtatgacagtgggatgggtctgatgagacactcaccttacattttgtatcagcaaaaaaaatgtggaataaggcttgctaattcctcactcacattttccttttgccagaatgggaatactgcccttggcattgcccggcgcctcggctacatctcagtagtggacaccctgaagatagtgaccgaagagaccatgaccacaactgtaagtaaggaatgcagaaccttgttaccctaggagccagctttcagccagttttcttgggtttttctgagatgaatattttttcccattcataaactaagcaccatgttttaaaatacagtcacctcattgttggtagtcaggatagcaaaactcttattgctaatatgaataaaagtttaaaacactaagaatacctatttaaaagatgcatctgtagctatagagtttttacttccatatacagctaaatgtatttatttatttgtttgctttgatataacaagttcttaatgaaatgatggtgaaggcagaaattttttaacatccttccttggcagcgtaaagaaaattgaaaactctaagttggttccttaaaaatgttttaatgcacaaatggtacatggatacattatcattcctgtaaaaaaatgtttacattgttttaaaaaattccagatgggatcagaactggttttgcctgctactgtcactcatcttctgtcctattggagttttcataagaaacacaataggctgttttgttaaaatttaaagtggatctttaccaggaggccctattgcatcaactacatttttacaagctgcagcctctaggataagtcatttctttccaaccccatctggtacctttgaacagcattaacatttggtaactttggaattaaaagcaaatattacatgatatcagaggcttatttgagttattcctgactccatgactcaacacatagacctgaggttgactcttaacaaagtaaatataggactctggaacattttgaattatcagctctgtccccttttctcttcgaccaccttccaacatgaaggagaaaatggttagcatctgcaaattagtttgtatacccactgctttttgtgaaaaacatgggttgaaggtctctgtaactacctgcagtttgagttatctggcagtgttactcaatgtataattcttagtctttagaaactaaaaaacaagcctgctgattacgggagaaaaattttgtaatttgcaaaagagaaaacagttgttttaatggaatagaacaatgattgtcaagcagcacccattccgaacttcaagttatactttgtctaagagagaaatttccacatgttgctttcatacacctcttgaggattttattatattaaaatctatcattaagttctcaaaaaaagtgttcaaaccaataatgtttattacctttaattttatatcccatgtagctctatctaggataggaaaggagaagagaacaaactatttaacgatagccaagtgtcacaatgctataaagatttgaagtcattgcagtaaatatataatattaatacttctatttcaatgttaaaagacttgagacatgtaaaagttcaaaatacacatcttatttggttgaatgtaaatggctttctcacccattacaaaatttcaaaacttttcttcaaaatcaaaaaaaagctttaagagaaagtagagttaagaacaaaattaagttacaacttcaaaaaatcaactgaaagacagagaagggtctcagagctccatcaggttcccatcagaagacagaatgtgtacaggaatagtgccttttcactctcaacatcatcagctgtccttgttgatgactttctgcaaaagagagaagacactatgcatgctaattggaaaggtccagtttgcctagtgaagaaaatgaggcttccaccaaaagaagtgttcacgttgattaaaaaagagtccagagaagtctctaaaacttcgcccagcattgtggtatttggtacattatctcaagctgagacaccaccttgtcagccttgctttagcggttacatgtaaactagcttagacaggactgatgtaattcagggtggagtctatgactttaagctaataactatagctcagcctccaccacaggcatgatatttgtatagctagttactgggactccagcagccattgactctataaacagacttcagtttttcaaaacaaaaagagaatgtcttttccatgtgagtaaaatacatgatgtggcaatgctgagaaagacggtttagttaattagattacaatcaaaacagcataccaaactgaatggatagaagctgatattcaaaagatgtgaattgttatctatcaaaactgcattgtttaaaatacccaattacttcatatgtaaggagcagaacacctctagcacacagatattggttgctaatactattttctactaaaagcaaacagtgctccttggagaaatggctgaatctaaggatagcacagtaaatatataagatgagcctggaacatcttagagtgtcaaaaagtaaggaaatgctcctccctcccccaacaaaagtaaataaactaatacagaggcacaatggtagggggtatgttgaagggacatatgaattaactaaaagagttcccaatggccatagctggaacaatttgagcaaaaataaataaatataatagtcttgaagtatagtgcaaactgtaaaataactatccatgaattcatactattatacataagtaattcaataaatggaaaagaagacacaaatttctcaggcaaaagaattccaaataatgtatgaaaatacttcactctcgaagtggaacataattccccactgcttacatgtgggctgaacatagtgattcctttgcaaagaaaacagtatggaagcagggggaaatagagtaactttacaatggagaaacctgacaaatactgcttcagacatatgatcaagatcaacatcaacaatgataagtcatgttgatggtattgtacccttgatacaatgtgatgaaatggcacttttcctctgtgatcttcctccgtaaaacatacagccccagtctattaaaaaaaaaaaaaaaaaaaaaaaactatgagacaagccccagttgatggacatatctgactagtatactgcaaaactgtcaaggtcatcaaaaacaaggaaagtcaaatgcaaatcaagaccacaatgagataccctctcataccagtcagaatggcaattattacaaagtcaaaaaacaacggatgctggcaaggctgtggaaaaataggaatgcttttacactgttggtgggcatgtaaattagttcaaccatcatataagacagtgtggcaattcctcaaagacctagacccagaaatatcagttgacccagcagtcccattactgagtatatacccaaaggaatgtaagttattctgttacaaagatacatgcatgtgtatgttcattgcagcactatccacaatagcaaagatgtgaaatcaacccaaatgcccatcaatgatagactggataaagaaaatgtggtacatatacaccatggaatactgtgcagtcataaaaaaggaatgatatcatgtcctttgcagggacatggatggagctggaagctgttatcctcagcaaactaacggaggaacagaaaaccaaacaccacatgttctcacttacaagtgggagctgaacaataagaccacgtggacacagggaggggaaggacacacactggggcctgggggtggggagggagaacatcaggataaatagctcatgcatgcgaggcttaatacctaggtgatgggttcataggtgcagtaaaccaccatggcacacatttgtttacctatgtaacaaacctgcatgtcctgcacatttaacctggaacttaaattaatttttttaaaaaaacaaggaaagtctgagaaattgtcacagcccagaggaacctaaggagacacaactaaatgtcatacagtatcctcgatgggatcctgaaacattaaaaggccattaagcagaaactaaagaaaaatgaataaaatataaactttaataataatgtatcaatgttgattcattaattgtgatattttccatgctaataaaagattttaataataggccaggcgcggtggctcatgcctgtattcccagcactttgggaggctgaggcaggtggatcacctgaggttgggagttcgaggccagcctggccaacgtggtgaaaacctgtctctactaaaaatacaaaaattagctgggcgtggccatgcacgtctgtaatcccagctactggggaggctgaggcaagagaatcgcttgaacctgggaggcagaggttgcagcaagccgagattgtgccactgcactccagcctgggaaacagagcgagacttggtctcaaataataataatactatcaatgaagattttaataataaggggaacttggtgtggggtatatgggaactgtctatactatcttcacaattattctataaatctcaacctcttctaaaaataaaagtttatttttaaaactgctccattgcagtattacatgctggaaaagacatcaaataatggttgatttcaacacaataattggggataggggtagaaatcacatttaccaagtattatctctaagaaactatgaatttgtacctttttttagttttaacaacctggctttttttcagttgtctcatttaaacgtgtatcttcccttgtaccattagtgtctcatatgctgagaattaaaaaaacaaaacaaaacaaaaaaaaaactcacttttaaactaaggtcattaagattttcttaccagtgatgctaacagtgtcttttggatggatataatctaagattttcttaccagtgatgctgacagtgtcttttgggtgggtataatctaagttatcaaagagaaagtaaaagaggcagtaggcatttgctgcataatatactgttctttaaattttgggggaggctaaaatgatctgccaatgcatcaccttttaagtattttttcatacacaatattgtaaagattattgttgtaaatattattttaatattttgttttatcctatgaattaaaagtacatataagaggagaacacaaaatagacggaaagcttggcacaagtaatagagacatatttcttgcagctcatttggcttctcttcagccgagacctttcgtggaatggggcggcagattcatcagaccatgaaaaagtatagcagtggagtaggaggggcagaatcttctcttttcctttgaaaagctttattagagacctaaatcttttaagctgtggtactttgccactagaattctttcattttgtactcctgtgctttgtatatggtgacaacctttgtgacactaagggacaacaattttgatgttattttatatgtgggagattcaagatattcaacacatacattccacaagaaactgattaattcagagataaatgaaaagacccattaaaatgtacagtctgctcacactaaaatgactgcttttttgttactagactgtcacagagaagcacaaaatgaatgttccagaaacgatgaatgaagttcttgatatgtctgatgatgaaggtatgaaaatgttctttgagttcacaataattataagtgactgtgtattttgtttgtttcctgaagaaagtccattgcaaaaatgtttatcaggaatattgaaacgttttgttgtaatatcaagagtatgtatttttcatccacttatattgttcacttcaatcatgcagttcgtaaagccaatgcccctgaaatgctcagtgatggcgaatatatctcagatgttgaagaaggtatttgtaaatttttattgtgatgaaacttaactactaccaactttatctttcatttcttatctttgaaatataatatttccttgagttactaacttttcatattatcttgagattattaatttgtgtattatttaaataatgtatatctggtactactagctctcctttttaagtctctttgaatcctctttccttgaacctgtttcctaactttaaaatataaaagtgtcactaattatctggattacttgccttctctttgtttctatcgaacagaatactgatgcttttattgtttgcatctgaaatctagaaagggaaaactggttaatgtttatgattacaatattttttaaaacaagcgaagtttccttataggaaatccttttaaatgccctgagatttgcccattctgctaaactttgtagaaaaagcagcttttgatcttgaaatgataatgaaaacaacctgaaaaaaaaaacttttgaaatagaaattttcaataatgatttaatgaaagagatcaaaatattattgtagctatactttatgtgttttcagaaattggtttctgttttgcttaaaaaccaatactttgaccaggtcatgatatacagatatatcaatgaatggcatctttaaaaggtccattggaaaacaagcatttttatagtgagtaaatattgtactgatgacacattttggagtgtcactgtaataacaaaatatttaccatgggaaaattatatttaactgtttttcttgcatcatttgactctcccaaatgatgggagatcatcaaatacagtctaccctattatgacctccatttgccacctgtcatgtagtagctttcttttggttagtcttagtgttgctagtctttttttgcctttaagtaatcttccctattttaattcatatgatttctttctttgagttgcatgcatttcattgggaacctaaatagtggaaaagcttgcctagtctgaagccactttaatcttttcgttatccaatcaatgacttcccactataatgcattgtggccagggactgcacaccccagtgagctaatgtcctgctggtcatttagggacctcggaggatctggctgaatgtttgtaaatgctgttttgataaatgctaaaggcttttactcagttttctttctttttctctgaaacatctgctatacatttacctcccttctatccccaaatggataatatttgttatcgtctttaggacttttagaataatatacctactgtcatattatatttcattgccttctcatacatttcagagtaacttctgtgcagaagataaaagaaaaaatgatattcttacatagatgtttacacacacaaaacatgatgtcaaaagtatgtttgtcaaatgaaattattaggaatcatggtatgacaatcatagacctaaaaatttactgttcattaacgaaatatctaaaattatccccattgatgagaggccaagtttgaatggactaacagccttatacatatggataaccaaataatttcaaaaatggagattttgaatctcgaaatttgaatttaattgacctcgttacttaactagaaatgtgtttatctcagcttgggaatttgaaattggcaattttaaattctcattttatgcatcttttctttaaaatctttggcccttactttaatgtgtccagggctattggaatcaaatggcttttaattttgtggtattgccgaatttaatgttgaaaaggattccttaaaggtcactcagtctgagcaaacatctgctggaatctcatctgcttaggatctcctgtgcccaagcccttcaaataatgagaattctttaattcctaagctgcatagtccatttggacaattctgtctttaaaaatccttcatgttattgaacttcctgtagcatctactcattgattcaagctttggtgtatttgaccaagttgatgggaagactacattctatgtagtattttgaacaaaagctgccttttctgtgtgacaatctttcagatatttaaaaatgctttttctatttctttttagttttttttttttttcaggtatatcattgctacctccttctattgttcccctcagcaacctggtcgccctctcctgtgcatgtttcaatatgtctgtgccatctcaagttgaggtgaccagaactgaacacaatatttttagtctcgtcaaagcagagtatagcaggactattgcattctccatggaagatgttaaaagtctatttttgaagattaaggttataatacacttttaattcaagtcatattagtattactgtctgctaaggtccctaaattttgcttacaagagctctagtaagccacatttgccctattatgtatttatgttgtcctctgctgcataaattagcatttctaactactgcaaatcccaaaacaaatcattttgaaatttggattctaaaaggacccctacaacttgaatgataattttaacttctgactcatttgcctgatagtcttgccagagctttgattgtcattttagttagatttagtgttggccatttgagtaagctcctatgcagctgtggcaaatgttcatttccatgaagccataggcatgttgtgagtataactatctacaagaactagtgagagatcatcacattggtatccccagacactaaagaataacagcagcttttaaaagcaaataaaaataataagcaatataggctgccagtttgtctcaagaaagaaaatgaaaatgagtttgtaataagggaaaataaaattttaatctgattctaaaaataatctgctgtaagtagatatttaaaatttaaaataaataagataaaaaattaaaaagcaaaagtaaaataaatattaaggaagaaatgtcaagagtagtctctctcttctttttcattctcttttcctttttcttctttgctttctccttatcgtcttctctttcttttgtacactatgagaaactagtgcaagtgaaagaatgtttggattcatttctcaaaaaaataaaaattaaggaatacaagactagacaatgttatcatttaataaggtgggagaacaatggggccaagttgcaaagttgaacacaggtggaagcatcagcaaagcagagccgtagaagaagtcaagcaactttgtccaaggcagggttttaagctcacattaggcaggtgggggctaagcagagctcctcagagggtcagatgcatttgtagataccttactgctctactgtctcctgttccagaaaatacctatgcatataacattcataaaactttaatatacgtacaaaactagtatcttgattgtagtgctagtttgattcttatgttttgcaattcatattttgtaattgaaaatatgaaagagtgtgtgtatagaagaaagaagagagaaggaaggaaggaaggaagaagaaagagaaaggagagaaagaaaaagagggaaaattgagattaaggttcaagtgattgagtttggcgtctcctcccaagggattttacattggctttggttcaactctgatcttaaattgcaactgcctataaaatgtattttataaattggggcaggggggtataaaatgttattttagcttgtagaattctagtggattggagtgtagttacagatcgaaagaactatagatgggagataatgagaagtggaattaagccatgcaaagtaaaaatctaagaggcagctctatgaaatatgactctactgaacaggtttaggagacagcagctggtgaggcaaactcctgctaggaagaattttctaattctaagctactttcaaatttgatagggctgaaaaatatctctctgaatcaaatgcagacattaaatattaaaagaaaaataagaggctaagtatacatgtaaaaataatatcaagtaggtataagtttgagatataataaagcaataaaattttagcagataatagagtgacatgagggataagaagaatcatgttcagcttcgtgccaaatttggtggccagtggaagccacagtaaattaaaatccaccgatttcaaagaactgaatgggcaagttggagtcttgtaagtctattcctgccattacactgatgaggtaggaaagcccaaatacacattgaatggtctttccaatgaggtttgtggcagagctggacaagaagactggtctgacactctgtagttttagatcatttcattcccctgcccccaaagtctagtcaagtaaagcactgggagtagagaaggaacacatagatctgtaactggttgtgatcaattacttgcaaacaacactgcatagatcatctctttcattgctattccaacttgaaatgtttcttatatatagaacccaagaatgcatatttttagcttcaaaaaaaggaggtgtgttaaggaaaaggaacaaatcatgttcttggaaactatcacaaggtaataagaatattttaatttgtaataatggatacataataattgtacatatttatggggtatatgtgatattttgatacaattatacaatgtgtaatgatcaaatcagagtaattgggatatctatcacctcaagcattgatcatttctgtgtgtttggaacattctggttccacccttttaattcttttgaaatatattgttaactataaattattgttaactataaattattgttaactatagttgccctattgtgctaccagatattagatcttattccttctagctaactgtatttttgtgccaattaaccatcccctctttatccccgctctttccagcctcctgaaaccatcattctactttctatctccatgagttcaattttttttttcagttcccacatatgagtgagaacgtgctaaatttatctttctgtgcctagcttacctcacttaagataatgtctccaattccatccatgtttttgcaaaaaacacagaatttcattcttttctgtggctgaataatatttcattatgtgtatgtaccatattttctttatccattcatcagctgatggacacataggttgattccatatcttggctactgtgaatagtgctgcaataaacaagggtgtgcagatgtcactttgaaatactgattttcttttttttatttggatgtatgcccagcagtgggatttctggatcatatggtattctattcttagttttttgaggaacctccatactcttctctatagtaactgtactaatttacatttctaccccatagcatatgagggttctcctttctccattttctgttagcacatagaaatgatactgatttttatatgttgattttgtatcttgaattttactaaatttgtttatcagttctgataggtttttggagggatccttatgtttttctaaatagaagattttatcatctgcaaataaggataatttaactacttcttttctaatttggatgtcctttatttctttctcatgtctaattgctctggctagggcttctagtactatgttgaatgaaggtgatgaaagtgggtgtcctggtcttgctccagatcttagaggaaaggctttcagtttttccccattgggtatgatactagctgtgggcctgttgtttacagcttttattgtattgaggtatgttcattctatactacttttttgaccattaaagtatattgaattttattgaatgctttttcagcattaattaaatgatcatatggatttgtcctttattctttggatatgatgtatcacattgattcatttgcatatgttgaaccatccttgcatccctgggtgatgaatcccacttgatcatgttgaatgatctttctactatgttgttatatatggtttgctagtattcgaagattttttgcatttgtgttcatcagaaatattggcctctagtttccttttgtgtgtgtgtgtctttgtctggttttggtatcatggtaacactggcctcatagaatgagtttggaagtgttccctcaaatttttggaataatataagtaggattaatagtagttcttttttaaagtgcttggtagatttcagcagtaaagccatcaggtcctgggattttctttaatgggtgactttttattactacttatatcttgttattcattagtagtctattaaagttttctatttcttcatgattcaatctttgtaggctttatgtgtctaataatttatccatttctgacaggtttcccaatttattggcatatagtagttgctcataatagtctctaatgagcctttgaatttttgcactatcagttgtaatgtctccgttttcatccctgatcttatttatttgggtcttctcttttttagttagtctggttaaaagcttattgattaccttttcaaaaaccaactttttgtcttgttgatcttttgtagtatatttttagtctcaatttttcctactctgatgtttattatttattttcttctataaattttgagtttggcttacttttgcttttctaattctataagctgcctcattcagttgtttattcaaagtttccctgcttttttgatgtaggcatttattgctattaactgctcttttagtactacttttgctgtctcccgtaggttttagtgtgttgtgttcccattttcttttgtttcaagaaattttaaaaattttctttttaatttattcgttgacataatggtcgttcaggagcatattgtttaatttccatgtgtttgcatagtttccaaggtttctcttgctattgatttctagttttattccatcgtggtcagaaaagagacttgacatgattgcaatttttttttaaattttttgagacttgttttgtagtctaacatgtggtctatccttgagaatattccatgtgctaaggaaataatgtgtattttacaggtgttggatagaatgttctgtgcatgtctattagggtcatttggtctatggtagattaagtccagtgtttctttgttgattttctttctagatgatctgtccaatgctgaaaatggggtgttaatgtccccacctattgtattggggtctatctctctctttacctctaataattgctttatatatacgggtgctccagcatttggtgtgtatatatttataatttatatatccccttgctgaattaattcctttatcattatataatgaccttctttgtctctttttgcagtttttatcttgaaatctatttcatctaagtatagctattcctgttccttttttggcctctatttgcatggaatatcctttattttagcctgtatgtgtctttataggtaaagtgagtttcttatagacagcatatcgttcagtcttgtttttaaatccatttggccactctatgtcttttgattagagaatttagtccatttaaattcagcattatcattgctaggtaagaacttactatgccattttgttatttgttttctgattgttttgtttgtcctctcttcctttcttccttcttgtctttctttgtataaaagtgatttttttttattggctgggcacggtggctcatgcctataatcccaaaactttgggaagctgaagcaggtggatcacttgaggccaggagttcaagaccagcctgggcaacatggtgaaaccccatctctactaaaaatacaaaaattagctgggcatggtggcatgcatctgtagtcccagctacccaggaggctgagttgggagaattgcttgaacctggaaggcggagattgcagtgagccaagatagcaccattgctctccagcgtgggtgacagaatgagattctgtctcaaaaaaaagaaaaaaagtgctttctcttgtagtatgtttaatttcttgcttttaatattttgtatatctattataggtttttgtgcttaccataagacttgcaaataacatcttataatcaattattttaaactggtgacaatttcgttctgattgcaaagaaaagaaaaacaggcaaaaagaaaatgaaatattccacactttaacttcatcctccccactttttgacttttgttgcctctatttacatctttttatactatctatctcaaaagttgctctagttattatttttgataggtttctctttttgtcttcctacaaaggtatgagtggtttgtacaccacaattacagtgttagggtagtctgtatttgtctgtgtacttacatttaccagtgagttgtatgcatttaaatgatttcttgttgctcattaatatccttttctttcatactgaagaactccctttagcatttcttataagataggtctggtttttcatgaaatctctcagcttttgtttgtctgggaaagtatctttgcttcttttctctcactgcctttaggattctttctttatccttgatctttgagagtttgatgactatataccttaaggtagtcttatttgggttgaatctgcttgttttttggttttcttatacctggatattcatatcttactctaggtttgtaaagttccctattattatttctttgagtaaatcatctaccctgatctccctccctccttccctgccgctgcctctctctctctctctctctctctctctttttctctctctctctctgtctctccattctctttaaggccaataacttagatttgtccttttgaggttattttctagatcttgtaggtatgcatcattcctttttatttttttgttttttctgctgtgactgaattttcatagagcctgttttcaagctcattaattctttcttctgcttgatccattctgctattgagaaactgatgcatttttagtttgtcaattaagtttttcaactcctgaatttctgcttgacttttaaaaattattttaatctctgttaaatttatctgataaaattctgctctttgttatcttaaagtgcattgagctagcttgggcaacatagggagactctgtctctataaaaaataaaaataaattagctggccatggtggcatacacctgtgatcccaagtacttgcagtgtttaagtggtataaacacctgggcccagaaggtcaagactgcagtgagctgtgattgcaccactacactccagcctgggcaacagagtgagaacccctttaaaaaaaaaaaaaaaaaagccgggcacagtggctcacgcctgtagtcccagcactttgggacgctgaggcaggcagatcacctgaggtcaggagttcgagaccagcctgaccaacatggggaaaccctgtctctactaaaaatacaaaattagccaggcgtggtggcacgtgcctgtaatcccagctactcaggaggctgaggcaggagaatggcttgaacctgggaggcggaggttgcagtgagccgagatcatgccactgcactccagcctgggcaacaagagtgaaactctatctcgaaaaaaaaaaaaaagattcattgagcttccacaagacagctattttgaattccgtatctgagaggccatatatctccatcactccaggactggtcactgatgccttatttagtccatttggtgaggtaatgttttcttggatgtccttgatgcttgtagacatttgttgatacctgggcattaaagagttaggtatttattccagtcttcacagtataggcttgtttttagccatcctttttgagaggactttccaagaattcaaaagggattgagtgttgtgacctaagcctatggtcactgcagccatttcagcactagagagtgccctaagccccggaatgctgcaactcttacagactccttgatacacagctttggtagattttgggaaaataagggagaattccctgggttaccaggtaaaaagtctctcccacttccctctctttctggcaaaggaagtcagtctctgcaccaggctgcctggagttgggggagggataatgcggtcactctaatggccatgacagctggcactgcacagggtcacatgtaaagccttgtagcccagcacagtgctggggctcaccccacggctgtagtcactactgcctggctgtcgctgatgtttattccaagccaaagccactctattcagcagaacggggtttgtcccatcaggacattggattccctgctggtccagcgtgggtctagaaacactgtccagaaacaaaggcatggaatcaggaggtacaggagtttccctggtgctttattttagtgtggcttagctggtacccaagttacatgacaaagccctctgtattcttccctctcctttctccaagtgaaaagagtccctgagctgcactgcctggaattgggggatgagtgacacaggcacacccttggccaccacagctggtgtcacaactgaagtctaccacctctgtattagtcagcattctctagagggacagaactaataggatagatgtgatatataaaggggagtctattaggagaattgattcacacaatcacaaggtaaagtctcacaggccatctgcaagctgaggagccaggaaggcagtccgaatcccaaaacctcaaaagtaggaaaaccaatagtgcagccttcagtctgtggccaaaggcctgagagcccctggcaaatcactggtgtaggtccaagagtccaaaagctgaagaacttggggtcagatgtttgaggcaggaagcatccagcatgggagaaagatggaggccagaagactcagccagtctagtcctttctgtgttcttctacctgcttttattctggccttgctggcagctgattagatgtgcccatccagatggagggtgtgtctgcctttccagtccattgactcaaatgttaatctcctttggcaacaccctcacagacacacccaggaacaatactttgcatccttcaatccaatcgaattgacattcaatattaactatcacaacctccaagaccagggtagcaccagagcttgtccaaggactgcactccttgggtcctgattgctacctaaatttattctgagcctcaagccactttagtcagccaatggtgaagctggctgggactcagtttcctcttgctggggtggaggattcccctctggcccagcactgtcctaaatgctccttccgtgggcactggcagaattctgtcctgtactgtgttccactgtgacagggcagtgctgagctccaatgcaatgttgcacactcattttgctctctctttcccaggcccacagattctttctctatgctgtgctgcctggggctgggggaggggtggtgtagataatgcaagactgtctttctgagcttttcaatgcctctatccttgatattacattaaaatcgggtattgtgattgctacttaatttttttgttattatggaagtgctttcttgcattgatagttgttcagtttggggttcctgtgaggggaaaatcactggagtgttctattcagccatctttctctacctctcctcccctttacaataatgataaatatttagagaaccttcctctgtttcttttggcaaaagaactatatacaccaagatgaaaattcaagtaaaataaatataaacataatttcaaatagattttaactaaaagccagtagttttagtaaacgtatcagtgtattctcgttaggaaagaataaacagattttggttgtttcattttgttttgttttgagacagtctcactctgttgcccaggctggagtgcagtggcatgatctcggctcactgtaacttccgcctcccaggttcaagtgattctcctgcctcagcctcctgagtagttgggactacaggcgcccaccaccatgcctggctaatttttgtattttttagtagagacaggatttcaccatgttggccaggctggtctcaaacttctggcctcatgtgatccacctgccccagcctcccaaagtgttgggattacaggcgtgaggcaccaagcctggtggaataaacagattttgacttgacacaatccaaaactcaaaaaagtagggtgaattactttgggaaatgtgaaggtagatctgaagaagaccaccaggaaaagaccagttaggacctcttcttgccaaatgtctaggactctcctgctaccctaatttcctaatcattctaaataaataggactgttatgttattagcttaatagatctggaaagaggccatggagatcaggttgccctcaggtgattcaagggtttggtttcattaagtcactgttcttagcagcttcagaaattgttcttcacctgaaattttgttgttttacaagaacctcttatatcatttagccttttgcctgaagatttctctgcttacaattggcctttcaaatcgatgttacataattgcttgtatctctcagggataaagccaaaatggtaactttaaaataccagaagcaaagactaaatcttattctctgttttatcgcaagaacctagtatactgcttggtacacagagatcttcaatacatgtttgatcggttgcatcaacatgaagtcatactcaagggatagtttagcaggtttctgagatgaagcaagatgaagattgctgacaatgctaccttttcctttcattcagctcctttttactgagacagtcctaggctatgtttaagttgataaacagctttataatgactctcccaaagcatatctgcatctcaaggaatagttgatgaatttaaaagaattaccagctaaagaagaagatctgtggactgggacaagggcctttattctaaagcaaagtctgttccatcattggtatcctgtctttggaattagaattatatagtgattatcacccacactatccacttatccagctatgtacattttcatttaggttctgatatcttaagtcaccttaagatacctaaacataccccttgaaaatagtgtcttttctcacccttctccatctcaataaatggctccatcgcccaaggcaaaatctgagttttatgcaatctgtcttcccacagcacttctatccagtccatcagcaagtcatatcagtcctactttcagaatacatctcaaatctctcttctcttctccatctccattttcaccacccccatccaggccaccacatctctcacatggaatactgcaggagcctccttacagatctccagttcttctcttacccagtagactcagctttctccacagcatccacacaagcctttaaacatatacattggatcatgttattccactccttagcttaaaaccatccaaagcttatagttaggcttttaagatttattcatactgttgcatataattgaacttcattcattttcatttctatacaatattccattgtctgcctgtaccacactgagttatccactctactgttgatgagaatgtgggttgtttcaagtttgaactgttgttacaaactttcttatataagtttcctggtacacatatgcatacatttctgtaggatgtaaacctaggagtataattgctgagttgtatattatgtgaagacaacagaattcatcaaaaccagatgacaataaactatgcttgtaaaattagatactgagatttttaaggaaggaaaagaatatatagaaagcaattaccttgaggaggtaagaggggcctgtgtttggggtgggggatgtgggagtcttctgaggtgctgatgatgttctatttcttcacctggatggtgtttattttataacagtttgctaaaatgtatatttatattttatattctcatctgtgtggttgccgtattttgtaacaaaagtaaccaagccacacaaataatataaatacacccttaaagtagtacaaatacaaaactaaaacccacgcaaggctttatattgcatttagagtaatttcagtagtttgccatgattagtaagtcctgtgtgatatggtccctggctaacccctttccattctcctttcacttatgcttttttatttcatcctaatactcatctcattttattagtcattaatttcaagagtcagcagactttttctatagagagccagtggtaaatatttttgaatgtttagtccatattggtctctgtcacagctactaaactctgcctttgtagaacaaaagccaccagagataatacctaaatcaacaggcctgattgtgtgatactaataaagcttatttacagaaataggcaagaggctgggtttggcccatgggttgtagtttgccaactcatggttagttttttatattttctttcaaactagactagtcagtgccataggatcagagttgtcctggtgtctatcataggtcttagggtgtatacatctgtaccttcattcatgaatgtatctactggcttaattccacacatttacctgtgtctctgtcccccctcaggattccatgtaaattaatactctcaccatcagaaggtatttaccatgattgaatctttctatgtgctaggcattaagctagacacatttcatgcattatgtaatttaaccctcacaatgattaaattggagccattgtcattttcatttcatagatgtggaaaataagtttcagtaaggttaaggaacttgattaaggtcacacaacatcagtgctggagctgatattcaaatccttgtacttctaatatagatgttgtctggtaatttagataagagccccataatggttgagttattgttaagtttgaatacctatgctagtctgttttgcattcatatgaaggaatatctgaggctgggtaatttataatgaaaagaggtttattttggctcacagttctgcaggctgtacaagaagcatggtggctgaaacagattgtaattttgaacactttttttttcctctgcattgtatctgtccttgcccatccatctgcttctggtaagacctcaggatgctttcattcatgacagaaggtaaaggagagttaggtggcaagagaggaagcaagagagaggaaaggaggaaacttcaattatatacaacagtatgaatgaatcttaaaagcctaactaagccaggctctttttaacatcacatctcacggtaactaatagagcaagcattcactctttacagaggggatggcacaagccattcatgggggatccacctccatgacccaaacacctcccactaggccccacctccaacactggggatcacatttcaacaagagatttggaggggatagaccttcaaagtatatataatgacatatgtgaaaagcatttagcctagaacttggcatgtggtaagaactcaggaaatgttacttacttggtgctgtatctttgttacttctctcaaagtattcaacagcattattaatactatttttactcctaatttccattatgtcctaatttaataccctaatttaaagtactattagtcctaattatattaaggagtcagtctcaaggagtttaagatatttgctcacgttcacacagttacagaaactggaatttgcatttagaattttttaccttagactttctactcgagattctgtgttagtctgttttgcgctgctagaaagaaatacctgagactggataatttatatatatatatgaggtttatttggctcatggttctacaggttgtacaagcatagcaccagcatctgcttggcttctggtgaggcctcaggaagcttctattcatggcagaaggagaagggggagcaggaatgtcacatggcaagagagggagcaagagagagaggaggaggtggcagtctctttaaccaactagctgttgtgtggacaaacagagtgagtacttactcactacaacaaggagggcatccagccattcatgagggatctgcccctatgatccaaataccttccacaaggccctacctccaacactggggctcaaatttcaacatgtgatttggagggcacagacatccaaaccatgtcaggtgccatgagagaataacagattaagtgacaagaaaattaaaaagacagggagattattaaagacctcaaaaacaaactttaaaggcattttaaagaatagataggatttggacacacagaaattttgcacgggtagaaggatggggattgggaagaggtgtttcatatttagaaaacttgttggtcaaagtgtcagagacaggaaagcacaggcccccacagaagagctcagcacacaggagtggggacaagggtgcagacgccaggcaccggatgaggtcccagggcagcacacaaggaggaagagaagcggttctggaaaactctgggcacacataagaggaagaagaatgctaatggacatggaaagggagtggtgaagaatgaaggggaaaaaacctgaggagtgggtgctagaggaagcctgggaggaactttcctagaaagctccaatcaaaagagcacaagtggtataggaggccgggtatggtggctcacgcctgtaatcccagtactttgggagggtgaggcggatggatcacctgaggtcaggagtttgagaccagcctggccaacatggcgaaaccctgtctctactaaaaatacaaaaagtagccaggcgtggtggtgggtgcctgtaatcccagctactcaggaggctgaggcaggagactcacttgaacccaggaggcggaggttgcagtgagccgagatcgtaccactgcacaccagcctgggcgacagagcgagacttcgtctcaaataacaacaaaacaaaataaggggtatgggaatccttggtgacctcagcagctgccatgccatatggaatatcctggatatagacagaagataagagttctagtgtaggtagggaaggtcacagcgagtatatttttttcctccaagaagctatgatagagtgagcagctagagcagcctgtgaaatatttaacagacgccaaggaattgtgtgcttgtttaactgcaaacaacaggctgttgtggttttttttatttgccccaaacaaattgtaattttgaatattttttccccctaaatcaggtctgtcccttccatctacctgaaaagtctgacctgcttcctgtggaaggttgtcctaatgtaaccaccctgtagccctctcattagctcagagaacacaacagtgagaatgaatgagcaaggggaagacaaggtggtgcacagggagctaggagcaagaggagtgagaggagcccaggaaagatgtcccaatggggaggggtgagtcagaaccccagtgagaatgagaactgaggacaggcctcatgtgtctttgccttgtgtgtacacatctctggggtataggttggaagtacaaaacaaaccaataaatggatgtttattgccaggcacaatgataggcaatttgggtgtaagggaaagaaaaggccaaaatcgctgtttatacacgagcctggtacttctttatacctgggaacagtgattaacgtgttcctgtattgtactcatggtccttgtgtgcctaggcaatgaagaggtgagaataatgcagtctggatttggggttgaggctagacaaatagctaaggaagaatgaataggacaaatcagctgtcatgatactgccaccttgaatttagctacctagtttctctgcaagtgagaaccaacatttttgtgcctgattttccagggctagtttgtggctagcaattagttcattgtctagtcttcttcacaagtggcttagattttagataatgagaacagtataagtaatcttttacttctttctacctgcattctgtctttagacttcagtgctcctttgaccaagtcagtatggtgtttgatcttacttagaggactaaaggaatttctgtatctgagttaaggagtactaataagaaagaatatgaaggaattttagagtctgtcccaacattgtctttttctgcctcttcataggaaaaacctgaattctctttattctgttctttgtggctaaaagtgcttctttttaaaacctgtatggcactttactgcttcttaatccaggctagatatagtttctaaagtaagcatgcatgactcagtgttggaacttttccaggtggagcaatgaaaaatgtcctatgtgatcttgtttgggttaataaacaaacccatctcagaaaggaaagagaattcaggtttttctatgaagaggtagaaaaagaatcaaactggtttgtactaaaaaaaaaacagcttaagcagggtcatttgttctgtggaatgaataatggcagtttgctgttctttcagaggtgtgcaaactttgtcattcaaacctgattcttttttggccacctacaatgccaggctctcatgagcacctagaactagggaaaggaaggcagaatgctgctgatggccatcccacaggaggcacatgcatcccttaaaatgagaacacgcttctttggccttcttaatttacctagtttacccaatgcttatttaactattttctcaacttaatccataattaccacccattttcagaaggaaagccagaaagttgtattagtccattctcacactgctataaagaaatacctgaaactgggtaatttataaggaaaagaggtttaattggctcatggttctgcaggctgtacaggaagcatagcagcttctgcttctgaggaggccccaggaaacttacaatcataggggaaggcaaagggggagccagtactttacaaggccggtgcaggaggaagagagaggaaggggaggtgcccctcaccttaaaacaaccacatctcatgataactcactcactcactatcacgagaacagcaccagggggatggtgccaacccattcatgagaatccacccatgtgatccaaccacctcccaccaggccccatctccaacactggggatgacaattcaacatgagatttggtggggacacagagccaaaccatatcaaaagtatatcctagcacttattttctgttttgaaagaacgacaaccatggccagcatatgatggcaaacaaagggttaaagtgaagaccctctctcccaccccataaataatcctctccttcttcctactgagaggagaggtggagagtgaagggggcaggaagtgaatgctcactctattgtataccttgagcacgggactgtcagtttttctctgaggctccagtcctgccagaaggtacagagatgagctgggcttgcagcatcaccagtgcaaggcttgcgggtcctccagcctgacacagaagttcctgggctacatgcaggaacctcctgaagcagatggcacaattccatcctccaaacaccacctcgtgctttttatcacctctcagaatattcacaggaaaccttacttaacacgagctcttgctccaaactgaaaaatgaaaggagaaatacatgcagatctggcatctaactaacgttcccatcaactattctgtaactctgggccagaattagacttttagaatccaagtttgagggatcaggatcctaatcctaccatatttctttttcttactcctgcttccttgttcttttgagaatgaaaatatcaggagatcaagggaaaagtaatgtgagcaaatatgtcatttggattctctaggctgagaatttatcgtctaaatgttgaatgagatataaatctttgccgggcgcagtggctcatgtctgtaatcccagcactttgggaggccgaatcatctgaggtcaggagttcaacaccagcctggccaatatggtggaaccctgtctctactaaaaacacaaaaattagctgggcttggtggcgggtgcctgtaatcccaactactcgggaggctgaggcaggctaatcacttgaacccagtaggcagaggttgcagtgagccaagattatgctactgcactccagcctgggcaatagagtgagactgtgtctccaaagaaagaagaagggagcaacagacaccaaggcctacttgggggtggagggtgggagaaaggtgaggattgaaaaactgtctatcaggtactatgctctttacctggatgatgaaataatctgtacaccaaacccctgtgacatgcagttttcccatgttacaaacctgcacacgtacccctgaaactactagaagtaccacattaatagcgtgcatctccttcttcctgccttgttacttcactttttctgttccatctcttaaagaggcatgtaaggtagaatatcaaagtattgagtgttccctttgcttgcttgctggatatccactggtacacaaacacatcttcgtatctacatggcagacttatgtaagtgacaatactgtttctggtggatggaacatagagcttatatgactgatctgtggtccctatattttgttttgttttattttgttaattttattcattttttgaataggtaatagatgcacatggtacaaaattcccaaggtacaagagtttacggtgaaaagtaagtctccctcctctttgccccagtaaatatagttcccattttgaaaggcaatcactgctctttcattcattccacatttattgagcacctactatgtgccaggttctgttctgggcaatgatatgaagcaaaacagacaaagcccccttgccctcaaggagcttacattttgattacgaatttcttgtaatattcattcaatagcatcttaagttttgtatggccagcgcactgtggtagttaaaagaagggctctagagtgacagcaactgattttgaatcctattttctgtatattctaagtaatcttggagtatttattccaccactctaaactgtgttttattttgaaatggaaataacaattctgttttataagattatgagaattaaataatacatataaaacaccaaacacagtgcctaaaacatagtaaatgctcaataaatattagtgttaattataattgatctgattctactgttctgtaatgctgactagaaataaaggatttattttcccaatagttttcgtttcctctctttgctgtatgatcaaagaaaatcactttttaaaggataagcaacagtaaatttaagtcaagtttgatcattaatctcttgtgtattagactatttgctgagttctattaagaaatcaactcctagtaaatcagtagagtatagagacactgtttctctttattctttctaatctttcttaatcccatgtaatttgcagggttgtactatttggtctgtactattaactattaatttaaactttataatgggagattctgtattttacagaagaattaaacacttttgagcaaagtttctaataatacaatttggtatccttgtcttaaggaactttatgactgaagtctccagccagatgggaaaacagctttcagttcatggaaaagtgacagaagttttccttggtgatggtcttaaggtggaaagagattagaagaaaagtacatcgggtgggggaagaaaagaagagaaaataacttctaggataagaaaacacttttaaatattaggccaataactatttcctttattcgacatgaaaaaggatcattagggggcataatgaaagattgtgaggatgttgggttgggtatattacaccatgtactggaccattgacttggaatctaaaaaggaatgagggcacacctatttggcccaccacagtcctgataatcatttaatatactctctttctctcctttgttcctgtttctattttgtattgttttcctggcagacgaagttgacagatctttgaatggttgattatggtgtaggaaatctcttctttcagcctagtcatgatgtagggaggactaggaagaggagattgctgagtagttgaagtaaaatgcctctgaactgcttttattaattggttagtggtgggatcaggtagatttggggagttttgtattctttttaaatattttgtaggctctgataatttattgacagatgtagattaacaataagaacatcagtgctcaagataaaagtttcgaaatgcatcaagtcaatactaagtgaggccttctctaatggcatttgccactgtgctcctgggctttgtgtatgcacatcatttaatgcactacagagctaactctaatttattagtgatacattaggcaaccagagtgtgacctctttggtttacctttggaccttgtcatttctcatttttgttttggttacctattacaaaattacagcctccccgaaactcagtgatttaaggtcttattatctaccttggttctgtgagttaatcggggctcagctgagtcttgggatcttttatgagattgcagtcagcagctgaggtggaggaacatgaccagatgtccaagatggtgtcttcattcaaaggtctgacacctcagctaggatggcagcgacagctgagcgttggctgggcatttctctttctctctctctctctctttgactctctttttgtctctctctttccctggttctaagcagcctctccatatggctaccttgagcttctttataacatggtgctatcatcatagtcagatctcttacattgggactggcttcccccaaaccactgtttcaagagacttgaggagtctgcaaggtttctttgaacacaaactcattcattcaaaatcactttgccaaattttactgttcaaaatttcagccaacccagattcaatttaggggtactatgcaagggcatgaatagaaggaaacatagttcattggaggtaagggtgaggcgggcattttaaagatgagctaccaaaatcctctttgcctaaaaatagtcaaattcctctataacacagctcttatttcactgcaccaaataactttagaaaacataaacctacacagctcctttttagtaagtgaaaatatgtgatcttggtaacatttttaagctaaatatatctgatataaaatgcatgtcatctgttaataaattaccttggttggcttatacacacgtgttagaagctgccactagccaaaatgtgtttggattatatagtggattagagaaagttaacaaatcacacaatacaattcatctcattcctttctaatctttggtacagtagtgtgttgtactatataataatgatagaatgttttgttcattgaaaggagtgtgaatgaactttgttgttgttattgttcattcattcattccatcaacaaattttgtgattacctaacacaatgcctggcttataagtaatggagaacagggacattttactgctgtaattggattttgcctttaccagtataaatagtagcaatttaaatgctatttgagttcatgcattcagatatttgggcattggaaaaaattgtgcaacagaataatagtaatcgtgctgattaagcccttactttgtgcattatttcatttaaatctccccaggaggcttgagggtagaggcagacttattacccccagttttatagaggttggaactatgactcagagcagttaaatggtatttcaaaggtcacccagtcaatacatggtacagcttggatttgaacctagagcacctactgtggaaaacagcattaaaagaataccattgcttttatttctaaattccatgtcttttaagaaatgttctcaccattctaaaatgctaagtggataattacttaatgttataaggctattttattttcattaatctttggccaagtgtgttgacaactcccactcctaccccagacttctttttgtttcatagtgaccatttctgaagtctaagaagtacggctaaagaataatggaaacttactttcattgaaattttactgtataccagtcatttaacataatatttgaaaagagtgctaagttgccatgacatgtagatttaaaagataaacataaaaataacttatatttattatcagtcatggattccaagattatttatgagaacttccaatatacctggcccaggaagaatatggctcctaacttaggggatctcaccagccaatgggaaagactaagcagatgtgtttactggcaatacattctgatgagggacacctaatggtgagtagagggtgcgacggcttctagaaagagtcaaagattagagaagttcatcaggaaaaaacgataaagtttccatcaggagaatacaccctagtaaaggctcaaagtctaaagagtttaaggacttctagggactgaaaaaattctgtataacaggagggaaggtgggtgtggaagaatagccaagaaggaaaaatagccaagaagtcagtggaaggaacattgcatcataggccttgctgagaaattggaatgaatgacagtatttgaataacgctttgctcagttctgtagtttcgattcgaaatgcagacttaaaaagtcgatgaacattcagacatttctctttaaacaagacttccccttctattctttagagttggaaattattctctgcttgggaatagttttcaatatgttccagacattataaatgacttcccttctatttccatgtatttcccatgttgattacagccaggctgatcagagtaaagcaccaggtgtcatagcatcctaatattatatgaatcatgcatttatccattcatctatgcatgtatccagggaaaacagatttttccccctactttatcggttctacagattcagattcctgtatatttaggtaacattccaaggggatagatgtgctcttataaaagactgcttacttcagcaagacagtttctaaaccctttacttttgagcccaattctccaggtattctcgggggcggtgggggctggagggaagcaaaaaaaaaaaaaaacaaaaaaaaaaacagcaattgaaatggcctctccagtgtacccagatggaagatggggaagtcctgctagttttttccttcactgccaacataaacagggtggagcagctgagaaggaaggccactagtggagagagaaagaaacaatgtaacagcaaagtgacagacctcagtcctgcctcctatctggggcaacagaggcctctccagccaaccccagttctccctttgctttgcacttcctccagggacctctcgaaggagcaccagtgagtccctccatattaaatagttgaaagaacttgggccaaaaataaagcagaacacccatttgctttttccaacttgtctcacttctgctcccttcttcaaactcctgataaaaagcagcggcaattagtgtattgcaaagtgcctcttggagagttatgggaatcactgctgctttccttagccccagtttcacaacctcaactcaagggcaggccctccctctctctttttcccctccttccacctgacagggaccataaataactgaggctcccagtgttcccagctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagattttttggggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtaagatctttgagttgtacttggtgtgtgctgtttttgtttgagatgcagtgaatgtgcaaatagcccagccgtaaatagttacttaaaataatctcttggtactgggtagcagcagtagaaagttgatctgtttagtttttacatttgcaaaaacagtagttgacagtgtatttttagacttgattggtagtttaaaagctgagctcttgcggtttcctgagtttaaatgaatggaaaatgtaaacagtaccgaatgcaggaattggaaaatatatctgggggaatgaatcacttacctttgagaaaacacaacatgtacacttttgcaatctcttggccagtgaagcttgcgtccagaaagagggtaagagtttgcctgtgtggggaaggaacttttctgcagcctgtgctaccttttgagaaggatgggaaatgtcccagagggcaaaagacaattgaaaaacctgccttgtcactcttggaatgtggtttttccatatgatgtcatgttttgcatacgtagctggtaaaagtatttcacataattaactctttgtcttgataattaaagagcaatttatatagtcctttcaaagtgctaaagcacccatattatctctggagaaggctgtgttgctttccatgtagatttcaagcattgggacagttgggctgttgttaatttgataggtttagaagcatttcaaaattgatgtgttccaaggctctccaaccaagcaagttatagttcacataacttgctagtttcttacataagccccaaactgaaatcctgtgtgtgagaaaaccagttttttttttaaatgtctgtttccttcccacatataatttcaagaacagtaatgaagaggtggttcttattttgtaatccatgtccattcaaacaagctgccctcatcgtgggtgaggtgaggtgaggaaaactataactgacataaaacatccacctttctagtcagctgaggcttacagggaagcaaagggatacgggtaatgttttcagatttgtatttaataccaggagttgtttccgctacttaaattcactcttgaaattgtgtactaacctttacctataccttttccttctaaatgagagtttcaaaaattatccaggtgataggggaaggtgaatatgagatattgggggatttgctgataaccaaaggagtgattttctccacagctgacactttcaaaagggaagcttttgatgtgggcttactctctacatctgcaggtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttcttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaattatgttgtttattaaagttgtccaccaagtgtttgagtatctcttctaaaactgttccattattttgtttacaagggacatgtaagaagtataacagtgatttaccaaaagtcacagacaggaatggtgacaaattcagttcttacaactgaagtggaaaacttctgtatgggaaaaccttgactcaaacttttcttaaactagttgaaagaaacagaaccttgtgcagaatttggagacttctttgccctagtgtggattttaaagctaataattaaaccttctaagccagagccctgaggacattttcctatagtttaaggatctgttgtagaaagtttcattgtctaatagtaaatggcacttcccacaaagtaaaccctggagtttattctcagtgtagttggtgtggccagtatggatattgaattgatttttcttctagtcttttttttagtaggaatttgaaactcatatagcttggtagaacttttgccttataaatacatttataaaaggccttaaagtcttattgtagcaggtgtcattaacaggaagaggaaaaataactttaaaaaaatatgcaatcttttaggcgatcaaagatagcaacaagttaaaatggaaaatatgtagaacttttaaggttcttgagatcctgtagatcttgtttaaattgtagagatttatagcttttgaaatccaataactagcttgccttctgttcttctgataatatatgacacattttgtgatcagtcatttttatgtagaaaactgtagtagctgacctccagtgacataggaaaccagaatatcgcactgtattttttttcttaatataattccaaggctttcacacttctaattttgattgcactattatttgttgctattatatgtaactcattttttttactttgatgactcatgttatgctcagaggcaaatattttttaaaaatctataaagccaatatttttaagcacattgttagagtattatcaagtaaaatatattctgagtgtaacattttaaaaggagtacattaaatgtgtaactcattcaaccataacattttttttcttttttccctgtctgattttttgctttctatttcttgttttttttttttttttttcctaaaattactttaaaatagtcccaagataaggtaagaagacatggcacttttatagtgtttctcttccttctcctggctcatgctctcatttttattttctttagcattgtaatgtgatgtgctgtgatgtgctgcgatgtgctttctttttttctgctcaaaagctttagaaacatcagtaaaaattttctgattttaagaaaagtagaaagtatataataaatattacttacgcaaaatttaccagatacttaaggaatttctttcccttaacaagttttgtatagtgcatgaagtaattaaaggaatttcactgggtttgcagaaaaagtcctgatgtgaagggctgtttgtttgctggtttctgttttatttgagttgtgctaggtaaattagtataaatttagaattctgaggcatgtttttctaacacttcctatatttaacacttagggtgtactgatggctacaaatagttggccttagttgaaaacaatttaatgctttctagatccccatgcaaataatctttaattttcagctgaaagtacttcgaagtattaaggattccgagtgaaacttgatggatttaattgactccatatgtctaatttaaattggtctggaatgatcagaagtaggaactttagacattatgcaaaatgaagacatctttaggcctttcggttgatagctcccaattcagggctctgttctgcagttggcactcatagagaaattaaaagaaggaggagatgtttaagaagtatcaacaaagtttagatacatttaaaaatgaaattaaaatgaataggtaattattttttaaaacttttaagtgtttgtctacatagaaaactgtttcatacaccaccaatgttaacatatcatgccatggggaccataatttgaagaaatgaatgtctaatgcagagagtggccggcgactctcaaatcacaccactggagcaaaatttaacattgttattaatacttagaagctgcactaataatgtagccactagccacctatagttacttaaattaaaattagttaaattcatttgttcgttcacaccagccacatttcaagtgctcagtagccgctgttgttggatagctcagatttagcacatccccttcataggataaagttctgttggacagtgttgagttagagaattcctgctcttaggaagcttctactgtatttgagagaaggtaagagaatagaaacaggaatggcggaaagaagggcttgcaattgaaactggggaaaaaagagagtaatgggtcccatgattgggcacagagggcctgactgtgcaagtggctagagtcatgtggcttactagataagttcctctgtgcaggaattatgcttataatggtcttttagtaagttttgctgaatacattaaataatgactgcagaatgatggttgtttggggataagagaggtccatctgagattctgataaaagtgaaggctccaatcctagaagaatgtacgtacctatctgtgtagacacttagaatgaggcctctaatgtcaggaggctctgtaccttgataaaaggatacccactttctgattttctttagtatagcaggcagtggggaaaagaaattgtttcatgcaaagaatcatttatttacctcttatgtgtatcttctttgttcatttccccatcaagcacacaaaaggcaaggccaaagccaaagtctggctggttcaactggtaaagatacaagaaggcacttttagatccagatggttttttaattatataggcagtgaaagaagaagtgaaaggtgctagcttctcatgatccttgtcccctacacctaaaaggacaccagaacaaaaggggctggatgtctacaatgctagttatgggataccccattgccgaggagccaattctagacttcagctaaatggttttatattctgcagctctattccaaggagagcagaataggaagcctcatacatcattagaaagaggaagtgatgaaagctatctcatgacagcctcccaggtgagatggggaggtgagtagcagatgatctcgtggaagctcctcaccaacctccatcctctcagttcctggaagatcacagggtgttctgtgaagactcagattagcttcaattccggtctttgcctgtatgacttatgtgaatatatgcaaggtcacgagagtgacatggcagaactgttctcccaagggccctgactctattgagttttagtttagaggtcactgtgatgatggcatatcagggcatcagggtacctgcatctgagaagttcaagggccatatggaggatttgacagtggctggaaagaacagttggaggagctagaaagacaacagtagagcaaagaaagaatatttgcagaaaagaccaaataaccatgcagggaatatgaatgtttcctcaaagccaggaagatggcaaaaaggatcatgcaaagtgtattcataacactacttccttcttgatgttttctatgagtagcaacaacaaaccagagttctcagtaagtcccaaagacttataaacagacccatttaaagtagacataattcttatcagtagcgcatgtcaagtagacatagaccagaaagaggagacattctaacataagatctcatcctagaaaaatctgtcaactatctagaatcatctggttcttctcaattgtcatgtcagttcaacttcatagtgaaacatccaaagttttcatgcatttcatattctcaaaattggcctaattttaaacaaattctaatcataaggttgtctacactgaagacattttctcaaatacaagggattttacttttcactatgtcctttcaagaacaacttttgttgatatttttagccatcttgcctgttcttaaagttgcatgcattaatttttttttattcatctcatcatcatctaccactgttgaatggttaactgtaaatacaacagcctccgctccttcagttcggataggtcttacaccttgaacagaagctcctatgcacgggacagcatgatgattgaagaactccttgtgccatccaaagagcaggtatgcattcttttcaaaatagcctttgaccattaaacttacatttgtatgatttaatcaagctctctgtcttgtgacaaaaaatatatttctgcatgtttgattttacatttgtaaatcttctggtactcgccagttaaaaaaaaaataagttgtactataagcagaaatattcctgtcttctgcaggtgaggaagataggaatatcagagaggaactcagaaagtcctaggagatgtgtagttacctttctcttctctaggtcaaatctatttcagttttttaaaaggagagttgataatcattggtagctgaagttgctggtattaacctcatgaatgtttttgtttgtttttggagacagagtctctgtcacccaggctggagtgcagtggcatgatgtcagctcactgcagcctctgcctcctgggctcaagtgattctcatgcctcagcctcctaagtagctgggaccacaggcgcaccaccacacccagctaatttttgtatttttagtagagacggggtttcaccatgttggccaggctggtctagaactcctgaccttaagtgatacacctgcctcggcctcccaaagtgctgggaacaggtgtgaaccaccgcacccagcctgaatgttgtattttgctaaacaaactgtgtatctatgttggaatttgttagaattgtttttagtaagtaaagatgagactggtcattttttgttcccttagcttcaaagctgcctttgatgggtgtctgaagatgtgatagtattttgctttctaccagaatctctgctacatgcatttggtgtttgtgtaattgttttcttccaataattgtggttgaatagatagcgggttactataagaagttccagtaacacagtcttcctgcatgtgggctcaggatggtcctggaataattactacacagataatacctggctttaagtatgcacagtagtgatttaatgacagatgaaactatctggacaataaaacttttaaaggtggcttataatatttaaacaatgtaaataattggtgaaatcatgctgggctttttgacttactgcacaatgaacgtgaattggagcagatgaataaatgatagtcacatatcatagccaagttagaagttaagcaataggtagacttttgggactcccacatgtctgcagatgctgatgtctagacctacatatgtgtgttgtacttcataggaacctacaatatatattttattactttttactctctagaacattcttaataagcaggccttacagaggtgaatacagtggttattcagtgtttggtcagacaaaaaaactctattaaaaatgattataggctgggcatggtgggtcacacctgtaatcccagcactttggaaggccaagacaggcagatcacttaaggtcaggagttcatgaccagcctggccaacgtggtgaaaccccgtctctactaaaaatacaaaaattagccaggtgtcgtggtgggcatctgtaatctcagctactcgggaggctgaggcaggagaattgcttgaacctgggaggcagagtttgcagtgagccaagatcgcaccactgtactccagcctgggcaacagagcgagactctgtcaaaaaaaaaaaaaattgattataggtgcatgtattagtctgttctcacactgctaataaagacatactagagactgggtaatttataaagaaaagaggtttaattgactcacagttccacatggctggggaggcctcacaattattgtggaagagaaagagacatcttacatggtggcaggcaagaagagaatttgtgcagggtaactcccccttataaaaccatcagatcttgtgagacttattcagtatcacgagaacagcacgggaaatacctgcccctatgattcaattacctcccaccaggtccctcccacaacaggtgagaattgtgggagctacaattcaagatgagatttggatggggacacagccaaaccatttcagtgcaatagcatgtcatgggttttaaatgggtattagcactagagaaagcacttgtctcaaataatgaaactaagtcttgggtataaggtgttgccaggaattggttgaaattttctgcttggttggctgtggtcattatttcagtctgtaatcctgctcttttcatattcccaattgaaatgagatggcagtggagatattgataccacttgtaagtataaaaatgcctgttattctctacactctaaggagaccccacaaaacgtaaaatcacaggtgaaaggagactccccaggtatcaatgacactttgctaatgtagaaagcatgtgccagggaatttctgatcaaacctaattgtggcttatatttctgcatattaacttgctatgggtcaagggcccgaaattggaaccaccaccaccatcaccatgaccttaccatcatcactgtcacctccaccactgctaccaccaccactattaccaccatagttactctaccacccaccttctgcacatcaacattgaagtaaaatgcaagtgtttgtggtgctataaaatggcttctgagggttctcacaccattgcctattaaccattaccaagacctacttactcaggtagactgtgggggcagcatttactcagaactaaggatttgtgaacagaaatagaagacaaagagaagttttgagatgaaactgatgctcttgtagtcagttgttgcttccaactcaaaaatacctctgtggacatcatgaacacttctatagacccatcagaggaaaggagagcataggacatctgaaaatctttcaaaataaactttaagttgataatgtagaaacagaaagttgctgtctttaatgagcacagaatacccacataggcattccttgtggaaccagcatgtttaataagcatataacactactcagatccatgcaaatccagaataaattggcaggagatttcggagcgggaaatgaaagtcataaagacattttagggactgttgggggcatttgaaaatgtcttggagatatctgtgtatgtaggaaatcattgatcattttcttagcagtgataattttagcattgataattttcttagcttatcactgctacttattggacctactcagagaatattggggtatgcatgctgaagttttccagaattaagcaatcattaattcaactatttatttccaaatagttcagccaaaatgcatgtggataaagttaaagcaaatatagcaatgttaattgttgaatccaggtggaaggtacatgggtattttttatacagtttttcaactttttcatttgtgtgaacaatttcaaaatagtaacttggaggaaggaggaaaaatcctgaaagaggtgcattaactttttaagtctctagttttgagactaaaaaaagctaatgcatctctgtctattattatagataaataaaattatagatacagaggagaaggaaaaggctaattgctcaaagaagaagctggcagacagaagtgtctagatacactgtgcaagactcatgggaagcatttacttcagaagtgcatttaaacactttaggattaaatgacaaaattattagtttctgtttttcatttctctaattttgtatttataatgttcaaaatatagctcttccacagtaataattttgttggaaagcgtgaaagaagttttcagtatttagaattcccaaagcaatgacatataacttactgtcagatttaaaactgcactgtcattgcccagttaaatttgccctgacaagtaaaggtgaaaaatgagtaaaaatgaactctcatacacttctctttttcaatgagtagatctcactcatacaaagtacagttgcctctttattatcctgctgattaatcagtttgcatattaaccacagttaaagtgtagttgagacccagggtgattagtgcaggactgccacctcaccctctagggacctgtgctggctgaaggcacatgtggaggccagagctgggggaggggagtgggagaggtggagccatctccaccccctgttgagcctgagtacttagtcctaatccacttaattccctcctggacaatcaacagtagactgttttgttacaggttatcatgaacttcctattcttttaccttccctttacttcagaagtgcatttaaacattttctattagaattaagtgacacaaaatcattagtttttgtctttcattcctctaactctgtatttataaatttcaaaatgtagcctttccacagcaataatttcatcagaaaacatgaaagaattctgttagccaaaaattacctgaagatatgtttttgaaaatgtatatgtaaatgaaatcatgtcttggatttgtcaaaagatctttttatttaaagcaatggctcaatccagaccacttacgagcatcacttggagaactttggggtgtgtgtttgtgtgtgtgtgtgtgacagagtctcactctatcactcaggctggagtgcagtgtcgtgatctcagctcactgcaacctccacctcctgggttcaagtgattcttgtgcctcagcctccctagtagctggaattacaggcatgtgccaccatgcccagctaatttttgtattttttagtagagacggaattttgccatgttgcccaggcttgtctcgaactcctgacctcaagtgatccgcccagcttgtccttccaaagtgctgggattataggtgtgagccaccatgcccggccacctggagaacttttaaaaagacgattgctcagttcctgatttctttggcctgtgtagagactgggcatgcaattctaaatgaacccaaggttgaaagccactgattcatagtcagtattcttaactgggggtgcccaatggaattacctgtggctcttttaaaagcaagatgcctgcagaatcagaatttccatgtctgggttcttgggcatatgtatttttaagggttcccctgacaattctaaggtgtacctttagttagtaactgccgatttaaggcaactctcactggaagcttggtgtgtattggtatgtcaacatctaatgtatttgttttataagctcagatttgtatgtgtcagattgtctgagagcaacacctgtgcttggaaacattccattcctctccaaataggatttaataaataaagggatgagtctaaactgaagcctgattgtctgggatgaatgtaatagcatggtgctttcatttcttctgatgtaattattgaaagcaactgtctggtacagctaatgtacttaagacacattactgtgtgtgatccagattagacagtgctcattacataaatggaatgctattcactagataccttcagtgtcaggagatataatggtggtaacacttatggtggtggtgaaaacagctaattttgagctcctattatatgcctggaactattctaagtgatttagcagtattaagttgtttatagttcacaatatccctatgaaataatttgttaaccccattaaaaagatgaagagtccaggcacggtggctcacacctgtaatcccagcactttgggaggccaaggtgggtggatcatttgaggtcagaagttcgagaccagcctggccaacatggtgaaaccctgtctctactaaaaatacaaaaattagccgagtggtagtggtgcacgcctgtaatcccagctactcgggaggctgaggcaggagaatctcttgagcctgggaggcagaggttgcggtgagctgagattgcgccactgcactccagtctgggcaagatagtgagaccctatctcaaaaaaaaaaaagaaaaaaaatgaagaaactgaggcacagagagcatgagtaactcacccccggggacacagcttgtaagtggcagagtcactggccatctggctccagattgcctcattttatcctgaacactctacatctgcattgctcagtgcaagaaaaaggcccttgaggagtccacgtaatttatagtctctcctccaggattttatacttgctagtattcttggttgggccacagaaccaccatcgtgatgtattttttagcatgaaagattatatttagacagtgttctttgttaacgtttatttctaatcctaataaagtcttttatttattcaatgtgctttaaaaagaactgacatattcagtaacaattataaaaagtatgaagaactggccgggcgcggtggctcacatctgtaattccagcactttgggaggccaaggtgggcagatcacgaggtaaggagatcgagaccatcctggctaacacggtgaaaccccgtctgtactaaaactacaaaaaattagccgggcatggtggcacgttcctgtaatcccagctacttgggaggctgaagcaggaaaatcgcttgaaccagtaggtggaggttgcagtgagccgagatcgcaccactgcactccagcctgggagacagagcgagactctgtctccaaaaaaaaaaaaaaaagtatgaaaaactaaaaattatggcatggaaggcatcattacaggaatggaactatttgaccttcagacagataaaaggtagaaggcatgacatcagtttacaaatatttagcaggctaaccaattagtttatcttcctttaaatgacaccagaattagttgtaagactaaaaggtatgtatatactgtaggcagaaacatgtaattcagtatgattttttatagagtcattcaaagatgggagaaaagcataagtcacttatcgatgtcggttggttttgcctgcatacacccatttggctttccacatatacccatttccgtggcagtgcctggatctgatggtcgaatccctaaccccacccatttctcagctaatgttgtttagaaggggcataagtccctcctgttctgcaacagtgagacccaattctggccgttcagagcattcctatctcctggattacagcaattactttaggataaaaagtgaaatctgagcccatctagtgagactcaaatttgagactttgtctaaccttttgggaaagagaaactctactggggttcctaagctataaagatgacatacgtccaaagctgctgggagtagaatgtgaagaccaatgattcctaccatcatttgagctggattcaaccgaccttgaagttagcaccatacagattttcttgccatataaaccagcaatttaatttcagtcttcccccatccctggaaagggagtatcttaaaccagttcagtttggttttctgtcattactaatgtggttgctattggtggtaatgaaacctggtaggaacaaccacatatcaatgggaacataaaaagtctagcatcttaaagtgccattcaaccttgagattctattattttatgctttctctctagaaataagtaaatccaatattaacaaaagagaaaatgaggaactatgatttaagagaatgctataaagttggggatttcttttttcttttctttttttttttttgagacggagtctcactctgtcacccaggctggagtgcagtggcatgacctcagctcactgcaacctctacctcccggattcaagcagttttcatgcctcagcctccccagtagctaggattacaaccatgcaccaccacacctcgctaatttttttgtatttttagtagagatggagtttcaccatactggccaggttggtctcaaactcctggcctcatgtgatccacccgcctctgcctcccaaagtgctgagattacaggcgtgagccaccacacctggataaacttgggtatttctaaacaaaaactttagaaaggagccccttgccaattgatcactctaaaatgaacaccttccatttccttgtagttctgttgacttaggggcagtgcatctatgaaaagagaggaatgggacagctgtttggccctgttctctctctgagtagatttctttcttttgaagacttccttttcagaccagatttgcctacatggtttgttcctgaggggactagtggcaggccttcaatagtgactggtttagaagaattaactagactatgatgtcaacagttgcactggctgtttgaatgctgactgtggagaaaattctgtaagtgatattggaggcctcattatagccatcatgtacaggaaggctgctgtcacatcttccaccccataactcttctcatttatttcacagccaaggattctggttcctttggattggacttggtcttttttgaggctaaggatgatttcatatacatttagtcatataatgtgtaatgtacaatttgatatgttagcaagtagtgtgaaaattggagcattcttcagaagaaacttcctgctcgtattttcaagatccaagcattttcaattacctcagtaataggaagggagaagaatacctaacccaaaagactgcctatgctaacagtcagattttcctcctctacctctcaaccctattccacccacactcccacccccatctcccacacccgtcggcagattaaccttgctatttctttcacataagctaatttctaaggggggtgctcagaaacgtgcatggtggcagaaggtagccagcctcagattaaagatttgctagagatagtccccctagaagataggcatctttgactggtgacatttaatatgctgctttctctcttcaatgtgctttgccagcattattcaggtgatgcattcaacacctctcaacaattggtcagcaagattacagattttttgttttaaggcagagaagttggtattgtgacttccttaaggtagtgcagttagttttgatgtctcaagctgggtgttgacacgctcagcttccactctgaccttgattcaccttcttttgttcgagttcataaccagattgtcttgaaatcaatccaattcggaaatttaatgaacgaaatttctttatatgctattctcaaaataagtcttaagagtaataatagttgacttcaagaaaataaataccgtaagggaaaaaagacctgctttttctattatagtaggcctttaatttttattttattttactacttgtgtcaggtttccttttgtggaatccatttcttaaaagtgtttccatgtagtagtgctggatgtttaaacctactactatctatttgggtcgcggtttgccatttcactcaatatccactgcacgtcacaataattataatacttaatacactacctgccacaatattttattaaatgcatcatctcatttcgtgcttttggctacctaatggaaggggtattatgattaccactttacagacgaggagactagggctgtgaggagtgtttagcttgtccagttaaatagcttgtccacagctattaggcggtagagctgagaatggactgtaaacctgatgggtgcttaaacccattctcctgctggccactaggcaatagtgccactctaataagcaaagcatagcagatctgagtaaagcatgttagccatgggaagaatcgatgcgtagacaagtattttgcaaagcaaaaacaccactattatttctgttaatccagcaggcagctctgacttctccctgtgatgtgaaaaggatatgctatcctaaatatctacatagagggatgcaacattatagaaatataagaaataaattatcttcaattattaaaaatctagaggtaggctgggcacagtggctcattcctgtaatcccagcactttgggaggccaaggtgggtagatcagttaagccaggagttcgagacctgcctggccaacatggtgaaaccccatctctactaaaaatacaaaaaaaaataaaataaaatcagctgggcgtggtggcacatgcctgtaatcccagctactggggaggctgaggcaggagaattgcttgaacccaggaggcagaggtttcagtgagccagcacagatagcgccactgcacttgagcctaggcgacagagtgagactctgtctcaaaaaataaaataaataaatatctaggggtatgagattagcatcatctgtgtttttgtttgcatggtaatttagagttttcaagccactttcacattacttgggtcattccattctcacagtgaatcagggcaattaatattttctacctgtcaccctaatgcagaaatggagattcagtgagttttttgacttgccagtcactgggctatggagtgacagagcctgattcaaacccaagtcatcttattcttcgtgtggggaactgacacccacatgacttcctctgccttggccctgtccaagttgtggccgtagagtgaagttatccctgatagccctttactttctgtggctcctagtctgattgtatcatccaactgttactaaactaaattgtatttacaatctcccagaattgttgcactgagtgttgcatgtgacctgttattgggagatttcctggttgctgttaacattagcctgtcaaggctaccagttaatttgcaagaccaccttcacccatagatggtagagctgttagataaggaaacttgcagggttagttctggaccttaactcatgtcatctaacactggaggttgacagtcagcaacgtagagaattactaatattggagttaattggatttctcctttttttctctctctcttgcaaacactttcttgaccctgcctctttccttccctgcctggacaattatttccagacctgggcatttgggtgtgtccttgtttgtaaggccagtgtgtacttgttctcctctttgctctgatgaataggactagtgagaaactatttttggaaagtattaagctcttggagacggtgatatcatcattagtcaggctttggactccattaaataatgtgcattttcagttgaataatccttgacatcacttccaaaatgaaaagtaatgtgcttattcatattatctttgacatgggaataaaaattattaaaaattccgtgtgaatttttctttaacatagtgttctattaaagccacccagtgctaggtgttgacttcgtattgcctagtttttgaagtctttctaaacctcattttcctcatctgtcaaatggctccattactctcagggctaataggttctgacaactcaaacaaaaaatgaatgtatgggcctaggtcagtccttaccattgaactgatgcacagtaagttgtggtagtgctgttaacaaaggaatgtaaatattttgagtcaataataagacctaggcattgataagatgcattcttgaatggcctccattggtttgataaaagcatcctatgtgtattactataatgccccagtgctgggactggaatatttttatttttgctgttttccaccataaatgatcagattgtgacaaatgagctaatataagtgaaagtcttttgaaaagtatagaaggctttacacatataaggagacattatgataattccatgccaacaccagcactgcattggtgccagactttgacgtatatgttttcttttatctccatatcaaccatccccagtttgaaaatgcagaaactaagactgaaaaaagttgagtaatctgctaatgatcacaaaaccagcaggtgatgctggggcatctctgaaggagctttcaataagtaaagataaggaaaggtcaatgacaaaatatctcctttattcctgatggaggccaggcgaggactggcttagtgtctgagccacgtgggcctgctaactgaatccctgagataggcacactcccctacccaatgactgtggtgctggcccaggccaggcacactctttgcagaagtaggctttggagagaagaggagactgctcactctctgtgcccatagattgaaaactggatctgagcagaaccttcctggctacctttcccaaatctatcattcagatacatcactttaatttccagggctaaaatgaatataaaggggtagggagaggcccatagttacacaactgggttgtcttttcaaactggaaaaatcgggagtgggaaagaagtgttttcattaacaagtggcaaaggcaatttccaaatctaagtctgtgactcaacttcaaagccaagcttttccattgagcccaggcaacacccctccttgctgagaaaacttaaaagtcaggtctagttcatctttaaccatcatcatatgtggtatcctgtttatcatttttattttaaaatttttgtgaatacatagtaggcatatatatttatgggtgacatgagatatttttatacaggcatgcagtgcacaatcacatcatggcaaatggggtatctatcacctcaagcatttgtcctttgtgctacaaacaatccaattatgtacttttagttattttacaatgtacaattaaattacttttgactgtagtcactctgttgtactaccaaatactagggtcttatactttttttttttttttttgagaaagggtctggccctctcacctagactggagtgcagtagcactaccttggctcactgcaacctccacctcccagctcaagccatcctccctcctcagccttccaagtagctgggactacaggcacacaccaccacgcttggctcttttttgcaatttttatagagatggaattttgccatgttgcccaggctggtcttaaactcctgagctcaagtcatctgcccactttgacctcccaaagtgctgggattacagacatgtgccatgcaccctgcctttattcattcttcctttttttttttttttggtgcattttaaccattcccactaccctccaccccctgcactccctcactacccttcccagcctctggtaacaatttttctactttcgatctccatgaactcaattattttaatttttagctttcacaaatcagtgagaacatgagaaatttgtctttctgtgcccagcttattttagctaacataattacctccagttccatccatgttgttgcaaatgacaggctctcattcttttttatggctgaacagtactccgttgcgtgtacatactccattgtgtatgtattttctatttctattcatctgttgatggacacttaggttgcttccaaatcttggctattgtgaatagtgctgcaataaacatgggcgtgcagatgtctctttgatatacttcttttcttttgggtatatacctagcagtgggcttgctggatagcatggtagctctattttcagtttttcgaggaacctccagactgctctctgtggtggttacattcccaccaacagtgtaagagggttcccttttctccaaatcctggttagaatttgttattgcctaacttctggataaaagctattttaactaaggtgagatgatatctcattctggtttggatttaaatttctctgatgatcagtgatgttgaggactttttcacataccggtttgccatttgtatgtcttcttttgagaaatgtctattcagttcttttgcctatttttagttggattattagattttttttttccttagagagttgtttgagctcattatatattccggttattaatcccttgtcagatggagagtttgtcaatacattctcccattctgtgggttgtctcttcactttgctgattgtttcttttgctgtgcggaagcttttcaacttgatgtgatcccagttgtctatttttgccttggttgcctgtgcttgtggggtattactcaagaaatttttgcacagttcaatgtcccggagagtttccctaatgtatttttttttagtagtttcatagtttgaggtcttagatttaagtctttaattcattttgatttgatttttgtatatggcgagagataggggcctagtttcattcttttgcatatggctatctgattttcccagcatcatttattgaagagactattattcctccaatgtacgttcttagcacctttgtcaaaaatcagttcactgtagatgtatggatttatctctgggttctatattgtgttccactgatctatgtgcctgattttttcccagcaccatgccgttttggtgattatatctctgtagtataatttaaagtcagataatgtgattcttccagttttgttctttttacttaggatagctttggctgttctgagtcttttgtagttccacatacattttaggatttttttttaaatttctgtgaagaatatcattattttgatagagattgcattgaatcctttgattactttgggcagtatggacatactgttaaatatttaacaatatttaacactattgattcccccaatccatgaacatggaatctctgttaatcattttatttctttttatttatttattatttttttgagatgaagtcttgctctttcgcccaggatagagtgcaacggcacgatctcggctcactgcgacttctgtaccccgggttcaagcgattctcctgtctcagcctcccgattagatgggattacaggtgcatgccaccacacccgtctagttttctttttgaatttttaatagatatggggtttcaccatattggccaggctgatcttgaactcctgacctgaagtgatccacccacctcagcctcccaaagtgttgggattataggcatgagccaccaccgcacctggccctgttaatcattttaaatgtgtatttgttcagtaattaaatagaggcaaagtttttttgttagtactgtggtgctatgcacagtaacatgtcagaacaaacataagtgaatagttgaaattttatatttcggttttaagtagattctaatctgtaggagtaagtcttcgcagacaggtagcatggaaatgaaataccaattcagtatctatgtataaaaccgtaggttccattgaattgcttcattttatatttagatggatgcgccataggaagagtattttgtttccctgtatttaggttattaaaattgagttacgtctgctcataaacctgaggaaaccacaaaactcagaagagaaagcactaaggtacctaaaaacatgtttaagtgttactatctgggacaaatattgggacatatagctcaaaataatatatagctcattgttttgatcaagtatgagatttgttcgtgttacaacaaagcttcaatgagtggcagagttgcaagactaaagaagttaagaaaggactcagagggatgtggaatccatgtcctggcacactctggctttgataaatattacatgattgcagtgatacctttttgtgagacataattcattgtttcaataattaatggcaccagtgcatgtttctaagagtaccaaaggtaaataatttactgtaattaccaaagaggaatgatattatttatttatgagaactttttttaaaaaaatgaacctttgtgaaaaataaccttaggctccccagtgtaggaactgtagcttgccctccactccactcatgccaaaaaaattaaaggaacatcactactttgtattaagtgttttgccctactctgaaggtttgttggtttgggtctccaaaagtcagtataagttgttaaatgaggccagactgaaaccaacacctcatatttggttaatccatatagaatttgggaactttcctaaatggtttattgcttttgacgggttagaatcttggttccgtagattcttattagaagcttaattgcacacccattcactagatgtgtcctcgctcattaaatgcagataaagctgttcctcattcatgtttgcattttcctaggatgtgggtgagatagtgacttgcatgtaattgctctacaaatttatttttcaatttgacttcagggctattttttaaaaatctgtgtaattcagagtaagtttttaaatttagattttattattaccaaagttatgcaattaaataaaaagccacatcattctacaagacacacttgttaggaaaaaacataatccccatatacaccttcagtccccaagttctgctttccagagacgagtgcttggaataatttttgataactcgtatgatgtgcttggatatctctaaatactgcatgtatattgttcttgttgatttttctccatttcaggaattatttattgacttccccaaatgaaagatgaagcttttttttccacacttttcctccctatgcacacttcgtatcctcccatttccgcaaacagttgtaatttattttgcttatatctgtatttgatgcttatcttgttatgcctgtgtaaatgttactcacatatgtggcttatattatgattgctttttctttcttttttttgagacggagtcttgctctgtcacccaggctggagtgcagtggcgcaatctcggctcactgcaacctccgcctcccgggttcaggcgattctcctgcctcagcctcccaactgggattacaggtacgtgccaccacgcccagctaattttttgtatttttagtagagaaggggtttcaccatgttggccaggctggtctcaaactcctgacctcaagtgatctacctgcctcagcctcccaaagtgctgggattagtcatgagccaccgtgcctgacctgattgctttttctttccagcacaatattttattttccctggagttttttcacttgcttgatgtcctctgtgcatatcaatagtccaaccccaaaactctcccccagttgtacaaatctctcaatgtgttcacattcattaggtgatctatgtgtctcgtctacttacctcatctcgcttagagctttcttacttgtcatattccttgtaggtccactgcacacagatgtgctcttgggtcttccttcatcataaccatgaaaattccctttgttttctcttgtgttggagtccatgccctcccttttcttgggtcagtccttcactttggtggagtacatcttccattagtttcctcagagagtgcatgagaaatatgttttttaaggtgttatatatctgaaaatatctgtctagtttatacttgtttttaatttagctggttatagaattctgacttgaagtcatttcctgtcagcatgttaaaggaattgctctattgccttttaccttcacgttttgctgttaaaagtctgacacagaccctccatctgtgaccattttttctctccatgtttatagaccctgtctttgtctccgaattctgaaatgttacgatgatgtaccataatgggttctgtattcatagtgttggtcactcactgggtcattttacgctggcaacctctgtctttggctctggaaaagtttcttaaattgtttccttgatttattttcctttgttcacaattttttttctttctaggacttctttttttttagactgaggggaggatttgaacctcctgaacttatcttttgctttcttgtattttctctcctattttctagagttaaaaatttctctatactttctaaggtttttttcaatatatttgttacttctaagagttatttttccctaaatgtttcttttttttttaataagtagtctattgtttcataggtgtaaaaatatctcatctctctctagatattaatgaataattttaagttttcttctccctgaaaagcctgtttcctgcaatttgctttccttctgtttgcttgtttgttttgtttttatactggatgcttttttcagcagtctagtgacggtcagctgtctactcattaataagctcattggaagctctctgtatggtgtagaggttgttatccatgatttccactgaagtaataagccagaacatttcactgggaaattccaatgggcaggtcagaatcctcagagacttcccattttttgcctagaactctgtccccagctgtgtctgggagaccagtaaaggaagggtgcgattctgaatattcagtgtacaatccccattttcaatatggtgcctctagccttctagtctcctgcctgtagtcttctgctagggttggtggtagtgatggcaggggatcattatttgacaactgaggggattatgaaggtcaaatcactttttaaagagaattctagccaatccttctgtttttctgctgatgtgttttctcttattctctctgtcctttctgtgtctgtatttttaactatgtgactgtcatttcactgaggtttcagtaggcagcagattgtgggggatctgtgggctaataccttttatcacattggcacattcatagccattatcttttcaaatacagcttctactttattctcttcttctcttctatttctaagggtccaatttacacctatgttaaaatctctcaatgttccacatcttgtactgttttctttcttttttttaacctatccttcattttgtatatttttccatttagggctctaacttaaccctcttttatattgtgtctaagtaaagaactgacattgtatttagcactgaaccaatgcccatttgattccttcttatgtatattctagcattctatcccatttaatttattttctctatctttccctgtgtttttgtaaacatactaatcatagttattataaagcacttattagcttacctcagaatcgggatggcctgggagtctatttatagtgtctctctagcttggtttggttttatttcatttttctggttttatccacacactctgaccatgcttggcaatttttcactttatgctagacatggtgtataaaaaattgtggacacacccgatggtgatatattccttcacagaatgtttgccctccctctgctaggcaaatagaatagtaaattttaattcaattaagattttgctgaaatgaggctggtctgcagccctggtgaaagctcacactacctctggtttccccccagcacaccagcatccttatttaaaatcgttgtatgatcttcaaatctcttcccattataagttctaaacttttaagtcattttctcattactgccaaaaatctccattatgctcttcagagatatttctggttaggttttgagcttcctgttctgcacagcttcggaattcagcaaatgttcttagcaggaaactgtagcatgcttgaggccacccaaatctccaccaaaactctcctggcttttctgttcaacaacagtgacccctgtaggttaaaagtacaaatctgtttgcactggtaactgacaaaagcctgtaagttaaaaatgggcaacagaaagtcaactcaactcctgaagatgttcaccctcccagagtttggtagttcttttagttctcgatgcttcaaccgccctctgctgcattcagatacaattgctgtattttatctggcttacttggaagaagcactaggctgctactagctactccgccccacttggaaccagaagtcatcaagattgaatttttcattttttattttgagaattgggaaaaaaaattacagttgttataggattaatttgaagacatgttgaaaatgtgacatgtgcttaaaatcatagttggagttagttatgtgatatttctttgccatgtcagttacccagggagctttcttaaaagattgaaataaaacaatacatcaatagactttgttttctaacattacactcagatttcaatgtatttctatagaggagaatttaaaaattatttatgttgaatgtaagtctatctggaattagaggaatacaaatatattttatatgtgtagagaaatcagtcttgtatggtttgttgatgtaatttaatttaccattttatttttcagcatctaacattcacaagggaatttgattcagattctcttagacattacagctgggctgcagacaccttagacaatgtcaatcttgtttcaagccccattcattctgggtaagtaacctaaatgtcacttttcattatcctactacatgaacagtgcatttattacttagagttataaattcacatcaacaagcttcatatatatgaatacattcatgtatgaaatgtatattcattagtatatgtgagatgtatttgtaaatcattgtttttttctaagtaattctgtatgagttttttttttgagaaaaatttaattttgttagaaaaataatgaaattactagtacaacaaactttcctggctgttctaatcttctaggtctttaattttccttttcagaaaatttcctttgtaagttttttaaaatttgaaacataatgatttttctccgttttacttttctattcaaatgaagtttttctaggtatctgatttttctttccaatagaaaattaaatatgtaagtatgcctgttaatttaccttaactgacttttgtgcttcccttaataatagaagaatttctctcaaatatttagtagttgtttttgttttttgtttttgactgggtctggctctgtcagccaggctggagtgcagtggtgcagtcttagcttactgaaacctctacctcctgggcccaagccattctcccacctcagtttcttgagcacctgggaccacaggtgtgcaccaccatgctcggataatttttgtattttttcatagagatgaagtctcgccatgttgcctaggctgttctcaaactcctgagcttaagcaatctgcccgcctttgcctcccaaactgctgggattacaggcatgagccgccacacctagcaaatatttagtttttaaatgagcagtaagctctggtattgtcatttttttctcatatgatacaggtctttgatttgataaatgatttgtgtgattttccttttaaaagaatatataaatttgaactttcgagttggtgcctctgcatttctgaaataaaattacaattaagttgtattaaattgtaattttaaaaaatgaataaaaagaataaagatatttacttaaaaaaaaaacataccagtgtctacactggaagtgctgtggttaaaaaccacaccgagtagcctcctcatcctgcctccctggtcaatggaattcgaggcaggaggctaaaaggggacctgcttcaattactgaattaataaattagtgtatctttagatactggattcttcatctttgggtaattcaaatttgggataattgacatccatataagtagaatcaaaataattcattaaaatgatgaatatctcaaggtatttttgcctttgaaattggcatttaggccataagttaattgtgatcaaggacaagggcagattattttggaattaaataaattaacaacaattaacttttgtgaagtgcttcatatattatatgaagtatttgctgctgctcctaattaaaataaattgtaatagctaacgtttacttacttcttgtcgtgtacctggcattgtgctaaatcttttacatgtattgtctcatttatatttacttgaaccttataatgatactgtgagatacgtattactcattatcctcattttacaaataaaaaatcagactcagaggaatgcttcaggttaaaataccgttatagattttggctttgtaatactacaattctgagaaacagaacaatatcgttcaaatgggaataattgacatgaaagtgtttcataaattataaactttatggtggcttttgagttagtaacattgcatttctttaactcaattagagaaaccttgaattattataattttaaactgctaaaaatatttatataatttatattcaatgcatatgggtctaatattggaaaagcaaaagaaaaaatcagattcaagaaggaaactatataacatctgggatacattcagggagcaaagatgttgaagagttttttgaatcacgcttgatgaattgccgccatatttcaaagacctgaaaccatcactttgtattctctacaaatcaaagacaaggtactagggcttaatttagtaaactgagaagttgaagaaacatgataacaaaatcagaaatgaactttcccatacattaaaaacaatgaagtatttgagtatgcaagttatctccccttcaccttgaatgttattgaagacaagagagacaatagacatgtgcaggaaagcaaaagtaatggcagcaggtgtgggcttatttgaaaaggaaaatatagacctggtgtgcacttagaaatatttcactgatgccaggtccttgcagtttatgcagctacataaggcagatatttttctaggttgtcccacaaatgccagatgccctggtttcattttctgatggtttttatttttcctttgcttgtcattgacattttctgttgcttgcttctaattatattacattaattcttcccatttgctttctaaattattttgcagctattcttctccacttcctcagtatgattcaaggtgataactgtgtcctttatgtgaaccatcctttttgtatttttaatttatgtgaatttttgccatagttagatcgtgtcaatgtctgtagtatatcagcatttgtcatcctgctgttcctaaaactagaaacattcatgtattagttttaggatcatttgtagaatttgtgctatagtttaaatattaatgatacaaatattattatatatcacctttttaatttgttctataagttatgttgcatgactttttcacacaatatgtaagacatgagtttgtaaaacaaatcactatattttataatgttattaaataataggacccatgtcctgtttaatgaatagtcccacttttcctcagtctgttgactctatgaagttgagaacctcagaacaataaatggttgctggtgagcaccagccatgtactgtgtgctatacagaacacagagaaagagactcttccagtttgttgttaatatcatgttaactagtgttttttccattggttctgatattctttacagctgagatatttttattttaatctgataaactgtacgctaccttcagtccactcagctccaatcagctatctacctatctatccacccatcaatccattagtattagtaaccgagtctcacctacacagtttctaagcaaaatagttttattcattggttcattcagtaagcatttatcacgtccctattttgtgctagaattgtgcttggctctgcaggtcaatcagtgaacaagacagacccaatcagaattactctctatattgttgagactcagcggttgccagggcaaacattcccctctcagtggaaacattccagtgtgtgtgtatgtgtgtatgtgtgtactgacacaactgaatcttcaagcccagagtttgtcgtgaatcgttttaaatccattctgttactattattcctaatgaaaaattgatttttgtagttacaactacgaagtgcagggaatgatttgatttttgtcttataatattgccatattgccttcattattgaataaaagtagttgttaaatatacgtatgtctaagaaaatgtaggcagcccagagcaatttcaggtgagcctcatgtcttttagcattggtaacaattcatcccgacacttgtacaagtgaacaagtatctttttctttgactagggaggagtgatttttgttttctttttgtttttgagagagtcagtgttttccccttttaccttgattatcgtagtggtcccaatctcccaaaatcgatagaatgttgtaagagacataaattcattcagagtaaaatggttaaatccaaaatgagcaaaagggtatgaagacgagtccaccttactgatgagcagagttggttctaggaatctgataggctgaaaaatgatcgccagcccattgcctctgcctgtggggatcacaggccagtttgcttgaaaaggtcactctttcaaggtcaagaggtagcattcttcagaagacggtccccagctaggaagtccatgcaaggtcttaaaatctgtttgcaggatgttagcattgtttttaggggaaaaaatagtaaagatttttgatggatgggactttttttttctaaaaacactttaagaattccgacaattttctaattatcaccattttgtactgtgctagtagtaatctgtgtattttcatacgtggaaactagaatacagggatatatttgtgttcccctgtctgaccttaactcttccacacattgaactcattgatttatgtttacttataactctgtgataacgataactgtgttataactctgtgatgatgatagtgggaccatgcatatgtgatagaagacagtgattccaatatgcttctacccaaaaataacagttaatttctttatagttctatacctattaatacatgcagacagttttttccttattagctttaataaaaggccaatgacagaattatgttatttagagccattttctaaaagtctaagttccacttttttaatcattgtataaaatattcaaatgtaggttatttcagacagcttttaagcccatatttatactgaaaacatttaatctctttccatcaaaatcaccgtagcaaatctagtcatctcctgcttttattcttatattctgcttcatcatagtaaaaattagtgttggtatgattaaaaatacatttattttatgagtcgtaaatatcaagacatactgtggagtttcatcttacttgtaagagaccatatggcagcatatggcaaaaaccacttatagttaaaatgacctttgaatataaagaccacagtttttttgttttaaatgcatgagaatcctgttactagaccgattttactccagttttgaaaccttccttattccttccatttgagcctggtaaagtagttggcttttctatgggggccatgttccaccaaaaacaagttgtgtttcagtttttgcaaagtgcacaagttaaatgcatgtttgatgtgactccactgtattgacttctgatttatctttagaggaaatgatagctacattgtctgtcgctttaaataaacttaaacatttaatttccaaacttgctgtgagcacagtttatttccgtccttgaattggcctctgatcttctcccctcaggtttctggttagctttatggtggacgcgagagggggctccatgagaggaagccgtcatcacgggatgagaatcatcattcctccacgcaagtgtactgcccccactcgaatcacctgccgtttggtaaagagacataaactggccaacccaccccccatggtggaaggagagggattagccagtaggctggtagaaatgggtcctgcaggggcacaatttttagggtaagttgttttgtcaattttaaccttggccctcacaatgcatctttgattttctttacccttgttaactcaaggagataactcttaaaactgcttagttgtacctgattgagtatactttttgtaaagtgtcaaaggtcacaaagctgtgtgattctgtgaaaggctaataggctgatactttcttaactcagtttgctagtcaaggcttttactaaccgagaagcatgttctctgctcagcaagtgcacggaaccccagtggtccctgtagaagtcaaggcaccattctagggaaaaaatacagatgctggaattattttaccgcattgaatatatggctactttggggacatgtctttttaaggaaaattttttgggaaacagttcattgtgatatggtattttacaaaaaggaaaaatgaatttaattcattttctgaggtggcacttgggtacaaatcaggcaggctctgtcgtgactgacagtttgttcacaatttccccttctcgtttctctttctgctgcatggatgttattcagtaaactgcatcttcctaccaatcctccccctgtaaatgagggtgagagcttggttagccgaatcctgcagcttgggcctcaaggaacaaaatttattgggtaggacctttatagacaagatacagaatgtctacaatttttttttttccattttcaatttttttctgtcacacccatggtctgattcttgtcttaagtttatttttattttttaagttttttttaatgctttcagttgatgtgtgtcactgaaagaaaaaaaaatcatagtggcttgacttaatgtagcaccgctacctatcttgtgcttttcaggcatgtggaattcactgcaagcattctgctttcataacttcgtgcttttgtaaacctttcttttatttgaaatgtttcttctgaatatgatactttttaagacagcaaaagtctttaacccagtgtaagagaaggtatttgcaggctttgagtcaacatttgctatcaattacatgtatgtacacctgtgtgtgtgtgtgcgcgtgcgcatgtgtgtgtgtgtgtaattagatcttttaaaagtacatgagtactgtgtaattttttatgggctttgagaagaagtcatcaataagtaaactgattttgaaaagtgttgggaaaataagatatttaaataaaattaaataggcagcagatagagtattcttttaaagttataaaattgtttcgtttggttttgtttgagctgaaatgcattggtatttgttgtttgttcacttgtctgtttgattgttgtatttgccttggcagtctgcatgaagaaacctgttaatgaaaagctatgcttggctttcaccttgatcaaagacccttgttcataccttctctccaatatcattgaacatcatacataaagccacattccttaaatatttacagagacagtatctgacatattaacctgcaaagattgtatcttgttctcaaaaataaatacaatttaatgtttaattataaggtgtagttaaaaactctggtaaatatcttaatcttgaaattattaatactgctaagaacacttgattttgtttctacctattgaagaataaaggcattataaaaattattttttaatctttaatttgaatgaattatgattttgctaaaagcaaaatgaccatatttatcatccccgtttgaagcaaatgcttttctaataaatcgatattcatgtttttatttatattatttgatcattacaactactatccctttttctgctcttacttacttaagcctgtatcttctgttatcacatatacctaaacacataggttaagaaatggggttccatacaacctctgtaggagaataatgatactgtctacttaaatgtcataaaataaagctgcacaatccaactacataaactgtgtgtgattgtggtctgcttacttccattcatctcttttagtatttatcctattttaaaatttaacaaaattatttcccgtggcttgattggctatgttcaatttgcagccattcttttacattcctttgcaaaaggacactgtcaaaaattactgtgtcattatgtgacaatttcaaaccaacaagtacttttacagaaagtgtaagtattcctatgcaggttatattagagccaggaatggaagctacctactaccatttcacaaattgaaaaacacaggaattgtcttaactgtacaggccatgaaaagcatggaatctgcctgttggaggagtcgttaacatattgattgttttcttgctaaggagaaaatatagcaatcatctttcaaactaggaactttatagaatttttttttaaagaaatgactgtgtccttttaaatcattagcatttgtataatatacctattgtgtcttttaaaaatggaccaactttcttatggtctactttaataagtttccattctgattcaaaattcctatttatatgtactgaaaaatttcccccattaaatcctatgcctaacatatggtagtcctccaagaactgtttgtgaatgaatgaatgatggcatgttttcaggcttcgaaaatattctttaattagcaaatgattctgcagctttgaaatcattcccaaccttagtggcacctctgattttcaaatgaatactgttaacgaaacattttttaagtatgatactataaatatatttaatttgataccaaaataatgtggattttttttccagccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaaggtaataatgatggctccttggttctgtaaatgtctgcaggcagaaattaaaggaatgactagattacatgaaacaggacctgaatttcacacatttgtattttaagctaggacccaagttcttcagcttttgttgctgttttctatatcataatgctgaagttccatttaatctaacaaactttattctccgtaatatagaagtataagtattttgatgattccatctttaatcacatacatcaatctttccaataccaaagaaagttttctaagtcaaaaatgagcaagaagagggtgaaataataatggaaagtatgcaaggcatgctgagcattttgaagaaaatatgttcacattttatttttggaattatttctggactctttcagctttttcaagtttctcccagataatttcagtatccttcataaatttttgatttctcttgggccataattagtctttaaaaaatgtttcagggtaattattggggtctgtgttgtttcaatgtctcattctttgacctagtaagactggtatatatctgagcatgtcactttttcatacacaacttcttcaggctgtctgaccctaagaaccagagcaatttttcttagtagacattgggaatagtctggttttgagaataggtgtttgacgcagagttttcctttaaaaatgtaaaaaaaaaaaaattagagaacaggctcaccataacgtctgatgctgagagaaaaatatcagagctaattcttcctttatactcacttcctaatcactccaaatccaggaattatttaaacaacagctttattcgagatataattcatattccataagatccactctttttcaattcactgacttttggaatgcactcagcatagtctccagtgagtttcaaggtgtgaacaaaggagcgaggtgaaccgtagggtacttgaggaatgaccttgggcaaatttattgaactctgtgagcctgtctttcttctgcaaaatggagattaccttcctaacttcctatggttattgttgagaataaataaaataattatgtgaggcacatgtgaaatacagtccttgttacatagtaagcccttgataattatgagttattatcaccattatatttgttctgtagaaaaaattgtcatgccaaaggtttggtataagacacaatcgccaccaaccatgaatttaaagatgtctttacagcaaggtagagggagaatagtaattgttgagtgtctagcattcatgaagcactgataaatgccttcatatgtgaaaaatttaaaaagaaaggatagcactgcaaatcaggtggttttaattccactttactgataagggtgctaatcaggtggttttaattccacttataaggaaactgaagttcagagatgtcaagtaacatatctaaggttattccactgagtagtaaggctggggtccaaatgtaggtctacttcttttcttttcttttcttttcttttctttctttctttgtttcttttttttttttttttttttttttttgagatggagtctcactctgtcacccaggctggagtgccgtggcacaatctcagctcactgcaacgtccgcctcctgggttcaagcaattctcctccctcagcctaaactaaggctcagagagattgagtgccaaactcaaacctacacgtgtaggtttgttatataggtaaacttgtattgcaggtgtttattatacaaattattctttcacccaggttcaaagcctagtacctactagttactttttgtgatcctctcactcctcctaccctccaccttcaagtaggccccagtgtctgttgtctttgtgtccacaagttctcatttagctcccacttataagtgagaatatgcagtatttggttttctgttcctgcattagtttgctaaggataatggcctccagctccatccatgttcctgcaaaagacaggatctcattcttttttatggctgcatagttttccaaggtgtaaagaaacaatgatgtaatcttctgtcttggattctatgtgttattttggaaaaactggatagcatttccttgccacatttttaaagaccagataaactttggttccattttagacaattcaaaggaaatgcatatacttccaggcttaaagaatcaagtactggagtccactagagcaaaaatgaggatggaattttcaaggcacagattttcttcatgtattaaacttaatagtaatgaagcaaccactacacacattttataattgaagctcagttaatcaaattgtatgccaaactcgaacccttctcgccactcttttcatatccccaaaaacacttcattcttaccagaactttcctctcttcaaaagcagaccagccaaaaaaaaaacccaaatctgtctttttaaaaagccaacttcttccttgaagggacaactgttcaaagttctagttcagagagaagcataagcacagtttaggaggtttcatgttttttatgttcttttatcctctctgttcccctcccattttgctactgaataactgttaattaacaagataaaaatagttcctgaattaaaccagtgaccaggtcactcaaggtttccttaaaaaagacaaataggccgggtgcagtgtggttcacgcctgtaatcccagcactttgggaggccgaggcaagtggatcacgaagtcaagagatggagaccatcctggccaacatggtgaaacccccgtctctactaaaaatacaaaaattagctgggcgtggtggcatgtgcttgtagtcccagctactcgggaggctgaggcaagagaatcacttgaacccgggaggcgcaggttgcagtgagccaagatcgcgccactgcactccagcctgacgacagcaagactttgtctcagaaaaaaaaaaataaattgtcttaccattatttaatataacgtattaatttcataacaattaagctttatctgtcatctgtggcaagtgacccttgataatgtctgtcttgttataaatgtttactttttcaacccccttctccatagatgaattctatgtgctactttataaccaatctacatgccacttttataaccagtcctgttgtaggttcttctctgaaaatcttaaaactcaagtatttaaaaatcatcttagcaaatattctgatttattaacacaattgtaaatatcagtttatgttcctatagtgtgttaaaatgtgtgaagcctttccatgtacgcaatcaaatttaactagtagaataactcctgggaaagagaagtttaaggagcaggataatttgccccatgtaatgtggtggttgggatcatgatttatggaagttacacagactagacttctcatcttggctccaccgcttactcgttgtgtgaccgtaatgaagcactcaatctctgagccttggtttaaatgtgtaaagtgaggatgcctaatagtgaactaataaggaatagatgagctaatatatgtaaagctcctagcttgatgcctgatatatgagaatcactcaatcagtgtttagtcatagtcacaactgccgtgtaagttgtgcaggagagcaaatggggtctgaaatcttgcccttttcacttgtcaagccatctgccctgacactggcctgtaagacataggggtactttcttctaatttgctcaaagctgctatctagttgccaacctgtgtacctacaaggttgtatacaccccaagtgggcacccttttccaaatcgtacaaagacactacatcagctagtaaaagccctggtcatcgttgattatgatgacacacactcaacatcgccaccacccggaaacagtaaatagatttagtcttccaaacctggacttctgactccacacctagttgtctctctgcactgctcctttgcctctgtatgctctcaaatgaatgatgcctgtgaaagtgctttgtgtagaacaaaagagccacatatatgtcagctggtatttaagttgtccgttactaatgaagacacctcttagtttctttgtatgacacaaaaaatatggtatgtattcaggaaaaactgtagctgcaaaataagggggaattaaaagttactccttatcaccagcaagcccagggactgaaatatcagtggttttgctaacgaagtaggtgtattagcaaaggtctattgaagaggctagaatcacagaaaggacagttggtctgggtgtgaagaacttgccatcaccactaaggtatcatgcaacaagaacaactttaactttggcagcagacatagattttgttctagtctttgtcaatttttgttttctcagccaagaaaaagatgctgcaaacagaaaacaaacattcattccccccaccaaattataacgcagcgaactgaattaactttttaagtttaatgaaaaccttcctttaattaaactcacaaagtttaattaaacatgtttaaagttacatctccaaagtcagaccccaaagagtgttttgtagtttgctgttatcttggatctggaattttctagtagaagaggtccttaatttacaaaccaaaagctccagaaatgttctagtcctgccctgtcccatacagtagccactagctccagggaacaacagagcacttgaaataaaattagtacaaatggaaatatgctgcaaatgtaaaatacaccagatacgcgaggatgagtaccctcctccaaatacatatctcattattaatttttacattggttacacattgaaatggtaatattttggatatattaatctaaataaaatgtacctataatcccagctactcaggaggctgaggtggggggattgcttgaggtcaagatttcaggagctcagcctgggcaacatagactccatctctaaaaaacaaataaaaaattaatttcacctgtttatttttattttttagtgtggctataggaaatttaaaattacatacccagtttacattatatttttactggacagtgcctctctggacagtgtgtatgctttgttttacatatctattttgttttaacacaaaaattgttgctacctaagtattacacggaaggctttgagtatatatgaattatgccattatttaaaaatcccaatcgctgtcttggaacaaaatgttgctgaagttcccccaaacaattttacaatgctaggaacatattttcttgtcattgctgaactttcaaatgagagcaaatgaagtttttaagataatacattttagattgaatagttacactattgttttattgtaaacaggaaagggaaattggtacttgctatgtaacagaaaattttttaaatttactgtctgactacataaacagtatcttagaaacagacttctcagaagttgccaattgggttcatttcaatataatttaattgtttttgccatgagaccaatagtgttaagtcattgtagaagcagttgagcactgatgtgaaatgtgtagctttatgttgtgcacagcaccatctgctggagaaatctagtaacagttttgaaaaattcccaaggagagaataaaaatagaatttaaccaaatcaggactgtggttggggtgcaaaaaaaaaaaaaaaaaaaaaaccatagcaaaatactgactttcagcctattgccataaactggcattttaaatcaattgaatgatgtccatcgtgttggaaaggaaaggaaactgtagcagaacagtcccccaaactagtagaaataaaaattctagtttagaaatgaaaattaggacaaagcaaataagcattaataaggacaggtttttaatgcatttgcatatatggatttgccagaaattacatgtctttatgaaacattagtggatcaaaataatgacataagccatcctgccccccaccccccatatcaggcacagtagagcttttagccctctgagggcagtgaagcaggtccacgaggttggacatcagcctccactacctttagtgttgatgtgaacagagagaccagtgtgccagaaactgcaggtctaagcttttggagtttagtgtgttctgtatttgctgctcatgcgaggttattgattcattgtgtttaagacactatttatgatcctggattttgaagatagaatcatattaattgatttttcccttagatgtaacagtaatggcttaaacaatggggtgaaaaaagtgacatatagggactaattgcctgaaaccatgtttttatttgcacaaatggaaaagtaaacaaatgtaagtctcttaatctgcagtcatggaagaaaaccttagaaggattattccagtgtggccagacgtcccctacttctcttcctccaggaagccctccctaatccccagactcagatcaaactggtaaatacacccacagtaccataactgcaactttgaactttgatatcttccttggtgcactgcaaaagtccaagagggcagagaccaactctgacttgttgacagccattatgcccactgcatataacaactcttgatacagagttgtcagttcatcatagtctgttgcatgaacggagaaatgaatgacttgtgtcaggcatatgccccccctgctggtgacactttttctcaatccagtgacccatacccaagagagagaaaaactttctggaagaagggaggctacaccaaatggagagaggaagtctggggcctggggaaggctctggggcaggttatggtcattctacacacagagtacaaagtaatcttaaatgtcaacactgaaggtagagttcaaaaaatggtcacatttgtccctgatttttaaagtaatatctcataagcacataatgattaaaaattaatcttctaaaaatagctttaaaaatatatgattgtcagaaattatattaatagactgctaaaactggagggaaaaacaagcaggtatatcattgtttccagacattctgcatcatcagcacttattacacgtgcaaatctaaacagcaaagaggatctctaccctgaataaagatgtgaaataatgctgacccaaatatatataaaccagatgacagaattggataagaatatgagttaaacactaaaattataaaaggtgcatggagcctttcgtactatctttgccatgccccatgaatttataattattttaaaataaatgttttttaaaacattgaaaagatctctatgatgttaacttcaaggaagaaggatcaagttatatcatttgaggatttttccctataacatcttatgtgaacttattatgaaatttgtgtattttgatggagctgaactttaattccaaagggataaatgcctgtagttttctaaactagttcagtaaatatattacaatgctatgttgttctacatattctataactagagttgaatattatagatttattttttattttcttcatttctcccaacttatttgatatttaattttcagtaattggtgattttctttaatggaatgaaatggaaatgatagcaattcatatttatattttgtagagaattatttttaaaatataacttgtgtattttcttagatctgctacagattgactctctggctgccctcaaaagctgtgtgacctcgaaaagaatatataactcttctaagttattatgtgaacagaattgtgctgggtggttttctgtcatttttttttgtcatatccatcccagaggaaactgctcatcctaatcacatagatgaggaacatatggctcagagaagttcaggaacttgcctgaggtccaggtgcactgactatagagctatatttcaaccctgggcacctgtctacagtgacttaccacagaccccataacttgctttttgaaatctaacattctaaaaatcctttactttttcacctctcaatatcaaataccccattcttagaggagctgagaaaagcctgcacctgactagaaattaaccctgatacacaaatcatcctttgggaaaccttgaggccatttgtattccttccatggactattcacactccaccctgaccaggtcacaagtagcctttgaaatctaaattgatacaggaaacagagctgtgtccccatttaacgaagtgatcgagacatttaattgtgtgcccataagagtgaggcaaaaactaatcaagatggtcatttgaaagcattaagagtaacccatttagtcagaacatgatttcagtcatgttatttatgcttcattgtattatggtctccataaccatttatatttgcaaagcattttatgattcttgttgtttgtaacaaagcctcagtcacagagaatgctgtcccaccttttacaaataaactgagttacaaggtgcttaagaaatttatcatttatctatgaggcaagaaggctatagaacattagtggctctgtaatcaggcctgctgcttagatgggtcaatgagaagtcaggtcaccttttcgaccacggcatttgcaaatctattcattactcatccgtttatcaaccaccactcgtgtgaggtagtctgcaaagacactgttaaagagtggttgaagtccatgtctgtgtgacttcatctctttccaacacccctttcctagacctaggttctaagctctaaaactgacgagctaaatccatctggacaagtcacttcacctctctgaacttcagacacctattttaccaaaatgctgtgtgggccaaatgataattgacctgacacaaaatagaccttcagtaagtgtaaagttcaatcttcctcctggccaaaactgcctatttcagaactcacttctcttttccctctaatcctctttttgtatgtgagaatttagtaacagattttaaaaagagagaggagagaggaatttcagggtcttttcatagtctatggcattatgaatcaccctgaaaggtaagaagctcttatgtttatgttctattgtttactttacagcaacttatgccatttttctccctcaattctgtagctgtggagttatttagaatatccttttaaaaaacaaaaccatataaaagtaatgaatatttatttttgccaataagcttttcttctcatattaaaccattcttattttttatagggtcctgttgtcatgtttttaacaatttgggttctgaatttttaagacaaagtacaggatgagagtctaccaagacattactttttcaaatgtgtcaaaaagtcacctgggtagagtgtgaaaacagatttttaggtttcactccaggtctgcctagtcagaagcccagcaatctgtggtactaacatgtagtacgattgtttcttacgaactggccaggttggaggacattgcattaggagctaggaactctgcagatgtgaatgtgatagtggcattgcatttgtgccgcagattattttgtcgagcttttttctgtaatgtataggatgggacaaaacaaaggattcttggtaatatattgctgcttctttgacctaattagtaaggaccgtttttaaaatctaaatacatataagttcaatcccagaaagaatattggcactgttcatttttacattatcaggctttattactatttgtctggaaatctgacttctctgatatacttttatcttattttattttatttctttctttatttttgagatggagtctcgctgtgtcacccaggctgcagtgcagtggcatgatcttggctcactgcaatctccacctcccgggttctagtgattctcctgcctcagcctcccgatagctgggattacaggcacctaccgacacacctggctaatttttgtatttttagtagagacagggtttcaccatgttggccacactggtcttgaactcctgatctcaggtgatccacccaccccagccttccaaaatgctgggattacaggcatgagccactgtacccggcctctgatatacttttaaaatatgtaatacaaaacttccagaaagaggtttatattcttatgaaagttaaactcattttgtgtaaatgttcattaagtaaacagtaatttgagttataaacacatggacataatagatttcactgtggattaaaaagtaggaagattagaaccactttttcacatgcattttttttaataaaaataaaactaggccaggcacagcggctcacgcctgtaatccaaatactttgagaggttgaggcagaggattgcttgaggccaggagttcaagaccagcctgggcaatatagcaagggccagtctctacaaaaaaagtttagaaattagcagggcgtggtgatgtacatctgtagtgtcagctactcaggaggctgaagtgggaggattgcttgagcccagaagttcaaggctggaatgagctatgatcataccactgcattccagccaaagtgacaaagtgaaacctcgtatctaataaaataaagtaatctaaaagaacaaacaataaccagtctctactagtacgtatattttatagcaagacttaaagaactgtacagttgtttgatgtgaaaagtgtctgagtctcattgattcccagctgatttctttggtagatgcttgtttagcacctgctgtgtgccgggtctcaatatcaaacatcatttaatttaatatagtttaactatggctaccttgctctttatgaaaagaacacctaatttttaaaacaactaataattttattagactcaaaagccttaggggaaggtactcatgatgccgagcaatgcggcccacagtcagggtgtgagagttagctgagtgtggagggtccttgcctccttcccccttggggcctctctccagctgtctggggatttcgttctctattttccagcactgagctaaggatattttgttttgtatttcactttccttttttaaaagcaagaaacagggaaaaaacaggtttgagttgaatgtgttaacacattaaaatgttatctagggttttatttacatataatatttattaatgctaatcctattaatggtcaggtaataagttttcagatcctaagaattctgtagtgacattactgatggctttacttcctccttttgccttttcacacttacctactatctatgtcatttattttttttttgacttatgcaatatcctagaatttcatagcctagccatcaactgcagcccttgaagaagagattatgcctttctttacaaaagaatatttaagtaatactttttgtatatttttgtatttttcttggcttttattcttagagaaaaaacttataaatatcttaagcacacaaacaggatgaaacctggttataagaaaccagagaggctgggcgtggttttcacgggtcatgcctgtaatcccagaactttgggaggctgaggcgggcacatcacttgagctcaggagttcaataccagcttggccaacattgtgaaaccccatctctactaaaaatacaaaaattagctgggcatggtagcgcatggctgtaatcccagctacttgggaggctgagacaggagaactgcttgaatccgggaggtgaaaattgtagtgagcagagattataccactgcactctatcctaagcaacagagtgagtgagaccctgtccaaaaaaaaaaaaaaaaaaaaatagaatactgtttctccatttcatcatgtagacacctggaaatctgactgttgaagaaggcagtgcatgtgattctatttaaggaatagtacatggagacactaaatgtcccccttgcctacagcagtgcctgaaattcccacattagttgtgtctttgagttggggcttatcttcaaaatactgttaaaatgtacattgaaggtcaataaccatgcaagttttaatggtgtcaaaagaattgctaaaagctttgaaaaaaaatgaacacaacacagagggtccctgagctgctgggaaattataaaatatgtcagaatttgaatgtggagggtactgatcgcttctcctcggagcttctctgtttatatagttagaaatctgagcatttccacttgcaacttgtctgctgcatctgaaatgtacatgttcactttatatttggggtggctttaatgccttatcaaaggtgacagagtagagcttaagtgtggtcagcctgcctctatcacgcaaagtggcaattcttctcaattcagtgctgtcatcgttttcgggggtgttatagctgtttctttctacttttaatcctcacaaatgtgtgcacatatacccagaactctctcacacacaaaaatagctaagaagtgtacagtacttccagttccccaaaagatgcctcagttcctctggtgggtctagactgatctcaagtaaatttcatactcacaggatacacagcttgttataagcagaattaggaaatctgccccatttgaaggatgtaatttcatgatctgtcttcttaaattgctagcaccataaggagtcctgagccattttgaaggagaacatgacatctttgtggctgaagtgaaaaaatatctgcttagctgatgatgatatgttgtatagcgatttaaacagataatcagaactttctcagttgcagcatgagttatgaacttgaggaattcactctcttaagccaaatcatggagagggaaatatatttgctttctatggaaaacgtttatctcctttcagttacattgaataggtgaaaactcccccagaatattctcctaagcaaactgtttgattctttcctatttttctgtaggaaaactttctttttaaaaattctggccgggtgcagtggctcacacctgtaatcccagcattttgggaggccaaggcagccggattgcctgaggtcaggagttcgagaccagcctggccaacatggtgaaaccccatctctactaaaaatacaaaaattagctgggcgtggtggcacacgcctgtaatcacagctacttgggaggctgagacagaagaattgcttgagcccaggaggcggaggttgcagtgagctgagatcatgcccctgcactccagcctagccaacagagtgagattctgtttcaaaacaaaacaaaacaaaacaaaattatttgttttcttttcttttcctacactaggatttcagtgtttaggtttacagagaagaagatacttgaggaggcaaaaaggagtaaaattgcagttccttttttttctaatagttacttttttaattaaagaagaaaatagttctatagtcattgttccatttgggaaatcaatgtttgataataaaagttctgttggtggctcattttttaaatctgggttgaaccctgtttctctcctagttgataatttgatcctcccatctcagagtttagtggttgatccgtaaaatgaaaaagatgtattgatccaattacctaatcattcattttgtcattctacaagtttctatttgaaataagccataatctcagcctcacgtatctgataaaggaggcagaaatgttaatagtgaagggacagggggacctgtgcagtatgtatcggaggtctgaaaagagtcctgtaggagtaatgaacaacaaaacaaccccccatcccccaaagtttgggaatttttcctttattttgttaataggtaaaacaagcatagctatatcaacccaagggtaatactccttgttccctaccctcttctcatcttccttccccaattccatttcctgttcctctgaggtaaccattgctaacagcctagaatgtttcttctacatatttcttataaaaatatacaaacgtagcctggcgcggtggctcacgcccgtaatcccagcactttgggaggctgaggtgggcagatcacgaggtcaagagatcgagaccatcctggccaacatggtgaaaccccatctctactaaaagtacgaaaattagctgggcatggtggcgcatgcctgtagtcccagctactcgggaggctgaggcaggaggggtgcttgaacccgggaggcagagcttgcagtgagtggagattgtgccactgcactccagcctagcgatagagcgagactccgtctcaaaaaaaaaaaaacaaaaatgtgcagattacattttcccctataaaggatgatcctgtgcacattgctgtgcatcttgctcaggtgtacagcaatttccgcaggttatacagggcagtcgctctttgtctggctccctcctatcctccctccagtctaccctctagtgtcacatctcaaatcatcctgttcaaacgagaaactctcctcccacccccaccctccctggtcacattctagtccctcactttgatttattttttcttcatatttgtttagtgatgtatctacccctctttatcccctattagaataaaatttccatgtgagagtgactttaatttcctttctaccctatccccagtgactagatcagtgctctacatggtggtccctcagtaaaaacttggtaaatgaatgaattggaatcattctgtttactaactgcaggaatgtctaggatatgggtaaactgttacttatgtaaccattcccttattcatagagatgcaagttctttcaagctttagtctttataagcaatgctgccgggtgctgtggctcatgcctgtaatcccaacactttgggggtccaaggttggggggatcacctgaggtcaggagtttgagaccaggctggccaacatggtgaaaccctgtctctactaaaaatacaaaaattagctgggcgtggtggcgtgtgcctgtaatcccagctattcaggaggccaaagcaggagaatcactagaactgggaaggcagaggttgcagtgagccgagatcgtgccattgcactcgtgggcgacacggcgagatctgtctcaaaaaaaaaaagatgtcagtaaatggtattgctgcgtccagggtaggtgcattttcaatttgaatagatgatgcccagttacactgttaaaaaattattgccattcacacccacttgcagtaatgaaagcacttatttcccttaatttttctctgataacaagatgtgattagtgtttaattttagctaatccaagaagtgggtgtggagggagatagtatctcattctaattggcatttccatgtaaattatccagtttgaacattgtaatatgttttattgaccatttttcagcttctgtgaattgcctgtttataatattttgctatcatctattgacttatctgccatcctattattaatacgtttggtattgagcatattaatcttttacttgtcaggtgtggctatttttccagtctactttttgcttttcaagtttactctttttgtcatggaaatctttacatttttatgtagtcaaatatattaccttttatattatgcttttaggcttctgggtttccagttttgtataggaaagtttcccctaactaaagcgaaaccatattttcctgaattttttggtaagattttaattttttttttggaaatggagtctcactctgttgcccaggatggagtgagtggcgtgatctcggctcactgcaaccttcgcctcccaggttcaagtaattctcctgtctcagcaccccaagtagctaggattacaggcgcatgccaccacacccagctaaattttgtactttttagtagagatgggatttcaccatgttggcccggctggtcttgaactcctgacctcgtaatctgcctcggcctcccaaagtgctgggattacaggtgtgagccaccacgcctggccagattttaatttttaaaaatagttgtctcctaagcaaatgtaattttttatttatatacaataagatgtgatttagctttgtttttccaaatagatttcctattatgtaaataccatcttttaaataaatcatctttctctcacttatttgaaatttaaatatattaccttgatttaaatataacttaaatacataatacatatataaaagtatatgtggatttatatatattcagtatacatatttaaacttgaatctatttcttgattctctattattgtcccccaacctatttgtctattcctatgtataattcttatatttctatatgtgtgtgtttaactgtttaattattgtacttctgagtaaatcttaatatcatataagataaattctccgtcacaaacctacttttccaaaatactcttgctaatctcaaacacttattatgccataaaaatttttaatcatttattccaatgaagcccaccagaattatgcataaaatttggctttgaaacacacatacatacacacacacacacacacacacacacacaacctggatggactggagtgagagaggtgagttggttgggaggtggtcttagcaattaggcaaactaaaacagggcctgaacacccgggtgacaggagggtgagccacgtccaaaagagaatcaactggacttggactttgaccatttgttaaggaagttgagtcataactattagagtgaaggaatgagcagattgtaaacccttcctagagttaggactatggaggaaagtacttttggaggtagacagcagggaagaagatgtatccatttgtggacaggttgagttccacgcatgagagccatcagtgggcacaaagaaattggtgatgatgatgctaaacatttggataactttaaaatatttgaaagaggtttttaaatgaagttctggaactttcaggcatacttaagttcttattcactttcttatgaggcctcacttttttttctttttcctaactcatttctacttttggcagcttgggggcaaattattgtaaattcccattcttgttcttgaaaactgggaatttatccacaggtggcaaaatgtcagttcttgaaaatgtttgttcccactctgtaaaaatattttctacaaatacttatattaatagttttataatatttttgcaaaacccaatattttatggtcactaccattttctctttatcataaaaactgtttaggctatggagtataaatgattttgactattaaaatgatgtattgcctgggcccagtggctcatgcctgtaatcccagcaccttgggaggtcgaggcgggcagatcaccggaggtcgcgagttcgagaccatcctggccaacatggagaaaccctgtctctactgagaatacaaaattagctgggcatggaggtgcatgcccgtaatcccagctacttgggaggctgaggcaggagaatcacttgaacccagaaggctgaggttgtggtgagccaagatcacgccattgcacttcagcctgggtaacaagagtgaaactccatctcaaaaaaaaagatatatcattttgacttaaggtatgttgtagatatgcttattctcatggcattttctttcatttgtcttttcagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggtaatgttcacaaaaagttgtttccctcagtatgcgcagagagcatgtgagtgcatgttttgctctggaaagagttattctaacatcctaatgatactgctaattaggccgtttggggaatcatttacctatttcagataaaaagcatcaagtataaagttagcttactggcttgttaaataaggtacatattttagggttgttctgtttaaaagtctcagttagtttctgatgaaaaataattttttaaatcataggttattggtctcagtatgtggaacaacataccaagccatggtttatgatatgccacatcataaaaatcagttatagtgaagcctgcagactttagtgttttgatttgattgaagtaaatcataaatactgggttttatccaaaccagttggaacttgatttggtttggaaagctggctggaaatcttggatcaaaagatttttcttgtatttatttcagctagactttagttctttttttctttattgaataaggaaaatgaactaaagtaacttaatagatgttattaatattgtaattaatagtttaactgaaggttcatgttcttcttgtgaggctggactctcctgcccaatggagttaactgggttttgtttgtttgttttgagccaagcatacttaagtcctgagatgacctttaataagtagttagcactaacgagaccaccttacatttcaggggtatgaagctcccttcacctgcctcccataccaagttattttaccaaacagaaaagaaaccaagtggtagaagagaggcttagtagactagaattgaaatcttttgaaattttgaatgcattttgttattaactctgaaagcctcagtttttatgtgggtatgagttgcctttaggaggttttactgaatgtcctgcataggtttaaaatatattggactcagcatttattgtcctttaatctggactagactaagaaacttctatgccgtgagactggatcccctctctttcctgcaagccagtgctatttgtgttctactggggaaatactcagactgaccaattcctgtcatagtgtttggtttcgtttattcatgctttcctaaaatagtaagaaaggttaaaaaagacctgggtttttttttttttttttggttgtctgtttttgtttttttccttctcacttaaaaagtaaacttcatgattgggaaaaaaaaaaaaaaaagtcactttcatttaaagtcctttctctgtctctaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacaggtttggttaagtcactgctgtacttcctattgattcacaaagattgtgtacaaagatatatttgtgtacaaagatataaaacctttgaaatatccatgccaacattataagagaaaataaaagaacaaaacattttacttgtccatcacctcatctctggtttcccaaggatcatttcttgggaagatcctggtcaagatcctggtctcatgactcatttaaaatttagtgatagcatctttcctgctattaaggttagcattagtagaagtatcattgaacctactggagcatctaggtaatttctagattcaatctaggtaatttcttggtgacctagacagaggtaatggacttagcaacatactttaaactacaaggaaattgggtggactttgggaaaaatacatgtcccacagagcactagtaataggaaattgttcagtacatggttattctcacctactgtactcgccagtgtaatccgagagtttaaacattcagggctcagaagaacacattttgtgataagcacctggaatctagagctcaattcatcctttgattatcctagtccgatttttaactgcaattccaagattattaaagatagattttgtttttgatcttcttttgttctctgaggagtaattttaatggctgatgcccctttttaccctcggtaattaattgtacagaatgccatgtacagaatgagctgtttcttaactttggtagttcttacctttttaaagagtaagaggctgggcgcggtggctcacgcctgtaatcccagcactttgggaagccaaggcggtggatcacctgaggtcaggagttcgagaccagcctggccaacatgatgaaaccccgtctctactaaaaatacaaaacttagctgggcgtggtcgcaggcacctgtaatcccagctactggggaggctgaggcaggagaatcgcttgaacccaggaggcggaggttgcagtgagccgagatcgcaccattgcactccagtcttggcaacaagagcgagactccgtctcaaaaaaaaaaaaaaaaaaaaaagagtaagagacttaattatccatctgaaacaaccaatctttgcacttacaaattgcatttataaaatatacttataaattgtggctgccccaagtttaagccattcattagtacccagacaaaaaacaaggaatttttttttaatttaatatcatcttacaaggaaatcacaataagcctggtaaaagtataaaaggagagtagagaggaaaactacctttagtacacactattaaactgaaggtgttgaagttttgccagtttgtggctatgcagaaagaagaacaggatctgatgaaaattttacaaggagcatctcccatgataaagtcaacatatctgctgttgttctctcagggggcacttcgcctgctcagtgggaagacatcacaggaacaactcctttgacgtttataaaagattgtgtctcctttacaaccaatgtttcagccaggtatggaaataaaggattccaaaaagcagtaaggaattagtttttattaccttttggaaagtaaaaattgttgtgttcaatactaaaaaaaattgttgtgagaaaaaaaatccgtagtatttgcttatcaaaattatcctcaaataacaaacagagggtttctgtgtttgatacatcgaaaaagcatctttgctgtttaaatgaacaagttaataacgttttgggttagttcctttacatattctgatttttttaattgtgagtctttttaagatttggcttttaaatagccacattttcatacttctgttttttgttttgctcagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggtaccttgttcacaaaaacaagttcatttcattacgtactccagatatgaggttttattttgtggtcttaatagcactcactataaaataccaagtgcattattgattttacttttactttaaaaaatttgatatagattaatactcaaatttttttatcttttttaatttaatttaatttaatttttttttttttgagacggagccttgctctgttgccgaggctggagtgcagtggcgcggtctcagcttactgcaacctccgcctcctgggttcaaacaattctcctgcctcagcctcccaagtagctcggattacaggcgcctgccaccatgcccagctaattttctgtattttcagtagagatggggtttcaccatgttagccaggctggtctcaaactcctgacctcgtgatccacccaccttggcctcccaaagcgctggcattacatgagtcaccacgcccggccaatactcaaattattttaagtgtctctggggctgtcttagctggttaaaacatagcactaatgaatttaagttatggtctccattttcctgtggccacttgagttacctacttttcagaatcactgtttatacacattactatgattttcctttttcaaacccagtgagcatgtaagtatctaacagtgcaaaaaaaaaaaaaaagctttcaaaatctatacgaataagtgattgatgtcaggcacattcttaaatatttttaaagttgccagaataaaaataaatgtgtaattctgttctgtatatgtccatgatatggattccaattacagttggtgagttgtaagcacacaacattatttttgttgcaaatagcaccacagaagtaactgcctaatagagacacgtgtaacatagtaacgtcagtcttttaacgttacgtgacataaaatctcaaaatattttaaactcagattaacattaaattgtttatttcttttactctaaaaggttctggaaggaaaacctatttatgttgattgttatggaaatttggccccacttaccaaaggaggacagcaacttgtttttaacttttattctttcaaagaaaatagactgccattttccatcaaggtaaatcatctttaacagagaatctgtgaattatggggaaaaaatactcttagagaataaaaataaaaggttttaatgatttatttaatttgaaataccccgtcaaatctgaactcataaggtcagattttgttctggttctaccagagtatactttcaagccagtaaagctttacaattggtaaaaaggatcattatttttcaaagagtttaataacatttatgtttaagcaaacatttgtaaaaccaaacaatttagagtaatacaatgtgttatttctggttaatgttcagtaatcaaataatggatgaaatgcaaatacagtattcaagtttcattttcatttctggtggagcccagggacgttctagagggatcaccttctctctccaagaacagaaggagagaggaaaattgttttgtcattattatttgctgttactgttgcaaaagctggagctttcagaaaaaaaaactgttagaaggaaaatgcacataactcagactgtactatgaattgtcaggattagatcatcagacacaacaatcctgcgtttaggaatcgggcatctaactcttgctgagttcagatgtgaccaccccggttgctgcataatcgtaatcatcatcttttccctttacctttcctgcctctcatagggcttgataaaacaaccatgcttaactcttatacagttaaaaatcctcagataagtctcattctataaccatcaactaccaaaattcttctagattagagacaccagccaagagccctgtggtcgtctgtcttttctgaaagaaccaaagacaacaaaaggactgcctcaaacagcggtttgcaacttaaatatcactctgccagcacataaaaaggtatcttttaatactgctttaaattgtctttccctggtcttgaagaagtgggcctttggtatgcaattaaggaatgctttgtaacatgaataaagctcttgaaactgaagttgtattagtctcctcgtgtagattgcctaagtcttgttaatgtggtgtcaaattcttatagtttgtatgatggagtcttctctgtttatcgcttttgcttctgctggtagcgcatagatttttatgcttttaaataacgtcatatgttaatttgccatggatgtacagttcttgatattttttgttggctttttttaaaatttgctttgctttctaaatcagcttgcatttgtgctccctactcagtccttttcatatcctgatattcttttccctgctgtccattataatattccttgtctctgcaatgcatcttggaaccaaaaggagacagagtcagatcaagatgatgaggtaatataaacacttctgcttttattctatcagaagtagaatagaaattgaatctgtatgacagaagttgcagagggctaaagtgtgggaaacatataaattatatttttcaggtcttaagtaggtaaaagggtatatatttttcttaaatggttcactcttcttccacacgtacttaagagtacttaaatatattcaacgaaattataattcagctgatgattcagaaactgaaggtctttaaacatttttaaatatggtagattggcatgtataaataaacgttaaaaatttttttagacaagtcaagtgcaatagtgagaaagggggaaagagtaggaccaggaagttctatctatgactgacgagaacagtcaactgagataacgcactaccttcgaacccgccaaatagacattttgtgaaagtttcatgtgcctattttactatcaactatatcctactatccagcatgttataacatttaaatcaagatcacgtttaatatgtgcaattttattgtacaaataaacttatgttgtatgtgatacaaaatatttgcttactagctattgataaatctttgatactctcactaaagaaatttatcttgaccatttttttaagaatatagttcaattaagttgtctcctaatgtttctctaagttatatgataattaggtttttgaatcccacacatcaatagtaataaatagaatcaagtagccttaggatgcagtaatagtacctctggccaggcgtggtggctcacgcctgtaatcctagcactttgggaggccgaggcggggatggggtgggggaatcacctgaggtcaggagttcgacaccagcctagccaacatggcaaaaccctgtctctactaaaaatacaaaaattagctggacgtggtgctgcatgcctgtaatcccatctactcaggaggctgaggcagaattgcttgatcccaggaggcagaggttgcagtgaggcgggatctcaccactgtactccagcctgggctacaagagcaagactccgtccctaccctcctctgcccgccccaccaaaaaaaaagtacttctaacaaaaccattcatctgttttcaatctcctcatctacactttatgcctgttaacatacagaatccccagcagtaattggaataataaactttgtgtgcctttctcccttgaatgtactcacatagagtgagtgtactttgtgatatatgtgctttcaatatgaacagttccaggaaaatttaatgctcagcatcagaagtctctgtaatgcttgtcttttacttgtacttccctgtagtctgctgtgttggtgctcttaaatttgccaaatgatgattttggttaagacatggggggtggggttacaaaatcccagtgggaaattaacatttcctaagaaggaaaataaacaagttatcaacatgccatcctacaaaatgtcttaaaactgaagatgtcacagggaagttggaaatagagttgtctttttttttttccttttcagattgagaaaacagatagacgacagagcttcgcatccttagctttacgtaagcgctacagctacttgactgagcctggaatgagtgagtttcctaacacatttactaatctacgtggattttcataagaagagacattttttctatacaaaccaaattttatcatttggaaactcaatggcaaaagaaaaattgcctgcaggaaaaccctgtcatacaacctaagtaatattttgtgcctagttgaagatgtgaggtaaaaacgcccctagctcatacttcaaaacagtttttaaagccattaactatttttaaattagaaacatgtattacttttcttttaaaaccttgatttttactttgattaactatgctaggagataaatatgaatgttgctttagatctatgctcagatgaaaaaaattactcaaatatttggaatggtagaaaaatgataaagttactttgtcatctcatttttctcagtatagataggttgtcatatcctagtcccgattctttttcttcccactttgcaagaatcacgtttccttaccttcttgaggtagcacttgtttacagagttcttctttcctccctccctccctctcacttcctctcctcctgtcctttattaaaatatcagttctaaggctggtcttcactagaccagttagacccttttcttttctcaatgatcgttttggttcattgttagctggcatgcacttattaagatacagattcattcagtcctatctgtttatatattctccctctctctctctctttctgtctgcctcctcctccctttccttccatcatccttgtaatcatcacctctggtgatctctacagccctcaagataaccccctccaccagcaggaactaagggtattgagctcagcattgtatttgactgacatattggtgccactttaaccattctcctcattttaaatgaggggaaattatacaaaaattattttttaattagtgaatcattcctagctgtttcccactgacacagtttcttaagttcaaggaggtctggaaatttgccagtaagagtcacatctttggcttttcccaccttttctgaagtcttgtttttatgggccaacagcatagcatataagatctgcggcaggacactactgcaccacttagttgagatggtcttagcgtcatcttctggagcctagctccttgactattagagaagtttcaatatttaaatacaaaatggagaatataagagaaatgaaagaaacctaccacattcaagaatgtttcctcagatctctgttctcctctagcagaaatgtcgaaatcctcccagaaacataagggctgaaattaactcatattatgctacagagcagaagaggggtgtgtgtgtgtgtgtgtgtgtgtgtgtgtgtgtgtgtgtgtgtgtgtgtgtagctaggtagctaggtggtttccagtagaattaaatacactggggaagttttctttggaatactattttgccctagagatcctcagtgggtagttggttgagaccctgtaggcaacatcgttaagctttggacaggctcaatggaccagccgctttaggtcggaggccccttcaggcaggtgagtttccatctgattctggttgctaaggcaaagtcaattgaatgtttcccacttataatagtgttactggttagatccagctaaggtgtatgcagcttgtgttcctggacttttggtagaagaggagcgaagttttctgttttatgaaagggtacataagggtggtaaacaagggaatgaataggaataggaagtgactaaaagaaaagtaagtctcaaaactggtgttatgggaactccaagtgaatgccacttttccttcaccacgctgcctttccaaccccttccccccaggaaaaagattctggattagttcggtgcctgacatccagaaattccctcttataaagggatcccaaaatatatgtcattaaagcataaaatgtgtaactgattggtaggttggttgttccttgcgaagtataaaaccatagacgtggttcaaaagatttctttgcctgatagagccagccttcagtggtaaaggatagatgctttgtcagtgtctgatagttacaaaaataaatgcttgtgagacacagactaagctcaaatcattgaatttgaaggaatctgcaaaccttccatttgcagcgtggcatttccaaaagagttcagcaatataatattgagaattatggcaagaaggggtaatgaataggcgagtttttccttagttcttccactttctttagaataatatgtaagcctaggaaaggatatgtttggaatgtttgaatttaaatgtacactagaaatgaccatcttcacccttgtgagagtagctgctaatccaaagactggactgtagcaatggcacgggcacagcatgaagaagaacataaaagctgaagcagattctcattttctctttgagtttcactattctgaaccagggctttcttggagcaaaactgtattcacctttgatgtagaacattagccgttggcaggccttgcaaatctctgaccagtttggtttgtttgagttgtagaagcagagaggaccaagtatgtgtttgtgctccccagcaagtgtgcttacttcatttgtgtgtttcttgctccattgccagaagaaatgctggtattactatatccattcttcctagtggtaggtctccctcgtgactgcttcagtgtttgtgatatccataagtcccatgaatattatgggaaggcaccagaattggtacctttgaaattgataaacatatatacacacaccccacatatcctactgtaggtacttaaatatggggtgttaaaaatatgaatgtagtttttagatgtcccccatgatagcttttgaaaattaaatgtagattaggttatgaaaaaatatctgagataaactatatgcttttatccatattgaagagttgcagacatggacgtatgtagttgcaggtgattttataacttgcagtagaaaatattttcctaaaatctcaaaaggtaccaagacttcatatctcatggaaaaagtgtactcttctttctaaatgcccttgtgaaagtatctttaaagtttatatattgtgcataatatggcatacgaattgtattacttcattggcttgtttgccatgatatattgtgcatgataaaatgttttcagttgctttgcttgcttatggtaaccatgaaccatattttctgtttttttctttgtgtgtgtatatgtacacatgcattttaaagtcatttcatattatgttttcttttcctctcatcaaaaggaatatactgcatggaaaagataaatgcaaacattccttttctttgttttttttgtttaaaattctgactcagaaaacttcttgctcttattggctttttatgggtgtaaagcataaccgaactgtgcatgggagatacagatttaaaatccagtggcttcacagtttgcacatcagttgcctgtcacttaaaagttattttggattctgcatgaaataggcttgagtggttttggaaaaaagttttagatatttaatgtatagctacatatattgaaatggttctaagtaggtgcaatctgtatcatggaaaggctaaaggagagagaggacattagaaattactaaaatgaaagttgtatggttgcacgaaacaaacatgtacctatacaggcaaaatagaatggctactgatatttcaaaaccaacacataagaaagtcaataggaagtagggaacagttttccattatggttatttttctcatcattaattctttcctcatgttttctatttttcattgtttgcctctttggttgcaatgtgctttttctttcatttcacattactctgttttttatttagttgtttttttttaacttcagattagttatgtctgtagaaatttgtttttcctcttaattgttccttttgcctcttccattctaaatcatgcaaacaattgtacttgcttttgtaatatttcaaagtttactgaccaatttttttctctggtctctctgtttctcaaccatttttgttgatttttgtgtttgatttcattttaaaatttaagaaacagttgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgatgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacacagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtgagaatgaaggcagtcaggtctctcgagcactctgctcacatcctggagaacgagcatagtttgtaaacactttccaactcgtagaccctagtgcatgaactgttgtgattgcctgtggagtgacttaaccgtagtttctcattatgtcattgtcatctgtatgtgctgtcgtatatactcttctttctgccttttgatcaaactacacggtagacagctagggaagcatgctgaagatattggtgtcattcaagatgaacaaccttcttttttcttttttaatgtgctaatggatatgattctgtcaaagtaaaagcacagatgttgaaatcccatcatggtgttttcaccaacacgacacttctgtaactgtttaaactagctagctcgtcagcatgttcaatcccattacattgagcatccatgtagtctgacatttggcctgatgcaggtgaaaaacaagtgagccatgtgcaaagaagtgttcatgtaggtgactaggacacatttcagtgtacagtgttagcattagtctctctgtaaaatctgcgtactgctaaaagcaattttccagtatcgtatctttcttgatgattattttaattaagaaattgtaaatcgtaggtccacagagtccatgtgaacggacagatatcaggatggcaatagtagccgatcacctgggacttagttggacaggtaagtgcatacactcctgaatggaacaaattagtttcttcatttctttgtcttactcacaagcagttcaatatatatattttaaaaatagaaacaagcagctagtaaaaaacatttttatcaccaataattttatctacccagagataaatactgattgtaccttgtatactgtgtttttccaaagccttttctatgcatatgcactaagaaatagaaatttaaatttattttaccttaaatttaagcattttcttcacaatgtcacttctgtaatataggttaaccttctactgaatagcaaatttatcttgtagcacaaaagaaaacacagctaaggcctatgacttaattaatcaaaattctttcacatggtttatgtccttagggcagctttctaggcaacagttcaattaacccacgcctaggctgcacaaattttagtcattcactgtgaacttctcttcacattttgtacgatatacacataaaactctatgtttatttatctgatactcttctttaagtaaactcacttttctgcccaaatatttatttaaaagaaaaatcttatatcacttcgataatgggaaaggattatttgcattatctatgtaaacaagaaaacaatgacagtaagtttaaattttgaattaaaaatttttaaatgtgatttttaaaatatgataaacatgtaaataaatatatttaattcacaaaagttgaattctataaaattcatgcctgtaatcccagtactgtggggaggccaaggcaggtagatcacttaatgtcaggactagcctacccaacatggtgaaaccctgtctctactaaaaatacaaaaattagccaggtgtggtggtgcatgcctgtcgtcctggctacttgggaggctgagacaggagaatcgcttgaacccgggaggcagaggctgcagtgagctgagattgcaccactgcactccagtctgggtaatagcgtgagactccatctcaataaaacaaaataaaataaaagatgatgagatttcatatcaattggacaaattggacaattctgcattgtaattttgagcttaacaggacccttaaaatcctacctcacatgaatctgagaaattttaagttttataggttaagtgtattttttaatgcatggccaaataataaatattcattatcatcacatctaaattcatcctgcataccattagcaacatacattccatacagttatctctatttaatgggagaatatgaaactagataataggaagcaatttcatctaattttttttttcctttgaatgccctcagtccccgtccacccccaccaccactaccccatttcaaaccctcctctcttcatcaacctagtctctgcttgctctcaggtatactgctaatggttgggagctgagtggagttctgaaaagatagataggtggtctgaataatgttttgtaggcagttgagagttaacagtaatttattatgtatgcatatttactaatatcaactttatattttaacattggacattgtaatctgaaaatatactggagcaaatgtttgttttgcattattatatgcctagaactgttagattattttccttaagcaaatacagtcagagtaaatttttggagatgtggcttaatagccagacgaaaagccataaacctaaaattcctagtgtcagtgtctttgctctttattaagtctctagacaatggatacagttttgtcatgaaggcttattgggcagtaggagtattgtctcttaagacacagagatgaagaacttaaaataattaacttctctaactagaattactgtatgctcaatgataattattaagaatattaagcatttaagagaacaaaatttatatctgtccctcgaaaccactattaacatcttatgtgctttttttaaaacaagaacgttttataatgttatacatacaatgtaatctgcttatttgtaactgtgtcattctacaaaattaaatattttctgatcttggttttaatgcataaaaaaatatccaatagatgtaccttatgatggtggttttctaactgtggttcacaatgcttcaatgagatgtgaaatcagttcatactttgtttttgtttttaaatggaatattatataaaagaaaatgactgtgtttaagtgtattaaggctaaattctgttccggggagatctgattttatttatgtaaacaccatgatatataatgtatttctaactgtaggccatgatcacaacagttgtttgcaagccactgccttaaattaactcttatccttttgttcaacatgcagattgttttcaatgaacattcatgtatataaatcattgtatataactcatatattgtcagggtaaatttctaaatgtgaatcacttggtcaaaagataatggacttttttgagcctctgaatgcattttgcaaaattgctggaagtattttgtaagggggatagagtcttgaccaattccttttccatgggatcatttttgcccatttcttactttttgttatcatttaaggtaatacacacttgataaattgttttaatataaaaaaatacagtgggaactaagtctccttcccttctctgactcctaagtttccctcttccaaggcagccactaatagtgagatcatatgtatctttccaaagacactctgcaatttacaagattgaatatgagtatatctgagtgtatacgagtagatggacagaaagctgtctcccttttattttttactcaagtagcttcatatcatataagatgatctggcctggagtcatcatataacctcctgtgtggagtttatgaaacttgaaggcatagagggtggcatattatgtgagtaaaagataccttcatgaagattgcttagcacaaaccctatcagcatctcttgtgccatatacatgaattgtatacctctacgtatcttgtaatttgctcaaattatagagaatttggctgaattaaaacaatcatccaacatcctctttgcaaactccaaaaatcttgttttattttttgagatagggtctcgctctattgcccaggctgaagtgcagtggcacaatctcagctcactgcaccccctgcctcctgggctcaagtgatccaactcagcctcctgagtagctgggaccacaggcatgtgccaccacacctggataatttttgtgttgttgttgttgttgttgttgttgttgttgttgttgttgtgtgtatggagaccggggttttgccatgttgcccaggctggtctcaaatcctgggtgcaagcaatccacctgcctcagcctcctgaagtgctgggattataggtatgggccactgtgcccagcctaagtctaaaaatctttataagatggtctctaaaaaaaatctgattgtaagtcattacctaaggagagttaagtcacagcctgtgtatggtcactactttgctatgaagccaagtatataaaaattaattcctgaggctgtacttgagcttgactataaaattcccttttctttttgtggcaattgagcattacttttatgaaacgtgtgataaaagtagaatatgcaatcttagtaactctctttcttttctacagaactggcaagggaactgaatttttcagtggatgaaatcaatcaaatacgtgtggaaaatccaaattctttaatttctcagagcttcatgttattaaaaaaatgggttaccagagacggaaaaaatgccacaagtatgccgaaattatattattttaactttcaaaactgcataaatgtaatattttagataagccaactgttaggttcatccaagtagtgttgtaattttctgtaatctttaatatagaaaactaagtgatcatgaggtaatagcaagtcttttgaagttatacttgtttaatttagtgttaacagtctaaacttctattcttcagaagctttttggaaagcaagtagcagggaatttttcgcatctggcctgacattctctctgtgaccataaaaactgaaaacataattttagttgttaaatcatgggacacagtcatcagaaacactccgaagttaccactatggctggaggtggatgtgcagagagggaagacaggatcatattaggggagcaaatagttttattcagcttggttggctctactgttgttgggtttggttttgttggctggtgggattgggtggtagtcctatattttggcaagtgccaacccacaacaatgtggaataaattattatgggtttgcctgtgtcaacttgaccctagaaagtcattaaaatgctaagtaccaaatatgagggtgacctattttgacattctaagaggaaaggaaactttagttttattagatccccttatagccaacaggaatctagttattttaaggcccatccgcactgttccagtggaacacagctttacaaagtgatgattaagactctgacaccttccctgtagcagcgagcattctgagtcctctggatagggagattgcagagatggagtaagaaggagctaaaatgccagcagggctgcaaaagccatgcctttgtgtagatattgtgctgactgaaagaacataatttaattgggttttcaacctttttttctccttttcagctgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggtaatcgaatttagtgttcatatttatttaatcatttgataaaatttgaaagtgcagtcagacaaggcagtcacttaaaagcaactaaactgtgatttgcttgacttagtttctcattttctctgccagagtctgcaaataaacactctgatatcagagcaaacttggtaaatacctctgtttatatacaatataaatatacaatataaatcatgacgtatgaacgcctaaggtatctgaaagagttggtatttctaatatttcataaaagttaaatatctagagaatgcattgcttttgtcacttttaatttttatattaaccctcctaaactagttacctcttttattcgtatataggtaaaacaaacgatgagccatttttatcaaataagcaaggtattgagtaaagtgtaagcatatagtatacaaattgtaaggtaaaatggcaatttactgtgtggcaccaggtatttaaatgtgcactgaaaaaatttaatgtatcattcaagtatgtgctttagttatttagcgttcgttgttattttaacttcatgaatatgctgccatttattctttggaaaaactgcttgatctattgtatatcaaaggcagcataatttctaattcagtcggcatacatgttactaacaacaattcctctttcacattagcttaatttatataatgatcttgtcattttttcctcattatgtaaattgtgctttcttcactgaaatattaagaaaaacataataaatatcttcctatgtttttcaaaatagtcctgtcttaggctcacaaatgaaaatttattcctacaatgaatttttgttctgtttttgagacgaagtctcgctctgtcgcctaagctggagtgcaatggcacgatctcggctcactgcaacctctgcctcctgggttcaagccattctcctgtctcagcctcctgagtagctgggattacaggcgtgcaccaccgtgcccagcaaattttttgtatttttagtaaagatgggggtttcaccacgttggccaggctggtctcgaactcttgacctcaagtgatccacccacctctgcctcccaaagtgctggaattacaggcatgagccaccccacccagcctctataatgaattttgagtagaaaatttgatgatggtgtggaggcaggaataagaactaaggatatttttctagtattccatttttaaactggcaaagttagattaacaagagtcacaaacttctaattaacttctaattctgcatatattttgtggaaaaaatcttaaaattcttagaaagttcctgcttattaaaaagtttaagtctggccaagcactgtctgtctcttaaaaaaaaaaaaagtttaagtcaacaaaagatttaaagcatacttgttatacatgtaacaaacacaatgggtaatgaagtaaaaagcggttctttttaagtttataaagaccatagaaccttggaaaaacgctccctttgaggccttgtcttatatgcaaggccatatattagtaaccacatgctttttgcactagataaatatagatcatcttatcaaattttaaattattgataagttatagtttatacattcttctaatattctttattggaaaaaatagttgttaagtaactctaataaaaaagatcaccagaacacaacagaagtagttgtgttgaaagcttcatttaatttgaacattttaaaattggaatatccttaaaatacagtcaaaaatgaaatggctttttgttgctgtatcttaatatttttaaattcctttttcaaaatttcttagggaaatttagaaacatgtatatgaagtaatttcacttaggcagattataaacctcagctaatcttagccagcttttcaacaagagtctggtttatagatgaccataactgaaaaatgttcacttacctatagcaatttgagtttacaacagcagctaagttggtatttacctgggactgatggaaaaattagacttttattttgtagaccaacaattcagaaactgtggtttgttgcttttttcctgtctctcctcttcgttgaacttttatgaaacttcctttcctcaccatgaccagaccattgttgacttttctctctgctgaggcagaaaaatgcttccatagtccatgcagcaatgtttaaaacaagggattcgttcccccctccccttttgtgtaggctggttaataaactctatgtttcatagcattgtcgtgaatattcagagtgctccctgcgaatggttttcctactatctctgttgtgtatcatttctctttatttgattcgtggttctgagtggaccctaccaccgacttcaccaagaccttcatgtaccccacaaccctttcatcttggtcatatctgtttttgtacaacaccctaaaactacatggagtcttttaaacttggtctgttttttcaatccttttcttaacatcgtttaaaatttttttcccagtgccactgctctaaaatctaacaaacaatcatttctttccaaagattaaatccgtttttctgtgctataatttcatgtgaaagaagaactaggttgctttgctcatatgtacagttcttaaaataagttgtaggtaattaatataaaagttgtaggtaattaatgataaaaattggtttcttgtggcttgctgtattcagtccaccacagtatgaacttcgcatgctaaatatagaaagataataagtatctcatgtaatgacaactaactttatattggtctttatataaacttaaatatataaactttatatatttagtctgcatactttggattagtgtgcatatttacttattgtatcataatttccaaaacagaaacaattgatatcttaattagtattctattttattggagtttgcactaggctttttatttcattgtgttacatttaattgaactaaaccgataaatttattgacattaatctgtaattcatcatacatttttcatgcctgatataattttagtcattccatgtgtttttgtttgatgtattctaattcattccagtcagtccaaatgtactgtcttccataggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacaggtatggctgtttcaaaaaaaggaaagtgaacacaggttacttgttaatcgtttatcttaaatacatgctttttagtggtgacttcttctaaattaccattctagttctgggataaaacctgctttaaagaccagttcattatgctaatctggaaaggaaagtgaatttaaatttaaatttaattctcaaaactgttgaaataaaatacaagaaaatttacatacatgcccaagatttatacgttgtctttactttagaatactattcttttctactttattacttgtatgattcttttcatatagccagtaattattgttcctttaaaataatgaggtgggtggatcacctgaggtcaggagttcaagaccagcctggccaacatggtgaaacctcatctttactaaaaatacaaaaatcagctgggtgtggtgtcacgcacctgtaatcccagctactcaggaggctgaggcaggagaactgcttgaacacatgagggtggaggttgcagtgagctgagatcacaccactgcactccagcctgggtgacagagtgagactctgtctcaaaaacataagaagaataatgaatgaaagtccatgttatttagaaatataaacattactgtttttttcctaactgcaaacataaatatgctcattattaaaacttaaaatgcagattaaacaaatcaatacaccccatcatctaccaataacattttggtggattttcttctacgcatgattttttaaatgtcttaatgtaaaaagtgcagagtagcaaaaagaaaagccatccattctcctaccatactaggaaaaactgattttacatatccttctatttttccacgagtcttatttttcataatttgaaagatacacagttttttacaccaaataatattgccatgatgaacatttgtctttacccaaaataatttcctggtcacatttgtctttacccaaaataatttcctggtcatgaatttggttaattcttatactggccttgctctagaaaggtgaaagtctagaatctgagacatagtttcaaatcccaccaccattaggaatgtagtttgtgatttgggatgaatctctaagctctaagaatgtcactctaattatctttaaatataagaatactactaccttccttaaacagatttatagatagaaaaagagaggatgtatcatgtctaccaaatgactgacacaaatagtaatttctcagtagcactaggcattatttttatttacatacacattagactaaaatatattttacttcagtgccagctagtgattaaattggacacaagagaacttatttcataaccatattttatatttttatgtcattaataagcttcttgctcaataaaaattcccaaagagggagtttacaaaactacttttgaaaaattgcaggcatgaatgaactttatctacagcctacaaaagagacaattgcaaagaagacaaacagtactaattttgatgtctatgttcagatatagtcacacaatttatagttacatatcagggaatagatataggaaaggtgttcatcattattaaaccgctgaaattccttgttttatataggctctgccagtgaattatatagaaaaaacactagtgaatcccctggttccatagaaggaggaaaatgccagtcactttgctcctgttatcagaatatgcagggtaggagaacgccggcaagcaatgtggactggggaatagaaaattaaaccaaagtcataaagctatatgttacaggatcttcacagtatgcttggattgtttatccttacacataaagaatagagtgtgctatggatgtcttttaaaaataagtatgttcagataatcagaatctgatttaaaggaatacacacacatatataagtatatattatacatataaagcattgtactagttattgccttctagcggtaataaacaaagatgctcaaaataatacgcaagctacaaaaaaagtgaaaaatagtctatactgaaacttgtaaaaaacttagaagtcaatttaaaagaaagcattggaaaggaaagagttttaatagttaagggaaaaacagttctctcagtaggtagaaaagggtgtgcaaccctcaaatcactagtgagattagcagaggtcaagagtagagaaaaatgagattcaagtaaaggtattagagttggaaaagtaacggcaggattcatgactgaaaacatatacaaagaattggaatttggggtacttgggggaataccacagtcttgaccacaggaatttgttttgttcttttttggagacagggcgcaattttttgtacagtagctcaatccttgctcactgcaacctctgcctcccaggctcaagcgatcctcccacctcagcctcccaagtagctgggactacaggcatgcaccactgtgcccactaatttttgtagttttttggtagagacatggttttaccacatcacccaggccgaactcaaattcctgggctcaagggatccttctgcctcagcctcccaaaatgctgggaatataggcaagaaccactgagtccggccagcagtttattttttactggtgatagagaagcgttctgaaatctcttctcctttaagattggtgggcttggaactctaggtatgtccatgagcctttcaggatcactcatcaagatgatagaattcaagtagctgtagaactgcagtttgtttatttagatgagagcatagctaggcaatttggcaactgagatatgggggatgtctagaagctgtgtagcacctcctgacaccgcacccatgagagccctttacattttatttatttattttgagacagagtctcactctgtcacccaggctgaaatacagtggcacaatctcagctcactgcaacctccacctcccgggttcaagcaatcctcctgcctcaggttcctgagtagctgggattacaggcacgtgccatcacgcctggctaattttagtatttttagtagagatggggttttgccacgttggccaggctggtctcgaactcctgacctcaggtgatctcccgcctcagcctcccaaggtgctgggattacaggcatgagccactgcgcccagctacattttaaatccagtggccacacttttcacacttttctattttatgccttcagaagtaggcaaaagacacagttcttaaaactttagagtttctgcaacctatattcagtcatagtttgccattgtgaatttgcaaattttctgttgcagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtacgtcatctggtcatccggtagcagtcattgaaatggaaagtatcggtgctttacttctttggattgatcttgcagcctggggcccaaggttttttacgatttctaaattataaatgtgtgaaattgtagcactaatggtggaggtaaagaaagtactgagttaaacacataggtaaaaaaaaaagttccaagtaaaatgtatgccatttcgttataccttcattcatggtgcaggaaaagggaataagtatctgtttagccatttttaggagggacaagaaccagagagacgttaagtaactagtttaagacccagtattttatctgggatttaggtttcctaactcccactccgtgttcttccttatgggaggaggataatcattctgatcctttctggctccttggcataaacagtctatagcatctgacccatctaagttctgttctgtatggtctgttgtctgaaagcgtgttttaaaaattaaagagatgaaattccaagcctaaaatgaggtgagttgacagcagttagttagaaatttaaaattagaagtataatttttataatttatataagttgatgatgattgtcttaacatgtatttctaatcactttaaaacctcactgtgatagatttgcttgttctttgtacttttgtggtacaatctaatagatttttttctttgaggtttactctatttttagatattaaaagtattttaaactgaaatgatgactcatacgtggatataagaaaataaaaagcagctctgtttcctacattttttactgctttttactctcccaatttttatgtcttttcatcaattctgcaatagacagagattaatagtagcacttgcagttttcgctgagacatatccagttcactgaagacccactttagtgttttgggaggaaaaaacaagtcttttctgaaataatgagttcaagattgatttgaggtttaggaagacttttagcaaactcaatcgctcaggagctgattctcagcttatcagtaatcacatcctttcctattcccttctgcagacaatatctgactattttcaggcttgttagaagggagagtaagaggaagtttagttctagatcatctatttttttttccctgtaagtaagttgctttgatataagatttggtggtggtaatcagttgcttaaatgatatcctaaaataatctccagctcatttaataactgccttcactaaatttttattaatggttttgttttagttttaagctcttttaagtctttttcaggccttctttaactccgtcctgacaagtgtggttttgaatactgatttctgtctttgacttgacttttagtatatttaagtggtgtgagttttggataagtttccttttaaaatgatcccacaaaatatagagagaagcaataacatagtggtatttttcctgtgaatatttattctgcaaaagcctgttaaagttctaaaggcaaatttctatacaaacacatataaacaccgctgtgtgtgtacatgtgcatatgtatgggccactggaaaatcatattggccattggcataaagacggttgaaaatttagttttaaaccttgagtggaaacttagctgagtttgtcagtaatggaaaataatttaccattagaaaacattttcaggatttcttgtaaatgagtttgtgcctctgatattggtttcgagtcctattataatgcagaaagacttcatgacctaaaaaatccataatggagttaaagcttctaggagacatgaacctgacctcacaagaaaaccaaagatgtttaggatgtatcgtttgtggctataccatagtataatagcaaccaactaggtcatctgatgtatgatctcagaaaacagccccctttttatcccctaaaaaatcaggtcaaaagtccgggtgcggctcctacacggatgactgcctgctgttataaggtaaaattctgctattttccacctgtttccatgcagcaacccatggcaaagagtactgagaaaattccatttggtttccttgttttcccctttaccaattcctagataattcactaaaaggaatcctgagcctgagattcttcctccattttcactttaaggttagcagagattccagggaaaaagtggaaactgaaacaatgaccaaatggccactttttctttatgtaaggggttggcctcacatgatttttttgtaggattatgctataatcacctctaggtttgttgtttgtgtttgctttaacatagatgctcttctacttttgaattcacccaagtgaaaacctttcctcaacttatgattccatgtacagataattcagattcagttttcccttttgcctcatccaacccattaatcctggaatgctaataattcttttctttcgtcaacacagattccttttacctctttctgacttcttgagcctttgcaaagcttccttccacaatacttaaatcattctaagtctcctaaatttactgtcctttactgaaaaatttaaaataataatagcaaacttagttcaagttcttactccttgtaaggatagtggctatgattttcttttaaaaccatattattcagtggggtggtttgttgaggtgaaatttcctgtaaagtcaaggctgatagtactgtttaacattttaaaatacttgtcaagtttactgttgatgaaaaagatggcctagtttattatctatacaactaacatttcataaagcattttatctaacacctgtacctcctatagcagttttatttttttttttaaacaaatactggaattcatttttccagcggatgttaactaaattctgtctctgggactattagatttgaggtaatgaattaacttcaaagataaagtaccagaattattttcatagttccaccattaaaatttagaaatttaaccactcagtaaatactcttccccatggcatctaagtgaaagctaaagatattttccccttcaaattatgaactatttgccccttggtagtttttccagattcccacctttattgcctaaaaattaatattttgtgcagcaactatattcttgtctgtgaaaggtattctattttatattctaatttcattatcagttctttaaaaaaagatttcaagctttcatacatttattccttcattaaattctttctcagtaccagttatgtgttaggtacaaattatgctgatattaatctcttgaatataaatatatgtgccaaaatatgctaatataaattctttacttgttgttgttgttgttgttgagacggagtcttgccctattgcccaggctggagtgcagtggcgcgatttcagctcactgcaacctctgcctcccaggttcaagcaattctcctgcctcagcctcctaaggagctattttttgtattttagtagagacagggtttcaccgtgttggtcaggctggtctcgaactcctgacctcaagtgatccacccgccttggcctcccaaagtgctgggattacaggtgtgagccaccgtgcccagctagattctttactttttaataaagttcaaaatagcttttaataaggttgtcaaatttgaccaaaatttcatagaagtccaaaatattatgcctctttctgtagatcaaatgaaatatggcccaatttacaagggtatacaccttcatggtagatgaatatagattttaaactagttttaaaaggaatatgaatgatttaattgtagtttctgctgccaaaaagtctccataattattttttaataacttataactaccttgatctttacctgtacacacacacacacacacacatgcacagagtaatttcacttagaatcctggtcaaaaattttcttccacttaaattttttttaagactctcacaaatatacatcatggttttctttagtcggcaaaaaaaaaaaaaaaaaaaagaagaaaacatcaagtaagtgtaattctttcttgatttcccttctcagaatgtcttttattttaagtgtgatggtaaaattatactaaaaatgcatttgtcaggacttgaaagacagtgagagtgattcaagctcagaggaagagcggagagtcactacccgagttattcgccggcgtttgattataaaggtatcctgtagctggatcattatgtggcattgctctactattagaaactccttccttgtggttgtagaaactccttccttgtggttgtgaaatttcagcatgcttgataatgaaatggctttgtgtaatttttttgcacccttgaaagcttgtaaaaacaacaaccaaaaagaaaagaagccatgttgcatggtattctgtataggcctatttgatatgtggcggttgtagttttatttgagaattcttggcatttgtatcctgctttccttgaagaagtgttatgtgaatgagcaaagattctgtcttggtgacacagtagttcatatcaaatgaaatgtttaattgaaaccttagaaactgtaacaaggtatgaggcacgataaagaagaaagagaatgaaagaattaaaaggcttccttctcagtctcaaattcctactgccttaagaatttttaaattaaaaccagttcttcataagcaatcagtggctgagaatttgaggttataacctggcatggatatatgtgacacaatgcaagtcaagtaaaaaaaaaaaaaaatctgaaataggtgtttgtttaactttactaacacacaagaaaaaaatcaagctgcatttttaagtataggagtcaatttaaaaaaaaaaggaaaatagaattcttccctattacggcacaattgaaaacactattaataaatattctgtctttccttcacaaaggtctgttgaagcacttaccttttgcgtagtaaggttccacagaatgcttcttgtagtctcccccttgtcttcattacttcgtcatcagatctttctaagggttagaataattgagttcagagaactagaaagccattttcaatgcgcagacttttgaatatgatccaaataacttgaggcttcttggttactgccctagagagaaagaggaagagaatatctattgaaaaccatttatcaaacttaaccaatcccaaagtgtcaagagacccaacagaaagcacagaagttggcacaggtgtccaaaatttcttaatcctggtgcttttcacttttcatgaagaaactccaccaaatctgccctaatacagtttttctaagactctggaaacattagggaagaaaataaatcgttgtctaaattttgagttatcctgcaaatcaattgtaagctcaatagggttcctttaaaaaccatgaatcacttctttgaaaattccatgtatataagcaagccaaattacttattgctgtctagcacatttgcaagtatttaacctgctatcaataaaatcctcataatcagtcacctcacacatgttctctgggttggggtgggggaatgcttgattctgtttttctgagtttttgctattctcataatcagtgtcttcaagatatgatattttaaagtgaaaggtctagaaaaagcacatagtgcttcgaacttgtcttttatgcttaacatatcacatactaatgttacatctaaatccaccacattcctttataatagctgcccatgatagaagttgactttcttctatccaggacaaaagaaaacaaatatagccatgcaaaaaaagtggaaggcggggataaagaagtttttctctgagaaaacaaaaacaataacttcaaaacctctcaaatcaataagggctatttcctttggtctcctagaattctagatatgcaccagcaagttagctattaagtaattttcttagagtaagttatctttgtttttcagcttaaaatatgattataacatattaacatatttattaagaacttaggtttaaaagacaaaaatccactataatgttgtaggtttcataaaaacaggggagtccgtattctccccaaatactttttttttgagacagagtcttgctctgtggccaggctggagtgcagtggtgtaatctcggctcactgcaacctccacctccccagttcaagcaattctcctgccccagcctcccaagtagctgagactacaggcgtgcgacaccacacccggctaatttttgtatttttaatagagatggggtttcaccatgttggccatgatggtctcgatctcttgaccttgtgatctgcccaccttggcctcccacagtgctgggattacaggcgtgagccactgcgcccagacccattacttcttgaagttaatgtaattttagagagattgagtgaagtcatcagagaataggttttataactgaggaaggcattgtataaacaataggatcattcacaaacaagctttgagagatatctttcatatgagatggaaaaaccaaaggctaaaaaatagttataatcatcattggaagctataggtataacaaaaacactttataaattatttttctgttcagatttttggggcaattgcaaagagtcacacttctgttgcttttctctttactccatatgttgctatctatctttctaatggaaaagagcttgaggactataatagtatatggtgaatatgacatgggaaccatctcttgtcaaaaacataaaatgggaatgtagtacctaaatgggtcattgagactaaaattactgtgtttccaagatctcagaactgaagattggagataaatttatttactcaaaatcacacagccagacagcagcagctctgggactagaacctaatccctagccctctagtgaagtgctttttcctcaatactatacaattggacctccatatctgggcattccacatgcacaaactcaaccaaccttgagaaaataaaacaataaacagtagaagtaagaagcaatatagtataacaattacttacatagcatttacattatattaggtattataagttatctagaggtgatttaaagtatatgggagaatatgtgtagcttatatgcaaatactgcaccattttatatctgggacttgagcatctgcagattttgctatctgcaggggtcctggaaccaatccctgtggatactaaggaacaagtgtattctcttccagaacaaatgaaaaagtattcctttttgctaggctaaatcaggtatttgaccattcagatcttttcagcagcacagaagagggcagcattgggctgtcattcctgggaaccatttgatggggctggaatgctgggaatttgacttacctcatggatgctgtccaaacctggactgaaccagcatagttaacactgtttgccatagtaagccccctagcacttagtatcccagttctgaaaactagtctggggtggttccatccctcccagagctagctctggctgggaagtatctcccagaggaagcagtatgtatgctaagcattggattgccaaaagtctgggcaaatctgtcttcttagaattccatttgtataataaatgaggtgacggcgatttttctctttactttcaaagtggatccattctttttctatgaagttttaaccttttttttacatttaatgttttcaaactcctatagaatgagtcaagtcaacaaaatctcccatttgtcatgggacttaaatgaatgtgctgataaaattctgatctctatacaatttgataatatacagtggtttcaaatgcttagaagcaatttatgttactaaccagtcgtgagtttaccttattagcttagcaaatccagtaactgcaaaggtaaaaaactgtaaaccaacacacaaccaaactattgtgaaatttcataaaattcaaataactgaatttttactatatagtacaactgtatttttatttcaatttttcaacatttttactggttttctaaataagagcttacatgtatgtttctgctaactcaggcagttcaaacgtatggtaagttctatccgttcattccatttcccagaggtaaccactcttcacaagcttcagattgtttttacatacatatacaaatatgtgtgtaaaatatgtaggtttcgtactattcatattgcttagtatttgctttttgtaaaatatatcgcatcaatcctatttttggacaattcaagttttaacgtatccatcaaagcaaattggtacatttcatattgtcactcttccattttattcaaaaattctaagagaaataaaagttataaaatgcagtgcttctagcaggagtccagagggaagtacagttaattttcattaataccgtcaccagaggtgaaaatgtaacaccacatgtgctataattttcctttataatggttggggggaagggaagggaggttgccagaaatgatgttgtcaacaagaccacggggacaattttgtttacttaaaaatactaagtgttttcaagaactttaaaaacctcattgaggccgggcgcggtggctcaggcctgtaatcccagcactttgggagcccgaggcgggtggatcacgaggtcaggagatcaaaaccatcctggctaacacggtgaaaccccgtctctcctaaaaaatacaaaaaattagccaggcatggtggcgggcgcctgtagtcccagctactcaggaggctgaggcaggagaatggcatgaacccgggaggcggagcttgcagtgagccaagatcgcgccactgcactccagctggggcaacagagcgagactccatctcaaaaaaaaaaaaaaaattgagattactttctcccattgaagagaggccttagagctctctcttaggtaacatttggtctctaatatagttgacagaattaaagatggataaattttttaaaaatgtattttatgactccctgctgtctttcctatctatttaatcaactcctatctaatctattcctcctattcattttggcttattatttataaataggttttgctttttgtaaggctattaatctaagtcaatgaatctaagtcaatgaatacatacttgtatgtattcactatgcttatacatatgcttacttcatagtcctttcagagattgtccaaacaattcaaaaattaactgacatcttttcccacaaaaagattcattcagtacctgcccaataggataccattttagggattttcctgggttctttaattgtctatcactcaaagatgtgtacatttccaaaagttagctcaaaaatatttgtcattcgtgtttaagctataaggaaaactttcattactttttattggctttttttgctgtccttatgactttacttttaaaataaaattttgggttttctccaaacatttgaaaccaccaaccatagaaaatacaaataacactgccattaaaaacgtgttgcaaattttagtgtatttacacaagacctctacatttttccagtttttctcccctctcttcactgcgctgattcaaacttgtcataagcaagattggagatgcactaaacaagatcaagcaacaccttgttttattttcattccacctataccacagtgaggaaaaacaagttaaatgtcccgcccattgtcatgaactatgcacccacaaactgtaagaacacaaagtcactttgtaataagaaaaaaaaaaaaatgagaacaaaactttgctagcaaaacaatagtgttctagtctttattctgttattttgaaccagaactgcctttctactgattgtgacatatggtcacatgacatatggcaatcatagaatgttctcaccattggctggcactgaccaaattatcagagccactatcttttccatgccagtaacacaaagagttagaatctcacttttccaggaaggcagctgtttttgtgattggccattttccctaaaacaaaacaaaaccacatctgtacactgccaagcagcattatccatttcaccttttcagtaagaagtttgactgacagatcaataggaccctggaatactagtccatccttaagatctttatccttgttctcccgaactataagtggcacaaatcttaagttaaacacaaatgaaggtaatgtattgcagatatggtcctacttctgctgagtagtttgtcgtgttatacaatcatagagctagtggagagatactatggagccatctaaatccaccaagctgtctatgacaggaaaataggcgcccaccctggagagttaagaatgtattctatttttaaaactcatagtgagacctttcagagtttcccctccaaaattagataacaaatcagaaagccagattctaactctgtattactggaatgtaaaagatagtgactctgataattttgtcaatgccagccaatggtgagcacattctatgactgccatatgttacagccaatagagatgcagcagttctggtttaaaaatgacagaataaagactaaaacactattgttttgttctcatttttttttattacgaaacaactttgtgttcttatagattgtgggtgcatagatcagaagatatcatcttaaattcccttggtattgattttatctatttttttgcctatggcaatgaagatacttcagtgtataaactatgtactatatccgacacaattattctcacttaagagctatgaaagattcagtcttcaagattctctctgtaccctcaacttttctcataatctttcaaaaaatgtgtgtattatctttagtgaatgaatttttaaataaaccagagtgataaatatcatgcccaaactaaggtactatcttagttcaagttagataaaactcaatccacaaaaatctctagagattcggtagaactaatgaagaaacagtgcttaaagtgagacgatctaatcagagctctaatccttggctaaaatttgtctcaacatatgaagcctttcggtttacagtgtgtaactgcatcctataattatgtattttcaaattcttccttctggaatctgttgctaaccatcacgcttatacatacttgaggtttaatgcttgaatgttgttgactgctaaataactgtcagtgaagtcagcctttttcccttgcactggagtagcaagtagaatttacaacttatttctctaaaattccagagcatgtgtgtggtgtttggagtagtgtggagatttctccatctagtatgttgctaatctttatgccacatcctttagggagaggaagcaaaaaacattcctggtgaatctgtcacagaagaacaatttactgatgaagaaggcaacctcatcaccagaaaagtaatcatcattcagatttcatgcttctcttggaatttagattttctgcattaaaaactctgctacttttgtgctgtagtgtcatctcctaaaacagaaaaatctctacttttcaccattacttcctacagatcactcggaaagtattaagacgaattgttatcccacaagagagaaaacgtgatgatgtggtaatggagagggattgccaaagagaatgtagaggacaaaagctttgtgcactccctagaaattgctgctaacaggctggcatctgcagtgtggcagcttgaagtgtttgctgcttttgacatcttatgcatttgatcagggtcaaagaaaaatacttttcttcctaacattctttgttacatacttttttttttaactgtcttcagagttttcacaaagataaggtcatttataggggacagaatgtgccagtttgagggagaaagaagataaaaccttcaccattcaccaccaaacctcagagcagtgcttcagccccacccagggcttggccttcagcagagtgtctgttgggacaggggcggagagcactccaaaagcacaggctttaaaagttagaatggcaaaaggctcagttcaagatctgcacatcggatccatacattttctctttccagtatgttctgcagggaaatctgaattcctccatcttcgtctgaggagggggttcccctctttgggtttataacagcccatttccaatgtgccagttaaagaatccctccagtcaacccctttctctcagagaaaacatctctggttatttttcacttgtttctcagatctctacccttttcaatttaaaaatagaaacttcaatagacaatgtttacattagaaaaagtaaactgaaaatttatcagaagtacaaatcacaaaattgaaaaggcttcatttgttttctgttaaaaattgggtaaaaactgagtatttgtgccacaaccttgctctcggggaactgtattcctgatgctcagtgaagagaggatttgtttacgcaaaatagatgccttcttggtctgacagtaagaggaagtcattggcaattccactaacttaaaaaagtccctcagatcaacagcatttccatggattagtacttaactaagaagtctgaatctcattgcaacagattgtttacaattctgctgccttatgagctgtggtgctgatttcttttagcttactataggaaatggataggctgctcgttattttgatttatcactaacttactgaattattgtcaagtacaattatgtggtattcattttgacagtgctctctagcttgcttgatgatgctaaactgtgtggttaagctaaagattgtacgtatttttggacatgaagtgacaaaatgctttaaactgtttcgcttgtcctaatccagcctccaaggatcagaatgggactgctttataactaaaactgtttcacagtgaaatcttaatatgtacactcctttcaaagcagggagaaggttttaaggtgaaaacgaagaaagaaatccggcatgtggaaaagaagagccactcgtaacagcgaacggtcagtcaaggtgaggtgtgttcatatcaacaacagtaggacttaaattcctgtgaaacttataaatttcactaaataagtgattcagattttccccttcctttccttttcactgaatttcagctttgaaaatcaaatacgaagttgttcaagttctgttgatgtttgcatatatacacacaatgaaacttgacttcggtttcacagtccattaactttctcctcacaaattaggcagcaatttaattgtaaattatgtttgcagaagcaagtataaatagtgataagagtaaaggctcactatgaaatacaatagccttatacaatctaacaggaagactatttggcaacgaatacttcttacagttatactcagagttttattgatccagactttcaccattttagcagaacggcatctgaggatatcattttggttgaaataagtgactttccaagtctaaattaaatgactgacatatctatctggtgttttatagaaacaaaaggaaaaaataggaggttaatggcactgttgtttgttttttaagttaaatgtttagtaagtgagctttgtttacatttgcctggacttttctttacagatcacgttattttccttttacattgtcctatttatttctacttagctacaattaggccatatggggtgaaaaagaaagtcctctatagtctgtaaagtaaagcaaaatcacttcctttagttcaccgccagtcttcttagccccacaggttaaagtagtaagaaagagcaaacagattctagttttcattttcatgcatctgctgttccctacttgccaggatactggtatgcagagtgctgagggaaggaactgggaagtaatctagtttcactgcctgtaattttatgtgtgagctaactaaggcccagataagttctcaattctccctccccgcaagccttatcatttgtttattcagtataacatttacttcatttctttctgtgagactttctcacatgaccatttaatggcattgagaagaccactaagaactgcagagcattctggaaagaatgtttactacacatcctcttcccagtgtttcatgcgtgctcttcaggcaatcctcacagccaaccctcttggataaggccttcatcatccccatttgatagatgaggaaacaggcccaaagtggttaaataaattgcccacgctcacataagtaaaaagtggcagaactaggatacaaacccgaacaagctgcctccagtgtccacttgtttgccagagacttaacctgggtcagaggtgacggggaaggtttctttgagaatatgatgtttgagctgaattttaaagaatgagtagcagtcagtcatccctgtaaggattctgggctgtacccgaaaagcagtgggaaaccactaagggattttaggcaagagtgtggtatgatccagtttatatgttctgcatcactcgctctaaatgcagggtagttgttaatgaattggaaggggcactggtggatgaacagaaaacctgttgagagactattgcagaagctagcttggcagtgaggatggctaaataaaaaaatttcaacacaacttggtttttattggatgagaaggatccaagatgagaaaatgaaggatgacatcaatgtagcagtagctagaatgaacccactcctatgcatgtcctactgctgaacctggtgaaagacttctccctatagcagatccacaaaatactaagcatgagtttgttatcttgaattcgtctatttatgcaattctaagtgaaaaatgaaacgaaagtagaaaagaggtcagtcatctgtagtatgcccctaaagtttagcagcttgttcaatcatattctcaggctcctagtggaaaagaaccaaaagggttacctacaccagctgagccattttctacaatgacatattcctaatacctgtgaataaatgacaccaaaaaatatgacagtgctatgcttccagggtcctttagactgtgttgatttaaaaacagcttgctcactaaatataaagaaagttttaaaattttaaataatcatcctataaagaagttgtcagactcacttgctgcaccactcaaaggagagagaacgttgggtagattcatatgaatgtgaaaataacttcagctaaagcaaacaatgtgtcagattgaaagaacagtgacttgacaagcctaattttactttccaggtagtgtttaccttccgtaagtgaacttagggaatgagtccaagaatactgcctggaattccaggagactgaatgtatgtgctccggaaaaatcaatttgcaaatatattgagagtttttatagtcatgctggctgcctctttaaaaaaaaaaaaagaaaactaagcaagtagaatgctgccaaatatgactgagtcttagatggtaacatcaaaatttgtatttcccattttagaagcagttgaattttgagctatctgaactctgcccctgcttttctttaatattgagtcatagccatcctatttttaaagagaaaagccaatgactttcaagatttgtacatagtatatagtgatttatagtttacaaagtacttttacatttttgtcttatttaatccttccaacaagccttaaggcaagtcaggcaattttgcttgtgaccttttacagatgaggatattaaggctcggacagctcaaatgatgtttctgccttcacacagtttatgactggtatagctaagacttgaagtcaagattattgattctcagcctaatgttctgttacactaagctatctctctaaaattatttacaaagaataataacaatcatcttctgtgaaatgattgctatgtggcaggcactaggtaaataattatatatataaccttaggaaatccccaaaacaatgctataaggtaaatacaactatcccccaaccccttttttaaaaaaatagggaaactgaggttcagaaaacttaaatgatttactcaaggtactacagctagggagcaaaagaataaaatttgaacttatctagaacatagatcttaactactacttatattaataaatagtatttgatcattaaagacccaaaagcaaattctgaatcaaatacaagcacaaaagcaacctgtcgtaaatttcttcttactctacacagtgaaaggactcatagttttttattcttttttcttaaacaaagcaagacttcatttctaaatctctagatttttacttcaaataccaaaaaagggggctgatttgtgaggtcatggcaagggaagatccccagataaaaggtcatttaagccatggcaaagacttgcatgacacatactgtattctaaacctcctctaggaaaatgctcaggttctcacagccatgtgtaagccaagagtggcaagagtgcccatgcttgtcaaggcagccctttacctgaggccaaaaagttaacccatttcatttatttcttcaaagaatatttggccatctgcctggcttaaagtggaaggactagatatacaatagtgaataaatgcttcatggtccctgtctttctggatctcccagtctgcaatgggaaaaagaaatgggacaaatgtttaaacactgaaaatacaaagtccaggatccaatgaaagaatgtaagaatgtacttagactttggggctagggaaggtctctctgaaatcatgacatttaagctaagacctcatcagtggcaccaattatgaaaataatggagaagaagaggaccccaagcaaagggtacaacatgtgcaagcaccctgaggtgggaaaaggcctaacatagttgaagaaatgatagatcagtgcatgatctttcatttcttcaaatatgtaagattggtgtgtgatctttcatttcttcaaatatgttaggtgagctggtggtaggtaagataggcacaagataacattaaaacacacacacacacaccatcattcagagccctgtaggccagaggaaaggatttagatttcattctaaagggaatttaaattccttatagatgctcgatgttagacttttgtcagatacatagtttgcaaatattttctcccattatgtaggttatctctttattctgttgatagtttcttttgctgtgtagaagctccttaattaggtccagtttgtcaatttttgctttttacaagcaaaaaaccacccaccccattaacaagtgggcaaagaacatgaacagacactttttgtttcttcttttatttttgagacagtctcacctgttgcccaggctggagtgcagtagcacaatatcggctcattgcaacctctgcctcctgggttcaagcaattctcatgccccaaccttctgagtaactgggattacaggcacatgctaccatgccccgctaatttttgtatttttagtagagacggggtttcaccatgttggccagggtggtctcaaactcctgacctcaagtgatccactcaccttggcctcccaaagtgcttgaattacgggcgtgagccactgtgcccagccacgcacagacacttttcaaaagaagacaggcatgtggccaacaagcatatgaataaaagttcagcatcactgttcattagagaattgcacattaaaaccacaatgagataccatgtcacaccagtcagaatggctattattaaaaactcaaaaaataacaggtgctggcaaggttgtggagaaaaggaaacatttatacactattggtgggagtgcaaattagttcaaccattatggaaagtggtgtggcaattcctcaaagagctaaaaacagaacgaccgttcaacccagcaatcccattattgggtgtataaaccaaaggaatataaattgttctatcacaaaggcacttgcacatgtatgttcactgcagcactattcacaatagcaaagaatggaatcaacctaaatgcccatcaatggtagactggataaagaaaatgtacacacacatacaccatggaatactatgcaggtataaaaaaaagagtgagagcatgtcctttgcaggaacggaacatagatagagaccattatccttagcaaactaacataggaacagaaaaccaaataccatatgttctcatttagtggaagctaaatgatgagaacacatggacacaaaaagggaaaaaacagacactgggatctacttgagggtgagaggggagaggagaggaaaaagtaactattgggtactaggcttagtacctgggtggcaaaataatgtgtaacaaacctgcacatgtacccttgaacttaataaaataattgtttgtgtgcatgtttagaggaattcgaagcctctgaaggattttaagcaaggacctaacttggtcttttttccctctttaaaaaaaacacaagagcacggactatctagagaatggatagggggacaagaataaaatgaaggtaaccagttaggaacttattgcttcagttcaactaagccataatggtggcttcagctgggaagattgacagcacttgatagattagcatggtgggtagagtggagaagaatcattgagtcaaaaatgactcctagatttctggcataagcaactggatgatagagaaagaagcagaagtggaagaggaatgagttttaagaagaatgacaggcattcaggcttggacttgggtttgaaatgctatgagacatccaagtatttatgttacatatgcaagtccgaagctctgaggaaaagttggggctgtgcatataaaaatgtgggaatcatcacaaaagaaatgggtattgaataccagtgaacagatgtgattacctagggagaaaactgaagtaagccaagaaggggctcaaaagttgagtcctcaaaagcaacatttcagagtttaaaaaaatttcctcagccagatgcagtggctcacgcctgtattcccagcactttaggaggccgaggcaggcagatcacgaagtcaggagatgtagaccatcctggctaacacggtgaaaccctgtctctagtaaaaatacaaaaagactagccaggtgtggtggcgggcacctgtagtcccaggtacttgggaggctgaggcaggagaatggcgtgaacctgggaggtggagctttcagtgagcctagatcttgccactgcactccagcctgggcgacagagcaagactccgtctcaaaaaaaaaaaaaaaaaaaaaaaaaaaaaaaaaaattgcctctgacctctctcttccgcagagctccaaccatgaccctccttagtaagcactcaataagcgtcagctattgctactagtattaaaaaaaccaagaatagaaccttgaagagctttggattacagaggctggtggactaagcagcagcagccagtgatggctagaatataacagtgggagaagtgagaacagcagtgtctgaaatcctctgcatgtgatggtggtttacacttcagaaaagtttccactatttcacatcacttgtttttcacagtagccctaggaagttagtacaacaggtatccttattcctctttactaagcaatgaacagtgacaaagagagagcaaaatctctaaggctgagtgcagttaatgacaggtctggatttcctgattctgattctcagaagtcagagctatgggctgaattgcttcactacaaattcaggaccctgccctccagaatattttaccggaattcatatagagtaaatatgtttttatattatgtattttttatttttcttaaaaatatataatattttttattttaagaaataaaattagcccagctaattttgtatttttagtagcgatggggtttctccatgttggtcaggctggtctcaaactcccgacctcaggtaatctgcctgcctcagcatcccaaagtgctgggattataggtgtgagccaccgcaccccgccttttttttcttacccttaaaaaattcctgttaacaaaagccttggcttcaagataagagctagaggcaggtggcttgatttccagttctggctccactatatattagctgtgtaaccttgagctcactatttaaaagctttgtggctctctttttggccgggcgcagtggctcacacctgtaatcccagcacttcgggaggccaaggcaggtggatcacctgaggtcagaagttagagaccagcctggccaacatggtgaaaccccacccatttctactaaaaagataaaaattagccaggcatggtggcacatgcctgtggtcccagctactcaggaggctgaggcaggagaatcgcttgaacctaggaggcagaggttgcagcaagccaagatcgtaccactgtactccagcctgggcgacagagcaagactccatctggaaagaactaaattaattaaaaaataaataagaaaatagagccacaaagcttttatttatctacaaaatggaaaaaataatagtacctcagggttattcggattaaattagctaatccactttagaacagtttagaataaatatctttacctaataaaaataataacagtaataaaattttattactgttaggtttttctttcactgctaaaacacgaatgaacagttttccagtatttttttttccagccctttgacttaagatactttttaatcacaagtgaacagaaaagaacaatcaaaaaagccctacttattggtattagtgaagaaacaaagctacctgaattgggaattactttaaaactgcactgtagtgtattttagttacataaagtaattaaaattaatgtttagaaaaaagtcttagtccatgatttctgtaactacagagaaggaaaaagagaaaagaagggaaagagagaggtgggtagggagagaaacaaagaactagagtaaagacctctttgtcctcagtgggctcaggctttccttaagccatgacacagctaagtcttaaagatgagtaagagttgaactacaaaggtggatttcattagggaaagaaatctgaactttcaaggaggtggcatttgaaacaaatttgaagggtagaagaggaattagccacagatgataatcagagaaggcaagtataggtggatacaaaatcatgagcaaagacaatgaagttggaaaacaatttgtagttgatacctggcatgtaatctagatcctcaaagtgaagtctgtggaccacagtatcagcatgcctaaaagtctgttagaaacacagaatttcaggctgggcatggtgacacgcctgtaatcccagcactttgggaggttgaggcgggcagatcacctgcggtcaggagttcaagaccaccctggccagcgtggtgaaaccccatctgtaccaaaaatgcaaaaaattagccaggcatggtggtgggcgcctttaatcccagctactcaggaagctgaggcaggggaatcactggagcccgggaggtggaggttgcagtgagccaagatcatgcctttgcattccagcatgggcgacagagcaagactctgtctcaaaaaaaaaaaaaaaaaaccaaaaaacaaaacaaaaaaaaaaacaaaaacagaatttcagacacactgacctactgaatcagaatctgtactcaaagactcctgtgtaatgcagattaaactttgagaagcactgttccagaacatttgactggctctcaaattatcgagttttaaaaaatttttgatgctggccccatcccgaaaacttctatataaactggtatgggatgtggcctggatattgttgttgttttaatcttcccaggtaagtctaatgtgcaaccaagtttgagaaccactggagattgcaaaacagcttttcagtgagggacagtgggaattaagcctaaaaaaggttcactgggctggaccagagagcttcagatgccaaactaaagataggagaccctttttaaagctaggcattagggtctaaaatccacaggtatgtccatttgcctataaaaaacaagtcagttctgtaccagagcatgctgctgacttgaagatgtgatgtatgcagtacatatttaactgtaaagtatcagctgccatgaaaatccaatgaattgctgtttccaagtttttttttttttttttttttttttgagactgagtctcgctatgttgtccaggctggagtgtgatggcccgatttcagctcactgcaacctccgcctcctgggttcaagcaattctcctgcctcagcctcctgagtagttgggattataggtgcctgccacctcacccggccaatttttgtatttttagtagaggctgggtttcaccatgttgtccaggctggtcttgaactcctgatctcaggtgatccgcccccctcccctgcccccggcttggcctcccaaagtgctgggattacagacgtgagccaccgtgcgtggccctgttttcgtatattttaaaatgtttcttaaaaatacagtgaaatggctaaaaggaatgattggttttctgatttagtttctcccacctttaggtttgaaaggcatacaaaacccaaagcaagacagattcctaagtgcaactgcatctatctcatatccattatctaaaccagaaaagggagatgagtcaaaattctatttctgaaatgtcatcttgatggcttctgccctcacaccttcccatcagatggcgctgtcatcacagtttataccaagtgtcaatatttttatagcaagtacacagtcacttagccaaggttctcatgctttttatgcaacattgtacttggtgtaaagtcttttgtccaatgaatgaccttcctgtacccagtgtggttgggaccaacaggctctgattgcataaccaagaaaagaaaaagttataagaggaactaactcccacttaaaaaaaatcacccaaaacatcctcactggaatataagtgggcataattcacagcatttttttaaatgatagaaacatatccaatatatccagaaagataacatttgcttggattgaggtgagaagagaaaggccttgctactcattacgaaattaacctgggaagttggattggtttttaggagacatggagaaaagtagtgatgatcacacatctacataaatattaaaaattatcaagccaggccaggcgcagtggctcatgtctataatcccagcactttgggaggccgaggcaggtggatcacttgaggtcaggagtacaagactagcctggccaacatggtgaaactccatctctactaaaaatacaaaaaattagccagacttggtggcacacacctataatcccagctactcgggagactgagacaggagaattgcttgaacccgggaggcggaggttgcagttagccgtgatcatgccattccattccattccagcctgggcgacagagtgagacttcgtctcaaaaaaaaaaaaaaaaaaaaaaaaagaagctgtgtatttataatagctgaagtatgatatacaaattatatatcaagcttcaaaaagtcagggggaggggtttagagaaagcagggagtgagactgtagtaacattatcataggaccatctaagaagcctggtgcctacaagattaggattaaatgataaaaacaggtgagaaaatcctgatcatcatcttctgatttgcccaccctctgcaagatgatctacccaagtgagtcactttccttctttggaacctcagcagagtcacaggggaggggtgttgaaatcacataggaggaattgatactttcatgttcttggctccaagcattagtgacctggggcatggaggtcagtagcacttttaatactaaaaaggaagccaggtcctgtaggggggcagagagaggaagtgctctaccaacatgtttccataagccaggctgtcctaggtgacccatctaaagaggaagatacttgtctgaggtaagtaaacatcttcaaggtcactggaactcctgggccccaagagaagtcgaattctaaaggttgtcctagatctgcaaatatagtctgttgtttatatgggagtgagcagggttattcttaaaattgttcttgccttactcaggatttctataggagctgtatcttgttctcaggcaggtaggcatgcaagtttgtcagcttttcacactaaacaaggaggagagacaatatatgggaagaactttgttttatggaaaaggcaaattcataccacaatagcacacaaaagtatgaaaacctctgccaaagaatgatttattttgacacagtaagactggttataaaacacagatgctttatgcaggaatcttccagcaagacaagacattctcagtggagcctccactaaaaagctcaaataaaattaattcatcccattatgactgacatggacaggaaaagcgaaagttctttgcagtggtagaagtttgtctctaattttaatttggttatggaaaagaaatttcattgtaatgaagtaatgacgcttttcttccttttgaaagattagttgaatttttggagaagtgagagacttacaaagcattcagaaatagctgagatgctctatcctgactccttatctctggccctttctgctcatggaagtcccaaacttcttacattttgatatttagggaagtctcagagattacctctctcagccacctcatttcacagataagactaaggcccaaagggctacaaatggcttccccaagcagctgaataacctgagcttcagacagaactagaagagggtcttcccaacacagtctaaaactgtcaccaaaccaaactgggtgtttgcccgtgcacaatggacagtcgaacaccaaacaccaaagcaccaggtttttgcaggagaaaggtgtattgccacttgactgacaaggagacaggaggaaccactcaaatctgtctctccaagctgggggctgggtcatgtttcagaagcatagggtaatgaggcatgatctgactggatcctgcaatggggtgacgccaaggctctatctgactggatcctgccatgagacataagcttcttaattagctccccagcctgagaacttaggttcctcctatggttgcatatttagttcatctgggcatgctcacattatgtgaccttcatcctgggggtgtccatggcaactcaaaaacaactcacaactttgttacataaaagttgagggccgggcgtggtggctcatgcctgtaatcccagcactttgggaggccaaggtgggcggctcacgaggtcaggagatcgagaccatcctgactaacatagtgaaaccccgtctctactaaaaatacaaaaaattagccaggcgtggtggtgggcacctgtagtcccagctactcgggaggctgaggcaggagaatggtgtgaacccaggaggcagagcttgcagtgagccaatttcgggccactgcactccagcctgggcaacagagcaagactccatctcaaaaaagaaaaaaagttgaaccaggtggtctggtgcaattacaaaacacagatacaataataagcaaggctctctggaggtcacctagaaaagctcactgccttctaagagctttccagtacaccttagggccttgtcctctaaggcatctagcaggtagcagcatcatgttaaaccaccccatagggaatggagggcctctattccctaagacttttctattgaatggcaagtaaggcttacactagttgtcttaaaaaaaaaaaaaaaaaaaaaaaaaaaaagaaaaagaaaaagaaagctaaactcactatctactgtctctttccacaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcttgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacctatctgtgctctacagtctccttgtgttttctggcaaaaggtagttgtctaatcccttgtcatatgagtcctggccaatccaccccattggtcctctttgtgcctctgtggtcactgaagagataatctctaacattcatatgtgccctgcaagctcccagcttataaattctgtgcatttcatgggggagccaagaattaaagattaattgacaagtaagctttgcccacatctgttcaggccttcttgaaaagtgaagaattggagatactatagccagcatgtcaaaaagttgactggcacttctaggaaccatcaacatgcagttgcttttagcccacagagcttgtttttgttttgttttattaatttacatttattgtccattcttacaagttgggacatttcacataattaagttgctaacatctcttaaaaagcaagatttggcaacaatggacctcattcccagaaggtaacaacctgctagagccaagttgtccctgccctctccagccaggtgtggggtctacaggtatcactgccacagcctcatttcttatatttgtacaacctgactgtgaatttgcaacccatacactgcgtgaatctaaattctactgaggcagagaccatggctgttttaacttttattctagttaccagcttagcatatggtagtagtgatagtagtaactgtgatcatcatcactaaaactggagtgctcactacatgctattctctgttctaagcacattccatttacttacttagtcctcatatctactttatgaattaggtactgtctttctttgatggtaatgatccttttataaaattaaattagtgctaagagactttcagcaatgttatatattgcctgtccattaaagattgttgccaaatggagtgagttgtccccagtaaggattcactatcaatgcagaagaaatgcacggataatctactttgcataaagaatggggctaggttgcatctgcatggtatcccaaataaataaaatgtgccactacccttgcaccaaaattattttatgatgggtaaagttagacccttgagaggttttttttttaaaaaaaaaaaaaaaaaaaaactttcccaaaatgcctctctgtaaagccaggatcagaatataggtgtcctaacttcctatctaagagttacgaatttctgactcagtctttgagagaaggtgtttatcctgaaccagaaactcaatgatgtatacctgtttaggtattaaatagttgtgtttatatgcccaaaaatttgactttaggtatatgtgatatgctttggttccgatcaagcaggaggtcataagtttactcagaagtatccaaaatatgacattcaagatttaacttgcatatgtgtgtatatgcatatatttatacatgtatatgtagattgaatgtgacattatgtatttctaacataatatttggcctgccagcttataaatatgtatttaagcttttcattgattgacattactgtaaaaaatgaattatgattgagaagttctggatatttgctgtttttttcattttatattcttactaaattattgaatttgttaaattaaaatgtgctatcactgtattgccaaattatggcaatacactatgcagtattatttcaatactttaagaggcatctattacttcattgaacacataagcagctagcctcctttcctctgtaaataaggactttttggcatcctgatgttcctcgctgttcatttggtatcatcctggagttccatcaagactgaggattttctccatggccaataaactattgtcagcatcagctcacgtttggctgtatgacagggatatgtgagaagcccagaaataaatcacaaaaataataaggcatcttctgagtctctctgaagaagccagtgatccaaaaactaacttcatatctgagtgagtcttggtattcttgatttgcttgaagaggctgtgacatattacaaggtgtgtaatttcccaggcatatcacactgcttctgtttcatgaattgatcaaattgtccagaagtaaacatttacaagattgagatttgaaccaaacttttcaagagttcttttaataagaggtggaaggcagtggtgtaatttctttacacggttacctggctaaacatgtaccaatacaaaaattaaataatagagcggattctgataagtatccttagtaacaagcccaacagctttcatttctttaatagaatgaaatgcagatagttcaaaaatagagcaaaatgaaatttaccattatatctgctgcacttattcattgttagctacatatgatatgtacaagtaggtgaacatgaagtgaagaatttttactcttcagcccctagtgcttcctgagttagggagtaaaacgccctgagggttgcatttccaactggacatcctgagactcctcaccaattccaaaagctttccatagcaaagttgagatgaacatgctcagaggattctaaggcagtgagaagaaccaccttagaatgccacaggaagcacaccagaggcaatacctatgaggactttttttctaggaccaccatggaactctgatgtcccaaaaaacgtgatctccctgcctgatttcccccaacatcctcaattaccgcttctcctttgtcatctaattcaaccattggcataattctgagagctgggatagaatgatggcttgccagcttttcaaaaatgttctgtcacatgacgtatgtcaccaggtcttcatactagactgtacactccctggggacagggactttgttttgttctatgctatatctatagtacctaggatggtgcttgccaccttatgagtgctcaagaaatagttgttgagtgcaagaatgaatgagtcagcaaacatcagagggcaaggagcagtaaatagggaatgttactctataccattttctttacaggctcaaccaacttggaaattgaaggaaagcacagcttttgattctaatgacttcattcaccaaggactaacttgtgtcaccaacctccactggtccattccagttgcacaacctccttcttagccaaagagtccttagtaattggggtatggatgttccaatacctcatgagcaaagagcacacagtcatgctgctgaagtggccatccttcctgtggccacgggctatggtgctcatcctcatcactgactggccactgagaaaccaggcaagagtgtggagaacccatcatgaaccttcctgtctataacaaagttagtttggttgcctccaccttggtgttgctgagtaaatgtgtttcaccattcaccacagctcctcttcctttccctgtttcctctaaaatccaacttactttattcatttctatcccacatctctgtttaatatcattagaggaaggaaaagaaggcaaacgaatgctattctgtttaaaatccttctttctggcaagccagatatctacctcattttcatcccgtctctctcaatgccagtaagaggaggatggaataaaggagcatgtaactgagaagacaaagatggatcatgtggttctccaaacctatgcatccctccaatcattcttctcatttcacaacatgtactcagtgcctaccaccttccaggtgctctcccaggcacaggatacatcagttccctacccactcccgtcaaagtgaggagaataccaccagcctctgtgtgaaatctaaattagggctcctcaggacaggaaactgtagaattacttgtggaaataaaactaccgcagcacatcatagggagtgcatgctgaagaacgtgagaagacatgtagaatggggaggaacagccctgtggctgctgagtgtaaccaatgcactttctctttttttgagatggagtttcactcttgtcacccaggctggagtgcaatggtgtgatctcggctcactgcaacctccgcctcctgggttcaagcgattttcctgcctcagcctcccaagcagatgagattacaggcactcgccaccatgcccggctaattttttttgtatttttagtagacacggggtttcaccatgtaggccaggctggtctcgaactcctgacctcgggtgatctgcccgcctcggcctcccaaagcattgggattacaggtgtgagccgcccagccccactgcacttccatattctgcctgctagtcagaattaagtgggactcaaggcctgacaaaaatatttcaatagaaaactttaaaaacattttaaaggtagctaaccaactctataatactgtataagctcatttgacttccagagattctgaatttaggtgaaaccagttgtaactttgaactcatgcacgatgttctccttccatatgtcaactcctacataaatcagaccacttcacagagtctgtccctgccgatgccagtccacactggcaactggtaaactaaaggaatacctcacaatgtggcactcaactctacatcctctggtagtccccttgctctccaacaagccttgtgctttccacatttccatgagcagagctgggtatacagacggtttgtaatgttgagcttcacatgcctaatcatttaactgttctttatggtaaagccttagacttcagctatgctgcaatacacatctgatagctcagtctgggcgcacaccccacccactggaagccagtgcttaagtgcagtgaagagtggagctagagctatcacacagcctggctttctgacactgctatcatagtgtgccttgcccaggtggagcctgaaataagtaaagaatatctagggaaaagcctatgaaatattagcctatttaagaacatgtggctctaaagaataataaaataaaacagatgtagtggtgacagctgtagcattgtaagctttagagtagccctcatgcttctggccatgataacactagattctcaagttccttaggccagagtggtcacactgaagtgtctgtggagactaggcaggtcatctaagcaaaggggttgttgtagactattgtacataaataatagctgcctctccctgagggtggattacacttcccagccccaatgccttcacccttgccatggaacttgctttgggcaatgaaataacagcagatacttcaggagatagtgtatttttgttaatgtaccctttcctcactccagtgatgctccagagagactgctccctgctctgctgctggggtgaagatgatgtggagcagaaccacagtcaacccaccatagataagcaatgtgagcaagaaataaacctttctagtaagccagagatgttttagtcatttgttactgtggcataaccactgccccaattaatatacaagtcaggtataagacattaagggctgatgggtattgggtaagcaaattcctcttctaatgaggctgccttgtgggaatataagcccagctctgccagattttgaagttttctaaatattggcaactaattttttttccctaagaatattgtatgggccaaatgaaacatgcctgtgggtcaccgttttcaagctctgccactagctcttggcatttgcaaaatggacacgttcttagatcatgctacacaaatttattaatgtatgatttttgatcacaccctgtgagactagtgtgcataagcaaataactcctgagtcggattcacagactaccccttatccccacctcaatacagcttggtttttctctatgcgccatttcaaaccctggaactctaaggatctcaaggagtcacttaagcttttttactcacattttattgccttcttagtgaagacttcaccagtccatttgggctttgtatggttccctgcctacctgtataaccacatctcatgccaccttatctctttctctcattacactttagaccagtgataaagtgtagcccatggactgggcttagtctgagaagcccttgttacctgtctgcaatgagacaagaaacctgagccagaatgtaaattgactgcattactaagcatattccttagttcagctgatctaaaaaatacagtatgttaacttatgtaatacatagtgctccccatatagtcttacgttgtatttatttcagaacatatcttggttttatgactagaataaagcttttttgagtccatgggtctcagctcttattcctttttattcctgatacatacatatgtctagagcggtgacttggacacagtataaactaaataaataccacttgagctgaatttgatttacagccatacccaccatacatccatgtcccactttcatcccctcatgcagattccaagcttctcttgaaaaatcagaagagctgacaaatctaggcctgaattcctgcattgcagtattttgttagagctaactaagcactgtttttggttggagcatgtgctctcaagttttctacagtctctactattctatcatgccttgcacaaggccctgtggcacttgatttttgaccattgtaaagccaaaagagtttagattgcagctaccattttgccccactagggttagaagagttgcagccattatagaacgtagccactcaggctgcctgaacagttcttttctgttattgtttaaccaggaagattttcatttcagccagaaagatggctcatttttctaacaccaatttagcagaggctgtgcgtacttgggtgattcaaagagtcatctaaagatctgatgccatgacacataccagatgactttaacaaccttcccatcacatgtccttggcacaaaatggaaaaacactatgatgacacctgacagtaacagaagtctcatgaaatactgtggtgggggagttgttataaagctcttctcagcaagacttcactgggggtggaagcacagcaaccctcaaaggcaaactgaagttttgataccttacagtgagtcactgaagatgtgagtggttttccttgacattcacagcattcacaagatactgatccaaagctatacttatttgtgcttcccttcatccctcatttatttattcaataaatgtttgcatgactactagtgccaggccttgtgctaaatgctatggatacagcaatgaataagaaggacaataaacaagtgtacaaataaacaaggtaattatagtggcagatgctatgaaggtaataaaaatggtgatgtgacggaataattggggggaatcaagatactctagagagggtatgcaaagaaggcatagagagcgtgacatttggaagctgagatggagcttccctggcagccctctgccaataagtacaaatgagacaggatgagaaaagaaggcccttgacattttttgagaaacagaaagaagaagctggtgtggctagagccgtgctatgcagagcatcaaccagtaacaagatcaagaacttgtaccagcctgtaattctgtaccattttcttctcaagaaaatattacaacatatattagtataaagcacaaaacagtaagtgccacatgtgttggctgttatgattgttaatagtattattccattttcataatgatctcaggattggttgacgaagtgaactggaaatggcctagcagagagccttgcacatattagacacacagtaaatactagtttaatgaatgaatgcttagtggaagagcagcatttgagttggaacttgagaagcaagtatgactttaatatgtgaagaaaggaggtctaggcaaaaggaataagaggctagaaggcataaagccatccaaagaagtgtgagcaaaatttgttttgatcataatttgaggagaaaggaggaacaaagatggaaaagagtgacttaccgttaagagacatcacaagaattgtaggcacggctttcagcagccatcttcatcaatcatatcttgtgtgcatttgctcgcatcagcatgtttgcaaaaagtagctgctcaatgactgcaaggctctattacacactgggctcgccatgcaagactctaaggcttgggaacctgagtccatatttgaaaagtgtttctgagttaagtgggagatatacctgggcttgaaaacctatctttctggacatgtaccataggaatccatcttcacgtaaccttaacaaagcaatttctcatccctctcccaagtaagtgaagcatagttttcaccaaatgcattttctaaagccagttgaataagaataaagaagccattggatgagtgtgtcatttgcatgatttaaaagctaatcaagatcaactgcagaacaagaaacaactacttatgaaatcctaattgttgactgactgacatgaggcaacatgagcaaactaaggcccagagaagttaaatgactctttcaaggtctcacagacagcttgtggtagaatcaagactagaattcacatattgcaccacaccctactgcctcccacttggtttatggatgaacctaaagagtcatgtataggggatggtgcaaaaaggtatctcgctccagctggattcacctgaggtctttgtgactgcaaatcaaaatgttatgaggactcgttggcccttatcttttatttaagaggaatttttaaagtgtattttaactgacaaataattgtacgcattcatagggtacagagcaatgttttcatacatataatgtagtgatcgattagtgtcgttatcatatacatcatctcaaatatttgtcattttttggtgttgtgaaagtttaatatcctcctatttgaaactatatattattgttaactatagtcaccctacggtggtatagaacactagaacttatttctcatttctcctctagctgcaattttgtatcctttaaacattcagcctgttgagcatcttctctcttcctttgtcttccctcagagtcctcttgctgggtctcctgctacttctctaggtgctcctgattagttggtcccaacgagatcctcttctcctacccatccttttaccattgggatagaccaaaactctgagtgatcttatccattcccaaaactttagtaaatattaatgtgctgacaattcctagtctttatctccccccaccatatctctgccctaagctccagaactcatgtatcagcagccttcaaggtctctccactcagataccccacaggctcttcaaactcctcatatccagaaatgaatacatgcccatcccctcaaaagaagtcagctcagatactcttctctgtgaatggcatcaccatccatctcttgcccaggtcagacacttgagaaacactcaggtaatccccctgctactccatccagttcaaaaacatgtccatcatatctcctagtctcttcaattgtcgccattcatacagccctaccttaggtcctaagttctcatctgagtaactgcaataacctcctaactggtatttctacctctgacaattgaatatagctttttttttttttttttttttgagacggagtctcgctctgtcacccaggctggagtgcagtggcacaatctcggcttgctgcaacctctgcctcccaggttcatgcaattctccctgccttagcctcctgagtagctaggattataggcgcccaccacaatgcccagctaatttttgtatttttttaggagagatggggtttcaccatgttgcccaggctggtcttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggattgcaggtgtgagccaccgtgcttggtcatgagcatatatttcttttaaaacctctaatcatattacttctgaagaatgaactcctttgaatatcatataaaacttagcggtaagacctttgacatgtcacttaatttctctgagcctcagtttcctcatccatgtaataggtcaataatccatacttcactggattatacagagaattagactgaatgatgcaggttaaatgattggcaaagttcctgacacaaaggaagcattcagtagattgcagctactggggtttattactaactgtaggccctcaattatctttcattctttatgtggctcacactggtcctttaaaatattttgttaaaaccctctcagaaaatgtgattctggaatgatctcaggaactgagatggaactcagttccaaaatctgctccctcacaagagtacttttggcagtacttagattctcccctctctagattccctctccttgccctgtggcttaacagcattgtttattctcctatctcttccttctctctgccctctctattaattgtgagctcttcaagataagtgatcatgccttatttgttctgctgtactaaatactctatgaaatgtgaggactacccatcctaccccatgacagctcactcccagtgtttcaactgtctgattatcatcctactgtatgctcaaccaattctttgaacatagcatactttgttgcaaaatacacttccttttattaatacagtcatccctcagaatccataggggatttgttccaggacccccaggagataacaaaatccacagatgctcaagtccctgatataaaatggcatagtatttgcatataacctatgcacaccctcctatatactttaaatcatttctagattacttataatacctaatacaatgtacatgtcatgtaaatagttatactgtactagttagtgaatgacaagaaaaaagcctacacatgttcaggacagatgcaaccatccagttttttttttcccaaaaaaatatttctgatctacagttggttggattcgtggatgtgcagcccacggatatggtgggaagactgtatatggccaaagaaaattctacgaacagtaataatacacttcctttcttctgtctcctctttatcagccatttttttgtttgatttcaccatcctaggaggtagacagggcagaaaccaaagagtgtcaggagtcacatagcaagtcagtggcagagttgggcggatccagtgctattagtacagtcatacataactagatgcatacccataattagatttttttaaataactactttcccaatacatgcaaaggctcaggaaagcaagggctggttttccattctctagtaactcttaagacctttttaagtgggaaatttttgtaccattggtttggacatgggatacatttattaggatgaaaccattaaagtttctgagaactagaaattattcagaaaccaccaatctgaaggccactctgaaaaaagtcaaggaaggataaagaagagtaggttgggcataaattggagttaaaatatcagcattatgagggacttccctaccttataaacaattgccctaacttttactacaataacaaaataaatgcttctgtgtaagaagagttgaaactgtcatgtcaattttaaatgcaaaaaaaatttataatttcaaatcaagaggattgttataaggcttaaatgaaataattcttgtaaaatacttatcatacctagaacaaaatagtaccaagtaaatagtagctatttttgtcacattagtatttactaatgttccctgacgtaagaatcacctggagtgtacctgtcaaaaatatcatttctggggcctatacaaggcccattaagacagaatctccaagcaaggagacccataagccctatgtttacagttgtattttacatgatgagtaagggaaaaattctatactaagaaattgtggccatcttagtgattttccattaatcccaggatgtgtttggcacagggtggtagggtctggcattcaggccactcttcttccctctccacattcaagtcttctagtatctaatttataaatataggaaatattttaatattctttcagtaaaagcagagaaaatcttttctggttactgtgttcatactgagtagaagaacctgttactgaaaaaccaggggttcggtcttggtcctgctgctcgctgcacagaaagccaatcactatgatgccgagtattgccaaggaagaaggctttaatcaggtgctgcagccaaggagatgggagctcagtctcaaatccatctccctgactaaaaccaggtgttcatttggcaggcaagagagataaaaatgtgtaagaaaacaggaacctgggagaggcaaggaagcaatcttggggaattaggggtcggcatctggtgtggtgatctgatttcagttctttcatacttttctgagaggcctaaaggtcatttcctgaggaatgaactcagataaaacaaatgtaagtttcaggctttttaagaccagaagggtcaatttctatgattatcaaatagaacagtccatggggcaattgggttggtttcaaaatgactttaaatggaaatatgtattttttaaatccccaattcatctttactgcatttgaaagtcattgatacttaacaaaatcaacctagttttccatttgcacagacatctgggaaaatcctgggacagaagggacttgaaaagaagaaatggataaaatagaatatattaaagctggccagtatgaatcaaataaacgtgtatagatttaatatacttaatattttaccagtgaaataatataacaatatcaaggatattttgaaagaagaaaaaagccacctaaaatcctactagcatcatgactacaccaggccctccagtccacgtgttctgcatctgtggattcaaccaagcatggatcaaaaatgtctttaacaaaatgggtggttgcggccaggcacagtggctcacgcctgtaatcccagcactttaggaggccaaggcgggtggatcacctgcggttaggagttcgagaccagcctggccaacatggtgaaactccatctctactaaaaatacaaaaatcagctgggtatggtggtacacacctgtaatcccagctactcaggaggctnnnnnnnnnnnnnnnnnnnnggttggtggatctgtatagatgaatgaagattgtgacaggtcaggaagaatgtagtagtagtaaatttgaatattgatatattggtgaatgacagctgtgtagatatgggacatttagtagatgagtagttgaagcaaatggtgtatagtattatttatgagagatgtataagagtatagtagtgtatagatagttgtgagtggtttgggtagtctggagtaagtattcatatattatcaacgactgtaaggtatagtagatgtattaataatatagggatttaagagagtaggcaatatgtgtatgagaggggaaataattgacagtttagtgtatatatgtgaactaatgtaaatgtaagggatggaatgttttagtagtagtatgaataggatatcaaactaaacaagaaagaattagagattatagtgtttgaaatatagaggtggtagactatataaatctggtgtggataggtgatttagagtaagaggggtacgtaagaaggtgaatgtgataaacatatagtaaggagctaacaaatcaaggtagttagtagtgaatgtaatagaattgagtagttaaatgagtggattgtggtatgtattaatatggttagatttgttgaaattatgacagtaagttgaagattaatctggagtgatagaagttgcggatgaaaaatcggaaaagtgggtgcattagcagagagaatttgatgaattgataaatcatagagaatgtggataggtggaaggagagaatggagaattagagggtggagtgtataatgatctagatgttgtggggttgtaaaatagagtagatatgagacgtaaatataggtgagatatacaagtatgcagggatcagagggacatcagtgcatagaaaatagtagtcatcgctaatgagggccccagatcatagaggtatcacgaaagtgatatgggttgcgaagcagacctcgaccgtccatggatgcaagcagattcccgagatatcagcctcccgagtagctgggattacaggtgcacgccaccacgcccagctaattttttttgtacttttagtagaaacggggtttcaccatgttggccagactggtcttaaactcctgacctcaggcaatctgcccatctcggtctcccaaagtgctgggattacaggccctagcgattatttaaagcacaagtgtgatggttaatactgagtgtcaacttgattggatggaaggatgcaaagtattgatcctgggtgtgtctgtgagggtgttgccaaaagagattaacatttgagtcactgggctgggaaaggtagacccacccttaatctgggtgggcaccgtctaatcagctgccaccaaggctagaatataaagcaggcagaaaataaacgtgaaaaggctagactggcttagcctcccagcctatatctttctcctgtgctggctgcatcctgccctcaaacattggacttcaagttcttcagctttgggactgggactggctttcctgctcctcagcttgcagatggtctattgtaggaccttgtgattgtgagagttaatactacttaataaactcccctttatatatatatatatatatatatatatatatatatatatatcctactaattctgtccctctaaagaatcttgactaatacagcaagcatacttcatattattgtgctttgcatacactcctcttcagaaaaaaaaaattgaaggtttgtggcaaccctgcatttagcaagcttatcagcaccatttgtccaacagtacacactcacttcatgtcttggtgtcacattttggtagttcttgcaatatttcaaactttttcattattattatatctgttactgtgatctgtattaaatgatctttgatgttactattttaattgttttggggtgccatgaaccactcttatgtaagacagtaaacttaattgataaatgttttgtgttctgactgttccactgatcagctgttccccatatctctccctctccttgggcctccctgttccctgagacacaatgatattgaaattaggctaattaataacccttcaatggcttctgaatgttcaagtaaaaggaagagctgtatgtctctcactggaaatcaaaagctagaaataattatgcttagtaagtaaggcatgtccaaagccagtataatctgaaagctaggactcttgcaccaagcaattagccaagttgtgaatataaaggaaaagtccttgaagaaattaaaagtgctcctccagtgaacagaaaaatgataagaaagtgaaacagcgttattgctgatatggataaaattttagtggtctagatagaagatcaaagaagccacgatattcctttaagccaaagcctattccagagcaaggccctaactctcttcaattctatgaaggttgagagaggtgagaaatccacaaaagaaaagttggtagttagcagaggtggaatcctgaggtttaaggaaaaaagctgtctccataacaaaaatgcaaagcgaagcagcaagtgctgatgtggaagctgcagcaagttatctagaagatccagttaaaatcattgatgaagatggctacactaaacaacaaactttcagtgtagacagaacagccttatattgggagaataggcatttaggattttcatagttaaagaggagaagtcaatgcctggcttcaaagcttcgaaagacaggatggctctcttgttgggggctaatgcaacttgggactttaagttgaagccaatgctgattttccattccaaaaatcctagggcccttaagaatcatgctaaatagtctgagtgtggtcgctcacgcctgtaatcccagcactttgggaggctgaggcaggcaggtcacttgagatcgggagttcaagatcagcctggtcaacatggagaaaacccgtttatgctaaaaatacaaaaattagccaggcgtggtggcaagtgcctgtaatctcagctactcgggaggctgaagcatgagaatcacttgaacctgggaggtggaggttgcagtgagccaggatcataccacagcactccagcctaggtgacagagtgagactccatctcaaaaaaaataaaataaaaaagaatcatgctaaatctactcttcctggtgctctatacatggaacaacaaagcctggatgaagcatatctttttacagcataatttactgaacattttaagctcactgtttagacccacagctcagaatatttttttcaaaatattactgctcattgacaatgcacctcatcacacatgagctctgatggagatgtacaaggagattaatgttgttttcatgcctaacacaatatccattctgcagcccaaggatcaaagagtaacttaaactttcaagtcctgttatttaagaaatatacttcataaggctgcagctgccatagataatgattcctctgatggatgtgggcaaagtaaattgaatgccttctggaaaggattcaccattctagatgccattaagaacattcatgattcatgggaggtcaaaatagcagcattaacagaagtttggaagaaggtgactccagtcctcatggatgactatgaggattcaagacttcagtggaggaagtaactgcagatgtggtggaattagcaagaggactagagttagaagtagagcataaagatgtgactgaatttctgcaatctcatgataaaacttgagcagatgagaagttacttttcatggatgagcaaaaaaaactttttaatggttttcctgggatggattctactggtaaaatgctgtgaacattgttgaactgacaaaggatctagaatattacataaactttaggtgataatgcagtggcagcattagagaggactgactccaattttgaaagaagttctgtgggaaaaatctatcaaatagcatcatatgctgcagagaaactttccttttttttttttttttgagatggagtttcgctcttgttgcccaggctggagtgcaatggcacgatctcggctcatcacaacctccacctctaaggttcaagcaattctcctgcctcagcctcccaagtagctgggattacaggcatgtgccaccacgcccagctaattttgtatttttagtagagttggggtttctccatgtttatcaggctggtcttgaactcctgacctcaggtgatccgcccgcctcggcctcccaaagtgctgggattacaggagtgagccaccatgcctggccgagaaactttcatgaaaggaagagtgaatcaatacagcaatcttcattactgtcttattttaagaaattgccacagccaccccaatcttcagcagccacactctgatcagtcagcagccatcaacactgaggcaaaaagattatgactcactgaaggctcagatgattgttagtatttttagcagtattttttaattaaggtatgcactcttttagacattatgctattgcacagttaatagactacagtatagcataaaagtaacttttatatgcactgggaaaccaaaaaaatttgtgcgactcacttactgtgatatttgtattacagtggtctagaaccaaccctgcaatatctctgagggatgcctctatataagaggatatgcatagattatatgtatatactacatcactttatataagggacttgaacatctgtggattttggtatccacaaagggtcctggaaccaatcccacaccgataccaagacaactacatttcgtttctgtaatttccctctcagttatttgtatgattctgtgtgtgtgtgtgtgtgtgtgtgtgtgtgtgtgtgtgtgtgtgtgtgttgggagaattgctcaatgtcttcttggtctgtgcccttttaaactagttgtactaaagagaacatttgtcatgtgactacaagcaaagaaagggccagaaacctttttgtcataatactgcaaagctggttacttttgacagtgcaaaaaaggctaaatgttaacaggtgctggaccttgaagaaaaaggagtgggtgtgtagcagagatggaggaatcgggatggaaagaaatgaaggagtccatagagggcagaagctcctcagcaacagtgagagcaatggcatgggcagccccaagagttcaaaaggaaaatctatcatatgtgagggactaaatagaatgagctgaacagagtagagaagccatcactattcctgtttttcttgggtggggtggggaatgattccatgtggatcacagtaagcacttgagtgcaatgtaaggcctattctctataaccttccagattgcatttatgaccattcagctggagtaagactaatattcaaaacagtcccaatttttagatttcaaggacaaggaaaacagagcttcatgtgcatacatgattttatgtagtttatatcctgctgtactagttatatgacctagggcaatttacataaccgttatgtttcttcatctggcaaatgggggtgatagttttaccaaccacagatggtgaagatgagatcatccatataaagcacttcaaaaatatctggcacagagtaagtgtgctccataaatgttacctgctttttattactggtagtggtggtggattatgcttagaggtaaagcagaggaaaatgccttgcttgggtctctctggcttatgggtagtggtgcatgcaggtgggaggctcatgacaacctttcacgctctaggatgctacaggctgctgcagaggcctggggacacccactctggcttccctccacttcagtcctgcctccagtctgcttctaagacctcagggctccagcagtcttctctctcccacccacactccaaggcaaatgggctccattcctagcccaggatcctaagaaactttacccttaggaccccttaggcaggatcctaagaaactttatcccttctctaccatgcagctccccctctctaaagtcaatcactgactcccttctctaaagtagaaaggtccctcttagaataatagtttccaatttcatttgtatttctctaaatccacttctgctccaaggaaaaagggaaaattttgttgttgttgttcagagtcataaaatatgtgtctaccttgggtggggagtagcagttgagtcatgggaaacttctatccagaacttatttttatgagttgagcccacatcagttaactatgccaactgattaagataagaagcttttggttcttggatgatttatctaattcgatttgggatgatgaagaggtaatgttcaaagcttaccaagtcataaatgagtgaattccctagaaaataggatatcggaagggagaactccctcttctgggtgcaagctgggcagtgacccaaaccagaaagcatgctgagttacaggtatggatgagagaccatgccacactaaagatctgtaatcgcaggcagcaaagtcaaggcgggctttgggtgttctcatgaggatactggaaagcttctgacagcactaacctagaggcaacgctgagtttggcaaccaagcagttgggataggaggtgagtcaggaaagaattcaggattgttgttaaatgctttccctgttgcttgggtctgccaccttcaaatgtggcgctgttcactctgggagcatcttaaaggtaccacttttagacttccgaagtcttctgcaaagtacaaagtgcctcaaaaacacaggttgtttttaatgctattgttatcaacagtgtatagtggcactgattcatcagaaatcattcaaagtctgtttgcttttcacaactattttcttggccaagggactaggtgttcttttttttttttcttttgagatagtcttgctttgtcacccaggctggagtgcagtggtgcaatctcagctcaccgcagcctctgcctcctgggttccagcgattctcctgcctcagcctcctaggtagctgggattacaggctcccaccaccacgcccggctaatttttgtatttttagtagagacggggtttctccatgttggccaggctggtctggaactcctgacctcaggtgatccacccacctcagcctcccaaagtgctgggattacaggcgtgagccaccgcgcctggcctagacattcttaattccagtgctttgctgcttttatttctttgctactttgtacccaataggggaaagtaggaatattagactccaaagagttattttcttctgatttctctagttttctgggtgctataagttttcttttttttttcttttttctttttgttttaagtctgttttaaaacaacaaaatgattaatttaagtactagttaaaaggaacttgttctgttgtcacaaagtctcctgaagacatcaagcaagtaggtagaagtatggagaagtgaacaggcacaggcttctcagtgtgacagatatgggttcaaatcctaactcggattgtaggcaaattttatttccatatatagctaggacactaaccctaccttgcatgggtatttgaggattcaagagaatatatccttgtccagtctaccatataattgatcctcaaaataaatggtagctgttattttagtcagacacagaattttgattagaaattaaattaccatggccctaatagagtcaggttgaacactatgcagacatagcaaataagtcattttaaaggttccttgcactgtggcaggaatgcagcctggtggggtaggaataaaagatagaaaaatggcagggagcaaatggattgtgagtcaaaaacattctttatctttaaatgtgccccattataactactctgaaaactattagtactaagacacatttcacattgtttatagagaaattaaactgtaacaaaacgtataccaaaaaaggcctttctattcttgacacatggaactgaaaatgtccatctttaccacctactccaaagagggggaaaatgggtaaaacttgtttatatcttagaaaacacataatgcttaagatacctcattattaagtacattttattgacttctaaaactgagttatgtggattgctattagatctgaagtctgcttattgtctgtactgcacggaaaaaatggttttaagtatatttatatttacatcccctcatttgtctaaagtctcaagctgttgtcatgcaactacattccctgaggatcgtattaggtatgtttgcattctgtgcaaagtgattaccagtatttgtcacacttgccaatcccatgtggaggaaagctgattattcatgattcagatataagtatctagtgtaatccactagcttgaactgaaatggagctgaagtggtattgatggctacagaatgacgaggaggaggaggaaaagagtaagaaaaaaatcacctagtgcagtggctcacacctataatcctaacactttgggaggctgagactggtggatcacttgagcccaggagttcaagaccagcctgggcaacatggcaaaaccgcatctctacaaaaaatacaaaaaattagctaggcatggtggcacattcctgtggtctcagttattcgggaagctgaagtcccagctatttgggaggaagcccagggaggtcgaggctgcagttagcctggttagggagaccttgcaactgtgaaggacactcaatgctaccactgctggcactggtgtgaacccgaaactgtccctgcttctttgtgacattcactccagacacaaagttctggcggggatggtctgacagactaagctcaggaacttaggttgtgtcctagtggtcagcggtctaaaggatttggcctttttcaacttccacagtttaaggtggaaccctcacctcctaccagactcaccaaacagaaggtggcttagatgtttggcagcctccccaaaatgccaagattccctcacagaaggtttcctttgtgtttctgatttatatactctatcttcagagaacacttaacgaaggctaacaataaaaaacactgattcgatgtctgtgttaaaacaaaagaataaaacctagaagccatgggacaaggccagaaaggtcttaggaaattagagcaaaaggatgctagagggagaaagagaacattttttcttattttttctttaattcttttccctctcacattcttctcagtagtgtgaaaagttattttacagaggcactcccggcccacagggtttctagaacttgctcttcagtcttcttggatcagttttcttgaggtttatatataaagggctactaatatacaatgctgagaatctatacatgttactggccaaggtattaaaagcaaaatcttccagtccgtgattgaggccaagtgttgtgaaagaaggagctttagcctgactcattcaaaaacccatatctagttcaaggctttacctcttagaaatgagatgaccacaggaatcccatctaacctccatcatggtgctcaaagtggctaaattgacaaaagactataatgaaaggtaaggcgtttctgagcaatccaatggacttttttacccactcattcatctacttattcattgagtaactactatttgataagcatagcaaataagacaaaggttactaccctcaagaagcttacatactaatagtttaatcagagtttggatgaaaactcaaatgccattggtagctaagaaggtaagagaaactgtgtgaggcagctttttttttaatgtatcagtattgagtggtggagcctatggcaagtcctacccaaaagtattcaatctcatgttttttaaaaaagtcatatatgtaaagaaggaattaaaacataggacattatatgcaataacatatgtataaattgattcagagactagaaagctattcgttctgctcagagtggaatggtaaaggtgttagaaaatctttcaagaggacatgatgcctgaaaatggttttgaaagaccaaaggagatccccaggtagataagtgggagaaaagcgaagtacacatcatgtgcaaagacatgtaggattgaagcaatatgtataatgggctctataagatgtttaatgtgacagatccagaggaaagcaaggaagaaatgaaactagagaggagatctagagtcaattaatagaggacctggtattactatctttagaaaagtagggaacagaacagaggaaactgagaggatctgaagtagttgggaggaaagatttaaggaagcataaaaataaaagcaaagagagccattagaagggatagcaacatcaaagatgaaagataatggggcttcaatgaagtgtctgtagagatggagaaatgctagatctaaagactatcatggggataagactggaaaaaagtttagtggtttaataaatttgtagattaacctagtgtgctgccattgaaagagatctatgaaaatcagggaaagagatctatggaaatcagggaaaataagagaacaaggataccagtgtcataaaagtcaacaaaggagacaactttaattggagatggatgtcaacagtatgtaatgggaagatcaagtaagttaagagcagagacatgtttattgatatttaacaaggcctttagacttttggtaaaagcagtataaacagtcttaatgaatggcagtggttacccctaaacagggaaatatatctgaggaagggcatatataagtagagtccacagtgaaaagcccaatccactgaccctgtatgatagattcaggaaaaaaagatgaaaaggacctgaaccttatgactctggttttgttgtcaatatatacattcctccttcttctggtgacagcatcttgatttttctttagcaactaaccctccatccctcagagtctatttggtttaggatagacattccctaaccaccacatggacacatgactcagacctggccaatcataggattccattcccttggccatagcaattgattcagtgatgaaccacaacccaagccagaccatgagacacaatcctttggtgttggcatatatttttgttgtactttttgtttggtgtgaattaggatgtcttttttagagcttttgagctcctttcctctgggattaccaagagaaattatctttcctctagtattattgaaattgcaggacataagcctggaggtgctggaaaccaccagatgcagaaggcttgcctgggaataaggccagcgcataggaaagtagaactgagagatggaaaagagggcagaggaggagaagagagaaagtggctaggttctaatgacatcatttgagcacttgaagccaacaaatacttttcagtaatgtgagccaataaatcctctttatttaagccacttagagttgggatttcggtctcttctagccaaaagaaccctaatttgaaacagcggatggagaggtgtgggaagcaaaccagtttcagttcagccttgcctggagccagctctgatcatggatctcaaagtttgccttatcccccaccctactcagccaaaaaaaatagtttaggtgtcttatcatcttagtcctccaaaggattgattcattgagagggggctgtgaggaaccttgcagaatctcagcagcttggccctgagccaggaccaaattgttgctgatggatcaaggtttctgggaaccagctgtgaaggagagataccatataatccttagaattcttagagcaaggacccctgactgctcccgttctgcaaaaactaaaaaatgggaaccaccattttctgccagaaaaaggcaacatctggagtgcaattaccataagaaatggagttgcaaacccctgctactctgcatttaaagcagacacaatggcttctaggcacagttgtgctcaactccaggggcaccaaacacattgtagttatgtgaatagcatcccttggagttatgccatgctcaacctacacagccatatgtaatgatcctggcagctactcgctaattagtgagaaaattagcatccatcgaccctcaagtacagagagactttgtatctgtgtcaactacagagaggataagagagaaaagaaaccatttgcaacagttcagatagcaaaaatctttagcatttcagttattcagaaaggagccagctgagttttctgtgtgaacctactttgtcccagagcccttgtcccaaagtgcaaatgtgaggcagggttcatggccaaggataactcaacagtccatcctggtctgagtccccacatgctctctttcctaaaaagactaatttgggcaaacactgagtaaaacaactggtactccagaaagcacctggatttttgggcaaaaatagtactgagccaacttaaacaaaaaacaagtggacttaatttaaatatggacagagtcagtttggggtcacaattaaaccctcaggattccactgtgcccccttctcttccagatgtgggacacagtaaaaatagctaagatagcctgctcatatgcacgttcagaaaagatttgccccaaatctttccaaggactgatattgagtctacttttcatgatgtgaacagtgtgtccaaatgaggcctaaattcaggtctttgccccttatcaattccatgtgagaaatacgaagagattgcctttaatttcccagagtagggcctcaaagaccaagcaatccagcctaaaactaataaaagcagcatcctgaaaagagtactaagctttcccccccacacactcagaaaaaaataaataaataaaaataggccgggcacggtggctcatgcctgtaatctcaacactttgggaggccgagacaggtggatcacctgcctgaggttgggagttcaagaccagcctggccaacatggtgaaaccccatctctactaaaaatacaaaattagctagacgtggtggcatatacctgtaatcccagctactcaggaggctggggcaggagaattgcttgaacccgggaggcagaggttacagtgagccgagattgtgccattgcactccagcctgggcaacaagagcaaaactccatctcaaaaaaaaaaaaaaaaaaaaggaaggaagaaagaaagaaagacaaacccaaaatcaattctcctttttcttttttaataatttcaacttttattttacagtacatgtgcaggtttgttacatgggtatattgcacgatggttgtggcatacaattgaccccatcatccagcagtgagtgagtctagtacccactattaatttttcaatccttgctctcctccctcccctcctcttagtagtccctggtgtctactgttgccttctttatgtccctgaatacccagtgtttagctcccacttataagtgagaacatgcagtatttggttttctgttcctgcattaatttgcttaagataatggcctccagctgtatccatgttgctgcaaagaccgtgattttgtgtttttatagctgcaaaaatcaatttttcttatgtctcctgtgaagctgcaaaatacaaagaagccattttctccataactgtaaccatcacaggcaatctatttgcactcacgggtaaagtctgatctggagtattttttctaaactggtgagaacttccacttgtagctaatgatcccctcacctcacttgcatttttttctgagtaacagtaactttcaccttggatgatctagtccttaaacgactgtaatgtgtttccaaaggggcactgtttcaacatgagaactgcattaacaattggcagaaacccttgttttttctctgtcccacttaccataccatgatggctgtcccaggccaatattaaatattctgctagtttacatttgagcaaatcaaacaaacacctgttggttccctttagtatttcagagatagggaatacggctagaaagtcatagtaggaacagctaccacttattgagtacctcagagtgttttacatacattatctttaattcttagaataacccagcaaaagtggtagcacttttattagggttttttttcctctttttttttttttttttttgagacggagtcttgctgtgtcaccccaggctggagtacagtggcccgatctcagctcactgcaacctccaccaccctggttcaagcaattcccctgcctcagcctctggagtagctgggattacaggcgcatgccaccatgcccagctaatttttttgtatttttagtagagacggggtttcactatgttggccagactggtctcaaactcctgacctcaggcaatccgcccgccttggcctcgcaaagtgctgggattatagatgtaagccacatgcctggccagaattattaggtattattccgtggtggacagctctgtgcaaacttagccccaaagtccaagaaagtggagaagttgaagaaagagactgacatcgccactttctcagaaagaaacacctaatagggacttaagaactgaagccatgcttgcgtctcaggtggtggcaagatgagatggtggatccccatgccattaccctccagacgtagggcttacataccataggggagtaatgtgtaggatagttatagcgaaaggcaagaatgctgtgttaatctgcataagggcaggatttttggttaaggatgtttagacctaagagtcaatacatccttttacacaggaaatgatataatagaaatcttagaggcattcctggaactagggttaatcagaagtcaacatggtggattagcatacaagatggagttgctttagcttccgcaggtgttgaaactgaaatttaaactcacatctacctaagatgaaagaccaggatcttaggccatgaactttctcactaagtcagcttaacagcagagaagacaggcatccttaactcacaaaaaactggagttttatcaacttgacatcacacaaagcacaattcctgtgatgactggtaggggatcccaaatgtgccagaggagtggtgaccagtagattttctttttaataacaagcagagttatttagttcacaattctagatgctgtaaagttcaagagcatagtgctggcacctggcaaggaccttcatgctgtgtcatcccatggcataaggcagaagggcaagaaagaccaagatcaagacagcaagaggcctaactcacttgtataagaaaaatgctcccaaaataccgagcccactccctcgataacaacattaatccaaccataagggcagagcctccatgacttaatctctcctcattaggcatcacttcccaacactgttgcattggggattaggtttccaacacatgaactttgtgggaaaccttcaaaccatagcatccaccaagggagacaggagtaaaaattagagatattgacaagaaacaatgtccccagttagtttttcaggttataaataggcacatttgctcacatactcatttctgccctcccttcacatccttattttgagcattatctctatgccaagatttgtgatgattatgtactaaaagatgaggtctcactggttggtcaactagccctggtgtcaccattcacagcaggaacagggaggcaagtgatggcctataacatatcaatgcagcagtagtaaaaagcagatgccaatcttcatgatggaatccagaccctgaaggcacccaagtatacaatacctagacataaaacattaagtccaggcacagtcgactcacgcctgtaatcctagcactttgcaaagtggaagaaggagggtttcttcagcccagaagtttgagactagcctgagcaacatagcaagatcccatctctacaaaaaaactttaaaacttaggctagtatggtggcatgcacctatagtccttgctactcaggagactgaattaaaaagcaagaggatcacttgagcccaggagtttgaggctgtagtgagtcataattgtgccactgtactccagcctgggtgacagagcaagaccccatctcaaaaaaaaaaaaaccacacaaacaacctgaagcacctaaatggaacacttaagaggttaaatattttcagtgtgatagtgagaaggaagatttagatacccataactgcctgccaatgacaaactaccttctaaaacccaaagtgatgattctgttaacatcactgaacatgagtaggagataatggaaagtaaggaatccttcacacctccagctcaaacaagtgagcaggagttcaccaaaaatatctgatcaatatggttctcataaaacttttaatataatactagaggttacttaaatggacaaaataaatgccattctattatattgcaggcatattagtttacatatattaaaatttaagttgggggaaaactaaactaatgattatatcactgaaacaccaggggtttggtctaggtcctgctgatcaccacacagaaagccaatgactgaaacgacaagtattgccatggaagaaaattttaattgggtgttgcagccaatgacaaggcagctcagtctcaaatccaactccctgacccacaaaaactaggggtttatatagcagggaagaaatgttaacaatgtgtaaggaaatacgaactagggaggggcaaagaagcaatcatgatgaggatcccatatctcattgtctggatgtggttgctttagcctgaaattctgataagtctcagtattttgatactttttttttttttcttgagaggtctgaaagtcatttcctgaggaaggaactcagatataacaaatgtaaacttcaagctttaagaccagaagggttaatttctatatttatccaaatactatctatgggactattaggtcagtttcaattaatttcctggattttagttataaaatgttatagattttagaatatgaagtaactttctctgcttctaaatttgagatttaaaatattaagaattttaaaaggtaggtgtcctaaaattaaaattaaatcttatttcttaaaaaaaccctcagttgattttatcttcacataaaaggtcatggtaaaataactaatcttctatttttgaaaaataaaaaatatatcaatgttttcaaacatatgctttttaaaaatcacagggaaaaatataatctaataagagattcatggatctgtaaagagttgagtagttgagtggtcagagggtccactaatactctgaagccttttgtgtgtttgtgtgtaagtgccgtcagtggaaaaagaggggagggagttagtaattttttcagattctcaaaggtgtatgtgacccacatgagggttgatattgactgtaggaaagtatgagaaaatgttaaaaccttgtcagttactggaagctatgactatctctgattaaagtccaaaacaaaaactagctaaaatataggtacaaaatctgaactccaacattcagatgaattaaagttccttgggggcaataaaagaacagactctctctgtggccctcagtagcacccattgagccaatagtccatcaggtcattgttgtttctatccctccacaaagaaccaagcccacaatgtgtaagagatttgctttgctttttcaactccagggccctagcagttcacagcagctggaaccagtccaagcaggctgctggataaggatgagctgtgtatttcacttttatagatcaaacggcttctcgattatttatcatctgtgtgatagagaaaagtaccaataaaatgtgattgtaaatccctaccttcttccaggatcaaggaaagaactaaaaaaaagctaaaagggaaatgacaacacagttttgtacctaaaaacgtgtggccgggcgtggtggctcacgcctgtcatcccagcactttgggaggctgaggtgggcagatcacctgaggtcaggagttcaagaccagcctggccaacatggtgaaatcccatctctattaaaaatacaaaaattagccagaaatggtggcaggcacctgtactcctagctactcgggaggctgaggcaggagaatcgcttgaacccaggaggtggaggttgcagtgagccgagatcacgccactgcactcctgcctggtgacagaacgagactctgtctcagaaaaaaaaaaaaaaaaaaaaaaaaagtatgtttttctaaatcagatgctgttcttgtttcttgaattaaacatccctgaagatgttgaatctcaaaagtagaaagtttggggattggggatgttgaagaattgactgtttctgggcagcctattgagtgaaatcttgagatagggtctttgataaccgtaccctaggaaacattttatctgctgtttcctgttaacatgagaactgcatcactttaacaggtttgggcccctcatcccaggaaacattcatcacccgaggaaaataaatcatgcacatgaggaggatggggcttgtgttaccaaggactataagaaataaaaccaaaaaaaaaaaataattaaaagtttaaaaagaaataaaacttatcactgaatgggtttcactggaatctatttctaggattgctcccacttacacatctgtggcatttgttttaccccaagaaaatattttcattctaagaattttcttttactttttcagcaaaaattcatggttttacattctctcagatgcatccgcagcagatccttacaagaacagtgtaactcacctctgagtaaccttcatattgtcttctgcaaatgcagaagccgataagaattctggcctgcacagaagaactaggctggagactgactctcttctctaccttgtcaatgtcccaatcaaggcctgtgcacactggtggctactacgtattcatggaatagtaaccatagctaacatttatatagagttcaccattgtaagcactttacttcacacaaacactgtacgataggagtattacaccatttcatagatgaggaaatggaagcacagaaagcttaagttgaccaaagtcacatagctagtaagtagtataactgttatttaattctaataacccatgggagtatgaataatttttcctactttttgcacaagaatcatgagcctcgaagaggtcaagtgactaacctaaattcacacaattagtaagtggcagttagaatccaccctaagccaatcagtattctttctccatgcctctctgcaggccaacgacagcaatagcagcacttaaatcctttaaaaaatgtcttactttggtctttgtttcctttatatcaaaaataatcattcatccagacagaaaataagggatctagaaataaaacttccaggaaataaaaatgttctgtatgtttcttgttctctccatatgtgaacaattactacagaagactaatgtgcatgctcacttgcttcaagcttcactggcaagaacaaacaagtttgaagagtcatacacacacaaaaataccaatagcacagaaaagcagttgaaaatacctatcaatgtcctggcaagaacaaaggaattccaacttacttcatttcagttaagggtgaaatatattggaaattcatttctaataaatgaactatttaacttggcaaacactggagttgaagaacttgcttctgaagcacaatgtcatttgtaaaaaatgcactcacccctgcataataaggacattttcactgacctcaagtgtttgtaatcttagaggaaataaaatgtttttggcagaatgacttattaggcttagagttagaattaaaccagggcttagacaaagatcttgctcttggcagttctttgtgaaacagccaaattttgctgtcagcacctctccagtttacctaccaccccaactccaggtgtgttcctaggacttacatattgtcccagggatgttcacaatcggccccatcccacaactataaaaattgcctccctgaaaagttcagtgtgtttgtacaacaaagtctccttctctctttgtacaaccaagacttcttctcccccttaaatagagaaaatactagagtatgctttccagaggagagagatatgaaatggaagagtggaaagattgctaaatatccccccagtatccatttatcctttctatatttttgtaatataactcctctgcccagctagagatatacaacctagcatgtctccacctagccatcgccacgtagctaaatatttgccaataaaatatgaacaggggccggggatggtggctcatgcctgtaatcccagcactttgggaggccgaggcgggcggatcacgaggtcagcagatcgagaccatcctggtcaacatagggaaaccccatctctactaaaaacacaaaaattagctgggcgtggtggtgcgtgcctgtaatcccagccactcgggaggctgaggcaggagaatctcttgaaccagggatttggaggttgcagtgagccgagatggcaccactacactcctgcctggtgacagagcaagacttcatctcaataaataaataaataaataaataaaatatgaacaggaacaatggtgcaacttctgaaaacttctttacttcaaagctaaccacttggcatccactccctttgcctgcttcagtgggtgctggtaaaccaatttcaaacatgtggattagggtaaaactccaggaaaggtggaacagcaaaacagaagatccccggatcatttgcctatcattatgaaggaaataaactttaatcctgattaagcctctgttattttcattattctgtaaaatggtcacatcaatatcttaactctatgtgtgagaaaggaagggagagcagcaagaaaaccccccagaaatgagtgagacacacacacagagacccctcctttgagcctcaatttcttcatctttaaatgggaataatccctctctttcactgttaaattaaataatatatgtaatacattaagcagactacataagttttcaagcaatgatgacttgaaaacaaaattataatcttctcatttgaaacatcaaatattctttccccttccctatccaagtagtcaccaagtccaaatatgataggtcagattattacaccatttcatagatggggaaatggaggcacagaaagcttaagtaagttgaccaaggtcacatagctagtaggtagtgtaactgtaatttaattctaataacctactggagtatgaataatttttcctactttttggacaagaaacatgagccttctttattatccatccttttctcttaaattctcactgctactatcataactctggccagaggtcaccaacagactacccataagctgaatcccatcagagacattattttcctgtaattagtcatcaatataaaagccaggagtttccaattaccattttgcagttaagagaacaagggatctctggagaaatggacaattcctagtcggtgcaagaaattttaaaagctaatctggaacatcttgccatatgagataaaagaaattatcatactacttagggtgtgtcaaatgactcagggaatgaacctaagaggctatgacagatcaaagtgagatgagttagtcatcaacaagaataaatgcaatggattgaaaaatatcaagtgtatttaaatctgtgaattcataatcataataaaaaaacagttaattgataaccatggaagatgattaagaactatttcattattttgaaaatttataaggggaagaatcaagcattcatccgtcctttcctaaagaaagcgtactgctaggtaatcaaataatagataaggggaaagtttctctttataaaagtattctagtgaataaatggtttgtggccgggtactgtggctcatgcctgtaatccagcactttgagaggccaaggcaggcagattgcttgagtctaggcgttcgagaccagcctgggaaacatggcgaaaccctgtctctacaaataaaaaagaaaaaattagccaggcatgttggtgcacacttgttgtctcagctactcaggaggctgaggtgggaggatcccttgaactcaggaggtggaggctgcagtgagttgagatcgccccactgtacttcagcctgggtgacagagtgagaccctgtctaaataaataaataaaatttaaaaagaggtttacacacacacacacaatacatatatgatcaatagagtagaaaatcactattctacaacctccaaaaatgtagctgaaccagtatttcaatatgaatagttgctaatattaaaagagagacaatcagacatcatgtctctcagcaaatggaaaaacacagtatcacttatggagatttgccccagaaaaacccaaactagaatctgatcaagcttctataatgctactaccaatttacagaaaatacagaggaaaagtaaacacattaaatgatacttcaaggacgcaatcaacaaaacccaaactctaggaaacttcacagaacatctcagttaacaaataaattacaagaaaaagatgcaagataacaatgaaaaattgtctcccaacactcaacagcaacgggacctaaagcacagactttacacaatagaaagactcactcaagttctgcctctgccatttatgagccatttgcatggggaaattaatttaacctctttaagcttacttttcttcacctgtaaaatggtaatactaacagtacctaccatagggttgctttgaggcttgaaataatgcacacacaattgcccagcttatagtacatgtactataaaagttatctatatttattatttttattttttgagatggagccttgctcgtcacccaggctggagtgcagtggcactatctggaatgcagtggcacaatctcaactcactgcaacctccgcctcctgggttcaagcaattctcctgcctcagcctcctgagtagctgggattacaggcatgcgccacaatacctggctaattttttgtatttttagtagagacggggtttcaccatgttagccaggatggtctccatctcctcacctcgtgatccgcccacctcgacctcccaaagtgctgggattacaggtgtgagccaccacaccctgccaaaagttatctttattatcttcatcattaggaaacatgtgctgaatgaatgattaaataactagaattaatctgctaaaaatacagaatgtaaactattcttagtgataatattggccaggtcatttactcagtatttatagggcactggagctggcacaggaggcataaaaataaatgtaaatgtgacctccaccctcacacttttgccttttcaaaaacagtcagtgtcttaacctcaaggaataccagctaatgaagatgtcaaggcccattaacagcctgctgggaagaacttttaggaaggacagccaccaaatatttgtactttcaagcaaaatctgactgagggtggatagtgctcacttgtgatagtttactctatatgattgaatcattgtggaattaccaccattctcacagagattgaaaactctttcctgttttctattcttgccattcccatctgttcctctttttcatccacaaagtttcctttcactccatatacctcctggggatcaaaatcctgtgacacatttgtctctatgacttgtatgaggaagagaatgcataagcttgccagaatattaaaagaacagatacttcctcattagaagagagccaacctactttaatgttgagatacaaatgactaatgcagtacagacagttcctacctcataaacactcaacttacaaatgacccagacacacactactgctccaccccaccagactgctgttgccatgggaaccactcaaggtagggaggggaggaaaacggaaggttttacaggagctgggcgttcagaataaaagaaagggaagaaatcgaaacaagtaaaatagcttgtcttccccagcttatctcgagtttgttcactgagctctgttccattgtctgaaattctataatcatagaggacactggttagcaaaaccctcttttttttttttttttttttttttaagacaactacttctagtgggagtttttacaataatacacaatgacttctgggctaacttttcactaaggggagattcttagtatcagtatttttatcagagacagaaagatggctctgatattattaaccacaactggcagtcagcatccaaggcacagcatccttagcaagaaacattcacttgtaaatacaattcacaggcaccaggtacacaaactccagctatcatttgcatatgtgatataacaggtgaggcacacctggtagttatacaacacagtagccctgagtatcaacagccccttcagtgctggcagcataaggaggttttgtaatgaaaacctagtgcaacagagaggggaaataatggatttggaattttatcaaatagacaaaataaccactttgggggctacatctaaaccagtcatacaaagctacttaggggaaactatgagaactaaaagcttgaaagaaaaatctgcccaagccagtggctttttttttttttttttttttttttttacctctgagtgggtatgaactgtaaaagaggtatttttttctaatttcaagtcaggcactgtatctatacataaaatgatttttttaaagaataaatctttccgaagaatgtttaagcagttattatcacttctgaaatttgactgaacacaatttttaaaacccttttatattattaaaataatgcatgatcattaaaaaattaaaacaatacaggaacatactaggaaaaaacacctctcattcccaccccagccaaatatcactcccctaaaggcagctatgcatactttcaggcattatccacaaaaggcatatatactcatacccacaatcctacacgcaaacacctataactttcacatacacacaaaggatatactatacctagtgccctgttattttctatttaatttatattggaaccctttccacattaatatatatatggttacttcacctttttcaaggctgtctagtagtttattgtacaaatgaatcagttttctattggcaaactcttagtgccattaatttttcaatcttacaacaatgaagcaataaacatacttgtgcatgtctttacacatttgtacaaaacgttttggttaggtaaattctcagaagtaaaactgttacatcaatgagtaagcctattaaaatgtttatcatgactgccaaactgaactccataagtttgtgttttccaaaaattatcttcaaacatatgagtgcaatgacattatacaaacctcaatccatagatagagtggacaaaacccacgataagattttcaactaggaccataccactggaactttccacttgaaagtctttctcttgaccaaaatatggttatgaaaaaaaagaaatcaagccttcctccacgtttcccagggggaagacaactgatatttaaaagggtccagatgctgcaacaggtgattgccaagtgcttgcctggatccccgctctctgttctacctgatattccatcttggtgtattccctttccttctcttatttggcttatttgctttagctttttctggcttagatacttaatacacatcccttcccctctctgctggtaagaacaccttcttcctttaggaagctgccagtccaccatgtcagatggttgtactggggctgacaaggatagcaactcatctccaggaaaagtggaatgggcctgtgacccagacctggctaatcatgatgtttcatgccccttgtcaataagtgacacacttaaggaaaggcatatctcaaatctagccagagttctcctctgatgtattacatatggacaatgagaaagggcagcctttattctttggggtctctaagatggatgacaaagctggagtactccatagcaaagccttcccctccccggaggaaagccaattaaaacaggagacaaaacattcaaaaaaaattcaatttcaggtatcttctctgaccacaatgaaataaaactagaaatcaataacaagaagaattttggaaactttacaaacacatgataattagacaatatgctcttgaatgaccagtgggtgaatgaagagattaagaaggaaatagaaacatttcttgaaggaaaagataatggaaatacagcataccaaaacctatgggacacaacaaaactgtactaagaggaaagtttacagctataagggactacatcaaaaaagaaaaacttcaaatgcacaacctaatgagacatcttagagaactggaaaagcaaccccaaagctagtagaagaaaaaatataataaagatcagaacagaaataaatgaagctgaaatgaagaaaacaatataaaagataaatgaaatgaaaagttggttttttgaaaagataaacaaaatggacaaacctttagccagactaagataaaaagagaagatccaaatatataaaatcagagatgaaatgataaccaatactgcagaaattcaaagaatcattagaggcttctatgagcaactatgtgccaataaattagaaaatctagatgaaatggataaattccaagacatgcacaacctacaaagattgaaccatgaagaaatctaaaccctgaacagaccactacaagtaacgatcattacaactaaactcataataaaatgtctcccagcaaagaaaagcctggggcctgatggcttcactgcttaattttatcatacatttaaagaaccaataccaattctactcaaattatttcaaaaaatagtttcagaattattctatgaggccagtattaccctagtaccaaaagcagacaaagacgcatcaagaaaactataggcaaatatatctgatgaacattgataaaaaaaaaagtcttccacaaaatactagcaaacagaattcagcaacacattaaaaagatcattcatcatgaccgagtgggatttatcccagtgatacatggatgattcaacatacacaaatcagtcaatatcatacaccatataaacagaataaaggacaaaaaccgtaagatcatttcaattaatgccaaaaaagcatttcataaaattcaacatccctcatgataaaaaccctcaaaaaactgggtaaggaaggaaaatgcctcaacataatagaagccatgtatgacagacctacggcaaatattatactgaatagggaaaaaaactaaaagccttccttctcagatctgaaacacaacaaaaatgcccactttcaccaccattactcaacatagtactagaaatcctagctagagcaaacagataagacaaagaaataaagggcatccaaattagaaaagcagaagtcaaattatccttgtttgcagatgacatgattttatatttggaaaaatgtaaagactccaccaaaaaactattagaactgataaattcagtaaagttgcaggacacgaaagtcaaatgcaaaaatctgtagcatttctatatgccaacagtaaacaatctgaaaaaaaatcaagaacgtaatcccatttaccatagctacaaataaaattaaatacctaggatttaaccaaagaagtgaaacatctctacaacgaaaattataaaacactggtgaaagaaatggaagaggacacaaaaaatggaaagatattccatgttcatggactggaggaatcaatattattaaaatgtccatactacccatgcaatctacagattcaatgtaatccctatcaaaatatcaaaggcattcttcacagaaatagaaaaacaacccaaaatttgtaaattttaggatggtcttttgtaaaaccacaatagacctggaatagccaaagttatccttagcaaaaagaacaaaaatggaggcatcacattacccgacttcaaattatactacagagctatagtaagcaaaacagcatggtactggcatataaacagacacatagaccaatgaaacaaaataggaaacccagaaacaaatccatacatctacatttaacttattttttacaaagattccaagaacatacattggggaaaggacagtcttcagtaaatggtgctgggaaaactggatattcatatatagaagaatgaaactagtcccctatctctcaccatatacaaaaatcaaatccagatgaattaaagacttaaatctaagatctcaaactatgaagccactaaaggaaaacattaggggaactctccaggacattggactgggcaaagatttcttgagtaatacccttaagcacaggcaatcaaagcaaaaatgaactaatggaatcacatcaagttaaaaagcttctgcacagcaaaggaaatcatcaacaaagtgaagagacaacacacagaatggaagaacatatttgcaaactatccatctgacaaaggattaataaccagaatataaggtgctcaaacaactctataggaacaaaatctaataatctgattaaaaatgggcaaaatatctgaacagacatttctcagaagaagacatacaaatgccaaacaggtatacgaaaaggtgctcatcatcactgatcatcagagaaatgcaaatcgaaactacaatgagatatcatctcaccccaggtaaaatgacatttatccaaaagacagacaacagcaaatgctggtgaggatgcagagaaaaaggaacccttgtacactgttgatgggaatgtaaattagtacaaccactatggagaacagtttaaaagttcttcacaaaactaaaaatagagctaccatatgatccaagaatcccactgctaggtacatacccaaaagtaaggaaatcaatacatcaaagatatcttcattcacatatttattgcagcactattcacaatagccacgatttggaagtgacctaagtgtccatgaacaggaaaatggataaagaaaatggagtacatatacacaatacagtactattcagtcataaaaaagaatgagatcctgtcatttgcaacaacatggatggaactggaggtcattatgttaagtgaaaaaagccaggcacagaaagacaaacttcacatgtttacacttatttgtgggaactaaaaattaaaacaatttagcttatggagacagggagtagaaggatggttaccaaagtctggaagggtgggggctgggggagtggggatgcctgtgggtacaaaaaaatagttagaaagaatgaataagatctagtatttgatagcacaacagagtacagccaataatttaattgtacattttataataactaaaagagtaaaactaggttatttgtaacacaaaagataaatgcttgaggaaacaaataccacatttaccctaatgttatcatcatacattgtatgcctgtatcaaaataccccatatactctataaatatatatacctagtttgtacccacaaaatttaagcacagaaatatcttaaaataaaaataaataaaacaggagagaggccaaccaaaatgcacaaataagcagatctgaaaggtagatggagacagagagaaaagaaaattctgaagtaatttgagttcttagaagttaggtacttcctacttacataagtcagtacagtctctttatacttaatatggtccaaattgtgttttttgttccctaaaaactaaggattatgactaatatggcatcaatctcagatccactagtttgtgtcctgacttgtctccttcctagttacccagtagtcctttgtctggtttccctgagttttcacctttctgtcttaggccctgtctcccaagggtacccctagtagtaatatcagctggtgttcctcaaacttctctcccttaagttggccaataaggggtacatattatactcctggatgaagtatccctcactagttgtgtgacctgggccctcattttcctcacagtgttgttggatataccttgaacagtactacatataattctgaatatttctgaatagctttcaaaaatagtggatgtacactatgagggtcacaaaagctgagttgcaaacatttgcagtgctggaataaatgaagttgaaaaatggaatattttgtgtaaccaagaggcatttgttatttcagttttctagtaaaggcttatgccagttttgcaatatcaatgtagtttgtgtagacagttgctaaaaaatcacatgatcttctaggataagcatttttaatttttttccatttcaaaaacaaaaacattaaaaaataaaaccatgcttaattctaacaccctaaaacaagtatttccttctagtttgcatcaaatgtatttatttttttccacaggtgaataagagtggtgtaactttatatttcctttattcacttacatttaaaaataggctttgccagggccgggcgcagtggctcactcctgtaatcccagcattttgggaggctgaggcaggcggatcacctgaggtcgggagtttgagttcagacttaccaacatggaaaaaccttgtctctactaaaaatacaaaattagccaggtgtggtggcacatgcctataaccctagctactcaggaggctgaggcaggagaatcacttgaacccgggaggtggaggttgcagtgagccgggattgcgccattgcactacagcctgggcaacaaaagcaaaactcaatctcaaaaaaaaaaaaaaaaaaaaaaaaaagggctttgccccatgcaggatctttacaattcaatagctagatattattatttccaatagagatataatttatacgactacataatttacactttctgatatttggatatttcaattttttccaaatattataaatgctccaataaaaagtggaattatcaggtcaaaaatctgtgaacagctcttgctattatgtaaaattgattctcaaatgagttttcctgagtcatccctaccagcagccaagtgtgagtatacatatgtggatgtttcacttttaattcagcagaccctgcctctggtattatcttttttttttcttcctctaatgtaacaggtataacatgttaccttctcagtgtgcaacaaataaattagactctgagttttgcaaagaataattaaaatctaagaaagacaaaaataaaagcttgcaagtataaaaactttctatttctaaatcaagcaatttagaaccttttctaaatcaagaaatttagaaatagaatgatagatttaaaaatagatgaacattagtagtgtataactatttataattcttttaattcttttccctttttcagatctgtaacgtacagaggagaatgtaatcttgcatgcacatgttaacctactgttaacaattctggtttcagagtactaaaacaagactgcaaatgtgtccttttataattttttaaaaggggacatactttacaaaagacaaaactaagcagaggataagagtcaaagagtgcaaaacctagagatttcctttgagagatttaacagagaagagggattaaaatttatgaaccaattgtcatccaaaaatatcctatcagtttctctactctgaatgcatctactttccctgttccaagttttaacctttctttaaaagaagtattgaagctctaaagctccagggtgctgtatttagaaggcagtaacagactaagctgggctgttaggagcccacatgaggaggccttgatatgggttctggaacactcttcattttgactttgggattctgctgacagtgagtagcagctctgggctagacttaagacaatgaagactgacaatgacagacaaatttaaagagttgtggtcagactgtggagactaacagtcctaaaataggttgcatactaacttaatagactgttttcaactcctagctcatgtatcagagaaatgtatggactccataaaaataatggaatggtggcacatacctagtgatatagtgatcatattccaaatgccatacataccctaaactcctgaattcaaactagtcacccaaaagtttttgtctttaaatacatataacaacaataacaagggggagaaagtcctgtttctagtccaaaacattgtaaagctcagattattaagaggtcatgtaagcgatgtgcttagtgtattcaaatcttcattcattcaacaagctgagcacctactaggtgctacaaattcagtgttgaataaagacaaatctttgtcctctgaaaacacattttcagaagtggaataagggaacagcagggctcagtgatgcatgcctgtaatcccaacactttgggaagccgaggcaggatgatctctggagcccaggagtttaacaccagcctgggtaacatagtgagaccccatctataccaaaaaaattaaaaattagcctggcgtagtggtgcatgcctataactccaactgctggggaggccgaggtgggaggatcacttgagcctcggagatggtggctgcagtgagccatgatcccaccattgcactccaacctaggcaagagagcgtgaccctgtctcaagaaaaaaaaaaaaatagtaagaggagaatgaataatagaataaatgagtataataaattaaactcattagaatattacattatgtctctgacagaagcacacaggaacctgaaatggagaataacaaagttaaagatgcagggaggtcctaaacaaaatatggttctttgcactttatagcatctattggttttaatagttctctgttttttccctttctctactccccactctcttcttcctctggattctaccagtctagagctgcttcaacatctccactctgcgtgtatacacaacaggcacatatatgcacacctcttttttgatgacccaaaacttcacttaatattaagagataaaaatctcctacttcatgctgggtgcagtggctcacacctgtcaccccagcactttgggaggccaaggtgggcagatcacctgaggtcaggagttcaacaccagcctggccaacatggtgaaacactgtgtctaccaaaaatacaaaaattagccgggtgtggtggcgggcaactgtaatcccagctactcgggaggctgaggcaggagaattgcttgaacccagaaggcggaggctgcagtgagcccagatcacgccactgcactccagcctgggcaacagaacgagactccatctcaaaaaaaaagaaaagaaaagaaaagaaaatctcctactttaatgccataggtattcctagcaaagtacaatgagacttgggtactgaaacttcagcttgactcccccacccctgccctcccctccacccccgccccaggcaccattttaatccctcatattgcttgactagaaaactactcaggaaacagcgctagaaataatagcagacttttatagagggcaaaactgaataacaaaggagcagtagttatcaacatgttttgaaaccaaggcacttttctacgttactgccatttaaacatttattttcctcctttgaaattgttatcagtgtttgctatcagctggaacagtatggaagtgactctcctgaggttagaaacagtctaaccctagttcccaatacaatcttcaccaattcaaaagaaattagataaatcctaccttagaacatgcatcacaggccgctttctgaaattatctggggaaaggttcaggcatgccagcaatggggatcataccaggaaaatacatctcacctgggatagtagtatgaggaggaggggcaagttccaggctttgacccctatccactcccagctgtgtgcttaattaaagtttgatttccagaatggcctccctgtcttaaatgaaaaccaagcgtcatgacgtagctctacagctctgccccaaggcacaggtcttgatttttcattttggcaaaacttcaaatacaatcaagtcagggagaaaagttccaaaatgccatagaaccttcttagatcttcctggtcacagcttaaagagatacacatgaggattgcttaattggaatcacttggaataatttaacctgaaagaagaaacaaatagcagggtttggttttgtttttaaataatatgcagtcatcaggaaaaaagctgaagttgaggttgatcatattaattacctggagttcttgttaaaagtaaagaatcatccagaccttaggctcttatttaattatacagaaatgtgagattgcatattgacttggtttggttttttggtgggttttttgggtttttggtttttagcattgacttttggggaaaaaaaagtgcaaagttaagaaccgtagcaaatagcatggttgcatctttatcatgaacacataatagttatacatttttatggggcacatgtgatattatgatacaagcaaacaatgtgtaatgatcaaatcagggtaattgagatatccatcacctcaagcatctatcatttctttgttttatttcaagtgtgtctctgatttgtaaatatgcatacaaaaaagtggaatatatacaaaaatatcagtagtgattatttctatgtggcaagattccatctgaatttagtgtttttcttttctctgtttttaaatgtttccagacaatacaggcaccatatttttaaaagttatttaccatttaaacttttcaaaagacatcagttatctgctaatcttctgaagaaagcataactggaaaacacatttttctaatggtagcaagacttagcttaggggttaaaagagatggtttcccaactcaactcagaagcatccattttcaaaattctcttaatagaaaatgagtgaaagatgtatcatatccataccacatgtgtcctaacctatccctgaatataaatttgtagagccaattgcctactcaacatctccaactggatgtctcaaaaatttcccaaagttaatatatcccaaactgaaatctttattcacttcctctatctcaattcccctccgcaacctccttttcctcatttggccagccaataatttaagaagtacttttgacgctcccctttttctcaaagctcatatccaaattgtcaacaagtctacttttttctatcttaaaataaatcctcagagtttcagtcagccctaaaatacagcttctatctacacagcttagtgcactttgtgctactgtaacagaatatctaagactgggtaacatataacgaaaagaattattctttagaataataaaaaatagaattcattttttcacagttatgaaggctgagaagtccaagatcaaggcactagcctctagggagggtcttcttgctgcatactcacataacagaagatggaagggcaaaagagaaggaactcccttaacatcaagtccttttataaaatggcacaaaattgcatttaggagggaggggccctcatggcctaatcacctcttaaaggcctcacttctttttttttttttaatggggtcttgctctgttgcccagactggagtgcagtggtgcgatctcagctcactgcaacctctgcctccctggttcaagggattctctgcctcagcctcccgagtagctgggattacaggcacccaccaccatgcccggctaattttttgtattttcagtacagatggggtttcaccatcttggccaggctgggcttgaactccttacctcgtgatccacctgcctcggcctcccaaagtgctgggattacagatgtgagccaccgtgcccggccaggccccacctcttaatattaccacattggcagcacctgaactttggcggggggacacactcaaactataataaacctaacaggtggaagaagtgtaaataaagtctcacatgacccatgccttcaactgtaacaacttcaaattacttgtaagatataaacataaaattacaatagcatttccattgctgctacaaccctatgaatacagaaagttaggggagttaaaattctatgtggaaaagagaagagaaaaggaaagaagtgagattactacttagaacacagagaaaatcaccctcagacagagacactctgaaactgagtgctaaaatactgaaaacaaatctgggacttagtagtacacagcactacctacaggaaagggcttgaaagtgagatatcaagctgggcgcggtggctcatgcctgtaaatcccagcaatttgggaggctgaggtgggcggataacctgaaatcaggagtttgagaccaacctggctaacacggtgaagccccgtctctactaaaaatacaaaaaattagctgggcatggtggcagccgcctgtaatcctagctacttgggagcctgaagcaggagaattgctggaacctgggaggtagaggttgcagtgagccaagatcacgccactgcactccagactgggagacaagagcgaaactccctctgaaaaaataaataaataaagtgagatatcagacatgtcagcctagaggaattactgcttctaggggaaaggaagattaatatatagaagtagtgatgcccctcagatgtctgccacagagagaaaaaagaaagtaagaagaaaaattaaggatcctatgaaaacagaagagaattacaagacatgccaactcttctcccctcctccatgacatcaccactaagacattttattaaagaaattacatt

SEQ ID NO: 12850 - DNA, 24735 bp, Human
tttcattgtggtattgatttgcaaatttccctattgacattttccaatggtgttgagtgacttttttttttttttttttgacgacgtctcgctctgttgcccaggctggagtgcagtggtgcgatctcagctcactgcaaactctgcctcccaggttcaagcaattctcctgtctcagcctcccaagtagtagctgggactgcagatgcatgccaccacgcctggctaatttttgcatttttagaaaatatggggtttcaccatattcgtattggttagactggtctcaaacttccggcctcaggtgatccacccacctcggcctcccaaggtgctgggattacaggtgtgagtcactccccagccttgagtatcttttatgtgctttttggcactttatgtatattttttggagaaatgtctatttaaatcctttgcccatgctttaattgtttgtctttttgttgttgtagttaggatatgctctggataacaaccctttatcagatatagaatttgcaaatattttctcccattctgtagactgtcttcacttttttttttgagacagagtcttgttctgtcacccaggctggagtgcagtggtgcgatctaggctcactgcaacctctgcctcccaggttcaagcaattctcctgcctcagcctccgagtagctgggattaaagcatgcgccaccatgcctggctaatttttgtatttttagtagagatggaatttcaccacattggtcaggctggtctcaaactcctgacctcatgatccacccacctcagcctcccgaagtgctgggattacaggcgtgagccaccacgcctggcctgtcttcattttattaatactgtcttttgatacacaaatgttcattccgatgaagcccaatttatctaatttttctttgattgctggtgattttggtgtcattatctaagaatccattgccaagttttacttggttttgatctctagaagactgccatcatactgaaggtaatcttctgaaacttgcggttttctttcaaaaattatgtttataagatgatccatgttcttgcagagtttattcattttatgctgtataatattccattatatccacatacaatgcagtattgacccttcctcctgttgatgggcatttgtcttgtttctagttactttgctattatatcagtgtcaccatgattatccaaaagtaattcttttgtacactctaatttaagaacaactaaccctttttaatgaataaatcaaccttgtattgagttgctactaagtttcagttgactagtacctgggatacacacaggtgcagacatttgactgagacatattgatttttctcatctgcctatttaggctaatcaccagactataaaaccatgagaaccactgccattgagtatagtctgtgtcagtctacactatagctttaactagttgtgtgatttcttgcaaagagcaatcagagaagacacaataaacacatttactgatttcaggctggagagcttttaagcaatagggagatggccacacacaaggtggagaaaattactgtgaaaaggaagtactttctttagagccccacctaagctaggctgcagaaatgtctacaatgggtttgaaaaaactcaaaatgagcctttctgcagtgtgaaaatcctccaagataaagagacagattgatggttcctgccgccgccctgtcctgcccagttgctgatttcaggaaatactttggcaggtttgtgggtcatagagttgccaggtttcttgggatttgtaatagaacatcacaagaaaatcaagtgtgaagcaagagctcaactcttaacaggggtattgtttgtggttttgttactggaaaagatagtgaccttaccagggccaaagtttgtagacacaggaattacgaaatggagaagggggagaagtgagctagtggcagcataaaaagaccagcagatgccccacagcactgctcttccagaggcaagaccaaccaagatgaggtgggtccacagctttccctcctgcctttcctctggttctttatttcagtcttttttgcatacatcggtagagatgcagaaatagaacaaagaaacgggcaaatgggctaaattatagtgaaccaaagggcttagtgtgttaaatcttctccttttctgcatccatagaagacagtgctgctgtctttcccaggagataagatttactctcaggagtgtctttttccttcaggttacatttttgactttatagggtatgtcatcagctcccgtggtaggcttcctggcatcctgagtatatttattagcagatattttcctctttaaaaatgtacaataaggaagactaatagtaacacatttgaatgacacaattaattgactagtacctgggatacacactaatacctgggatacatctaattaaggcacttagatcttataaaaataaacactttttgaaatgttgaaataataagactagaaactttttttttttttgagatggagtctcgctttgtcaccaggctgcagtgcagtggcatgatctcggctcactgcaacctccacctcccaggttcaagtgattctcctgcctcagcctcccaggtagctgggactacaggcgtgcgccactatgcccacctaatttttgtatttttagtagagacgggctttcaccatgttggccaggatgacctcgatctcttgacctcgtgatctgcctgccttggcctcccaaagtgctgggattacaggcatgagccaccgtgtctggcctagaaactattttaatagaagcaagtagtgcccgaatggttggcatttgttagtgagatggtgaactggcagacggcacctgtgggtcaatgcccatggccaccgtcctgcttttggacaccagttctcttccaggtaaccttctggcattttggggtttcagataccatttcctaaaggtgaattattataaaatactagaaatacccacgtgtttaaaattatatatttaaggaaccttttattacggaaaatatcaagaagtagaggaatagcacagtaagcccaaagttcccatctctgagttatctacattttattaccactatctttgcggtgtctgagggaggtttctctttcctggagggctcctgtattattgccaatgtactttcctgaatgcggccagaaactgagcccacccctccacctatgtgcctttctatccctctctgaagcttctgcagaattcccagcaggacagggcttgctggaagcttggtatgctcagaagctgctaaagtgtgtatgggcaggtgtgggggcaatttcttggtcctagcacttccatatatcgactttcttttctggctgctaagtgggaggagtgtgtgtgtatgcatgtgtgtgtgtgtgtgtgtacatgcatgtgtgtgtggatgcatgcatgtgctgtgaagcagggagactagctttccactcctccttgtcttctctctgcagtgccctgggagctgtcattgccctcctgctctggggacagctttttgcagtggactcaggcaatgatgtcacggatatcgcaggtcagtctttggttgggtaggagtgtgcatcccactctgaccctctcgggtctgcactctctctgagaacacccaattcccccttcttatctcgacctctgggctttcaggaccataaagaacattggggttcctgccagaaatgaggggagcttgcctttccattggcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattagggcctgaagggcactggctgaatccattgtctacatcgcccacagattaggagagcctgtgcatacagagagcctgctagagagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaacaagaggcaaaggcccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaatataatacagttcaccagccagggctcaaaaatctcagtatttcccacttcctttgttagaaaagtgggaaatagagctttttgtaatgtaaacaatttaaaaaacagaattattttaaaactgcaactattggaaatgagatcagcaggtggtaagggcaaagcatttaaatctttctactttacgcagcagtgacagccgcccatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtgttgtgttcagtcttgagtcttttttatttgctcctttatggtccagggtagtcagaaggtatagagtctactgggagtatggcagaaaacaccctaaacccactggaaatcccgaaggtgatacaaactcttccaccttagggaatcatgctcactgattgagtgcctattgaatgctaggtcccagaaagttaactgttgtccttgttttacagacaaggaaacagagactcagagatggtaagtgagttgcttaaggttacatagctatgaaacagggaagcagaactttgaacccaggtctgtttgatacaaactcagaggtcctttcactgcatgctgttgcctcctcaaagtgaattaggagaaaaggcatgggcctggttgaggaagaggctagctcaaaatgggatggggaaaaagtgttttaacacagacagtacttcagagtttgggatctaacctaccagcactccagaaaacaaaagacaatgatgtaaaggcaggatctctggacttactgagtccaaatcacagaatggcccataaatttgctaagtaatttaggtttcctggccatcagttcctggtctcttccatgaaggacttgagccaggcgatggctaatgtccctatcagcaataaccttctggtattccataaagagtggggaggtagagtccctgcatcagtagaagctgcttttcctactgggaacaaacccaccctgcaccaggaatcaaatgcaggctgtctgagcctcctctcctgatggcaggtcatgctattaagggtctcccagaagaaaggttctggaactctgagaaacagaagctcttctaacagaactttttcttgctataagctttcaataccaccaatcaccagtgcaccttcttctcatgccaaaatacggcccctcctttgtagggtgtaaaacgacactgatgtcactctctctcaccaaggtctggccatctctgtgaagctctcctcacaggcaccctgcagattcatcaataaacttcaacaggttagcgccagtaggccaataagatgcacacttatattctagaacctgtgaaagaagtaatagccagaaactggaaaataacagtcaaactcttaaaaaaatgcctctcagaacacagtcacttacaccttttcctctggtagttctcttcagcaccaagtttcctggaagaacaagctactccccagttttcttaaagaattgtctgattgtattaagtaagtggcttctggtaaaataatggtaagagaaaagctctggcattctcttgatcactcatcttctctgccttcctccctagcaacatctcctggcctcagcctgtgggcttcagcaacaccaaactccatgttgctctctgacaagcccggccgtctccagttcttgggctttatttcctcgggggccctctgctgaaattcccttccccttgctgtattagcacctcctacccgccttcaacatgcaggcactgcctcctctaaggagccatctgtacttacgtagctgtgagcataggatggggcatacagcaggcacttaacaaatacttgtggaatggaaagaaactaagataggatcaaaaatacaaatcaagatgtgagagaaagacgatcaaaagccctcacgagggggctgggcgtgatggctcacacctgtaatctcaacactttgggaggctaaggcgggtggatcacttgagggtgggagtttgagatcagccagagcaacatggagaaacctcgtctctactaaaaatacaaaaaattagccaggcatggtgatatatgcctgtaatcccagctactcgggaggctgaggcaggagaattgcttgaacctcggaggtagaagttgtggtgagctgagatcatgccattgtactccagcctgggcaacaggagtgaaactctgtctcaaaaaaaacaaaaaacaaaaaagaacaccacgggaaaatcaagtgtgaagcaagagctcaactcttaacaggggcaatgtttggagttttgttactggaaaagatagagaccttaccaggtccaaagtttgtagacacaggaattacgaaatggagaagggggagaagtgagctagtggcagcataaaaagaccagcagatgccccacagcactgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagatagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagcttgagctttcgttggcttctatttggggtagaaggagattgatgtgcagagcagcttccactcatctgacttttcatgggtctctgggaacaatttccaaatggtaaactctctggcttctctctctttgcagatgaccgcttcccgaagccccctgagattgcaaatggctatgtggagcacttgtttcgctaccagtgtaagaactactacagactgcgcacagaaggagatggtaagacctggacaactatctctgtgctctacctacaacccctgctctgacatttccatgatgggtggtgctgaggtgatttgccagaaagttcgttgctctccttggagccaggagatttagattctgataagcgttttgtcgccagtagccatggccctttgggcagactaacttttgtcagcctcaagttttctgttttgttaaggggaggtgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatatttatttgctcacttagtccttacagtttcccactgaatagaggttattattctcactttgctgataaggaaacagaggcaccgacaggttgagtatcttgcccaaattcaggtggcctgtaagaggcagagtcaggatttgaaccctgagccctccctgtactgcttggctgtgaccgccatgaccacagtgtgttctgctgggcttaactggtgtccaggcacttggcttccagcacagcactctttcccttcctccttctcatattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaaggatcaccagggtcttgttcattggggcctgaagggcactggctgaatccactgtcggcattgcccacagatcaggagagcctgtgcatacagagagcctgctagagagccctgggtctaaggagaagcaagctccagggagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaattattttaaaactgcaactattggaaatgagatcagcaggtggtaaggacaaagcatttaaatctttccagtttatgcagcagtgacagccgccaatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtgttgtgttcagtcttgagtcttttttatttgctcctttatggtccagggtagtcagaaggtatagagtctactgggagtatggcagaaaacaccctaaacccactggaaatcccgaaggtgatacaaactcttccaccttagggaatcatgctcactgattgagtgcctattgaatgctaggtcccagaaagttaactgttgtccttgttttacagacaaggaaacagagactcagagatggtaagtgagttgcttaaggttacatagctatgaaacagggaagcagaactttgaacccaggtctgtttgatacaaactcagaggtcctttcactgcatgctgttgcctctttaaagcgaattaggagaaagggcatgggcctggtgaggaagaggctagctcaaaatgggatggggaaaaagtgttttaacacagacagtacttcagagtttgggatctaacctaccagcactccagaaaacaaaagatgatgatgtaaaggcaggatctctggacttgctgagtccaaatcatggcttggcccaaacatttgctaagtaatttaggcttcctggccattagttcctggtctcttccatgaaggacttgagccagggtaacgtccctatcagcaataagcttctgggactctgtaaagagtggggaggtagagtccctgcctcagtagaagctgcttttcctacttggaacaaacccacccttcaccaggaatcaaaagcaagctgtctgagcctcctctcctgatggcaggtcatgctattaagggtctcccagaagaaagcttctggagctctgagaaacagaagctcttctaacagaactttttcttgctataagccttcaataccaccaatcaccaatgtgccttcttctcatgcgaaaatacggcccctcctttgcagggtgtaaaatgacactgatgtcactctctctcaccagggtctggccatctctgtgaagctctcctcacaggcaccctgcagattcatcaataaacttcaacaggttagcgctagtaggccaataagacctatattctagaacctgtgaaagagataatagccagaaactggcaaacaccagtcaaactctttaaaaaaatgcctcttagaacacagtcacttacacattttcctagatctcttcagcaccaagtttcttggaagaacaaggcactctgcagttttcttaaagaattgtctgattgtattaagtggcttctggtaaaacaacagtaagagaaaagttctggcattctcttgatcactcatcttctctgccttcctccccagcaccacctcctggcctcagcctgtgggcttctgcaaagtcaggtatcaggactaattagctagcatcaaattcctgttaattccagaagcagggacaaacctgttggggagggacttaatgacaaaattaggtataggtctatacgttaatcaaggaaaattctctacttccttaaacttacttaccaccctagaggagagccaaatccactctgatgacgtttggtcataggaaggaaattggggaaaattacaagtttctccaatccatgtaaaattaagaaatcctggggaagttgtaaagagaaaacagtaccctattcccttgaaaggcagaataggtttataacttataatcgaaggtctccttcaggaaggacttcttgaaccccatatgtcctcttacaacactccaatattgcctgtaaaaaagtcggatgggtcatagcggctactgcgagaccttcgagccattaaccaaatagtccagaccacccaccctgtcattcctaac

SEQ ID NO: 12851 - DNA, 15473 bp, Human
ggtatgggacaacggcagtggaagggagaggaagccaatggggaagtcagggggccgtggtgacagtaggaacaagtggtgcctatgtccctccccattcagtttaccagctgagggtaaagacagacatctgggcttcacaggatttcagaaggcatgtctagggcaacactaaacacatggcttgacagaaatttgaaccaaagcatcgaacccagtgaacgaggcagaagggcagagagaaggcaggtagaagccacagaccagaggctgggacccagggcacagcagaaggtttagaatcagagggaaggcggtggtgcctcagtagagtccttgggccatggaactcaccccaggagcttttccaggctgcctgcagcctgcaatgtgggtgtagagtgtggctaagggagctgcctgctgggaccagctctactgctcaggacactcaaatccatctgtatgccactgtcatcaccccacacatactctctccaatcccggcaaaatcagtgctaatgtctcaccaacagattaaggcctggattgaagtacaagaaacaggatttttaactcaagttaattcaattccccagcgacccttgttaacttattcaccctcagagacgtattaatagttctgtcttatattgtatagaaatttgtgcagtgagttttctggtagctttacattttttttctcacttcagttagacatgtaatctatttaaaagtaatatgggaataagataaatcagtgtaggaataacttcctggcagaaatatttttactagtttctgagtgtaatatcagcccagcaaaagttatctgcaaatatagaagttctcatgtacatcaaagacactcaagttttttttaagaaataaatcattttatgctactgaaataactctgtgatgtgctattggcatttaaggagctaaacagactctatgggccagccaacttctactgcaagcattagacatgcacaggctttagactcaggcacaccttagaagttctggctttgctacttattagctatggtaactcgggcaggtcatttatcctctctaagcctcaacttcctcatctgtgaaatgggaataatatcagtcacatgccagggataaatccagggagaatggccagggggctgtgtcaaaggccagacacaacttccaccccaggtgaatgtcgggaccaggacagtgagcaggcaaaccttgcccttgccctccttccctccacaatcttaaagctccttgaacaacccccatccccaccccctgagaatgtctgtgccctcctgctgaaagggtttggcctttcagtgttcccctccaccatgagctgtttccatgaaaagatctcaagggtgacttgaggctacggtcatcactaccacaagccttttcccatccctgcctctacctattgccctctaaataaggaagccagcgctgccaggcaaagaacttctgcccaatatgggtcctgggtggcctctcgcctctctctttccctgggcccccagccagctcccccctcccccagagatgctccctgctcacttcattcctgcctcatagttggaatgacagtggctcccagaacccctggggagtgtggagggtgatgggggtctggggaggcagccaggcccaagagcaggttaatgttacagccctggataagtgagctgggcgggttgacgtcagggcgatgatgggtggaggggagggccgggctgctgaagcaactataaagataggtcaaatcaaatatcatcaactagggacggagcaagcgggcgagctagagagcgtccccgagccatggtctctaccggccgcggctcagcctgggtccctctgctctcaacccgagtgcccgatggaggctttggtttcatgtcagcagccttcatctgccttccaaaaataagcccctgccgccatgccggagggagaaaaacaagaagggcggtatttttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgcggggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagtgagtgccagctgcagccagtcgggacgcttgggggtttgggctcatgcagggctaaaaggtgaaggggccctgctctagcggacaggatgcacgataaagggggcagaaatgctgctcaccacttagatgattccacgtgaccctgcctgggtgcaagctcaatatactgcggtccaagcatcctggtgttctttgccatcgccttggttagatcctcagtggcactaactatttcagcattactggcccatctgatgccttgtaagaccattaggaaccattagtctgggaagcccccaaggcctgggtagggagaatcagttagtatacttggatcaaatttgacacaagctcatttttattcagcttctttcttggagaaggaagggaaattcaattgcaaaatgtccaactgaagcacatccttctttttatttcagcggctccctctgtccccaggttcttatcctgcaagctgcctgcaagctgccagcttgctgtatggttagtctcctatccaagaaaggatgggggctgcaggatccaagaaagccatcagctatggtgtggctgctgtgttttcaagattaagtgggttgagatttgttgaaacatgtagagtacacattaagaagaagaagaagaatcagaatttatttttttactcaagtcaaggacctcaagtaattatgtcactgaaagcccagattcaaagctcatcttaaacagatagctaagtggtcactgcagcccctaactctgctatcagaaccttcccttgcagaactggatttctaacagcacaatggcagcactcgatgagtccagcagccagggtctcctagagttagagggatcatggatagggcgatggagagtctggctttctaggagaagggggatggactgagatgcccttgtcggctcaagttcccactctgatttgcacaagccttaggtaatgtggcccccctttccttgtcaggcctgctggaaatttccactgtggagcgaggcgtggtgagtctctttggagtgagaagtgccctcttcgttgccatgaacagtaaaggaagattgtacgcaacggtgagttcaccaggccggggaagtgccaggtttacaaggcttgatgcttacacagttgaagaaaataatatgaagtcctgagtagagaagtgactatctaaatgggaaaggaaaggctgtgagaggagcctgtgaaagggaggggccttgcagcttgtgcttcttcagcctcacgggtgattgtcctctgccctggcccgtgcttcttctgttcccacctgccggccggagcccgtgtgcttaaacggaaaccacagctcagggagcccgtgggccagagggaaacccacattctggcatccaggcttgtgagcaggtgtgattccctgcactggcgaggccccgagagcaagtctgtctctctgcctgggtgcgctgctccatgacacgcgccctgcaagacgccccagcctcgtgcgcagcaggaggagtggaatgggaggctattttcatcctcatcagtgtgctgagattctgcactagggttttcaatcctctggtctccgatcacgtacgctagagaagcagcctacccgttatacactttaggctggtaccagtcccacccattcccatccccacccccataggtcacctctgggagtgccaatgctggcacttgggttaatgcaaccagcttctaagcacattgacgaaaacctctgctctcactgacctactctttcctgcagccctcggcccatcatttggcttattccaaaatatggcggggcaaacatcccgatgaggctgaagaaatggagagttcctttgacagaaataagcaagctaaaaaggaagacctcagagcaggcctcaaaaaatatcaaagttatttatggggagggtgtggagagctgatctactgccccttggaggataaactgaggactgggatgtgaagaaatagatccaggactggcactgggtcccaggggagctgtcccaacagaggaggtctatgaaatacaagaacgggttcaccaggtggcctccaccccataatctttagtgctaacatctctcagtctgggttggtttatgtggacatacggcatgcactacaatcagtgggtctcccacacgggtctgtggacagtttgcatctctgtcaccttggaaacttattaaaagtatggatttccaggtacctacctaggagattcttattcagcagagctggcgtgtgggcctggaaatccatttgtttttgtattttaaatttgccaggtgtttctgaggaacaggcaggcttgggggtcagcaggctacatggcctctggagggcaggggaccacccactccccatgttacactgaacctgaaagctggagggcgagtgagatgagacagaagagacatatccttgttaccgctctctgggaaagtgatggcgaggacaggaagaggcctgggaccaacccaggttttgatggagcaggtttcccctctgtagggtggggcatcccaaagaaccccttctttccagcctgcataatgcccggaagcccatagggtcgggagagccgggaatttaggctgttggctgtgggactccatgcaagcaagggacgttttagcaagtaaatctcctgggagaaagcacaaatttcataaactcttctttctccttgtcgcctttatcaacaaaccatttattacttttttcttcctacccagaaaggaatttaattgtggggaggagaaaatgcacaaatatagaggaaatttacccacttcccactttcaatctcttggccctggaaggagaagctgggaaaggctcgggaagggaatatacgatttaaccatcagagaaagcgccacaaagcggggaagagcattcagaatagcaaaaaggaaaggaggctgactcctaatgcctgaaacccaccaccccacccccagccctcactctgcagcaccgttactggctgatgacttcaaagggggttaggcaggttgatgaactgctgggcttactaaacaagcagagtccaggagaaaggaagacttctgggaaaagacccggcgcccttcacctccaccctcccacccctcctaccttcaccctcagtagcatttggccaaagagcatcttctccagggagggagattctcctccctggacctcagggccagccgggcctgcacacagagagtggggctggacagctgtgccccaagcctggggcacctgacgttttgtgtggctcaggaccagatgctcctgagcaacttctacccctccctctccgcccctcagaggccgttatcacagtctaaaaaaacaattgccaactgatccccggagccaggaagactcctgctgggtgatgatttcattcacactatttccttttaagcccccggagctgcctcatctcccaggctcagctgctactgccagttcatgggatttctcatgggtgggggagggaaactgggctggggctgaggtgttggtgagggggacaaggcaacgactcgtgggcagagaacaagggccaaggaaacctggctagaagtggcttcacacatgtctgtctcctggaaagaggggtgtggaggctcagggcagtttgccaggcccccctttagacaatataaacagctgccctgccctgagcactagcctactgcttgtgctcggattcacaggctgcagagggcttcacgagcatgatctcacagcacccctaggaggtgcatttgatcttcatcctccctgtgcagctgcggacacccggtctccagggtcacacgtccagccacagctgtgtgcagccccgtctcagggctccgcgacccgagttccagttcctggccaacctaccctccagctactcgtcttactttgggcaacgtcactgaacttctctgggcctggatctctgctctctgaggatgaggcagaaatcagtgaattctagcccccttggtcccctttgaaattcagaaaacaaaatatcaaggatctccacctgacagtggttctattagaatcctttggttgagaaaaatatatactagtaaaaagataccagcaattcggtcgtgctttcaagtgatttcagttttactaagaagagccgcatttacatgcttttcgtcaacagtatgacaatgtgcaaaggacaaaattgatttcctccagagacctttgattattatctggggcattacattggggcattattatctggggcattgcattattatctggggcattacattattatctggggcattacaaggctgggaggaccagccttgccttggctcagctgccactgtagcagaaaacagcactcctgagggaatgggatgaaggacacccaccatgaggaagtgctgggagatggggctggagagcagcgggaggtgcatgcccttatgcagggcctgaggctctgcatacaaatccccgcctgctacaaagagctgcactggagtgagaagaatgaaacacctgatgaaaacactttccaacattcctaaatcaacagttcaattgtgtgctaggaaaaagggttggaaaatgcaggcatcttcagagctgatgatatttcagctaaagacaggaaaagaagcagtcaggggctacagaagaaagtcttaggacaaagaattggtttatttttccttcttgcccacatccttccaccccatccttctccatccaacacacactgccaggaggaacagggacaaatggccccagcggtcacagggtgaagatgtttaaaagcaggattagatcctcgttggtccaagtgacttagctctaaaggcgagagggtggctgtcttgtccacctcacactttggaggcacctctaccccatggatatgcttgctcctctgagaaatgcccttctccatagtgagtgccaaatgcacataagtctgaatagacctacatcaaattgaagatattttcatgctggggcttgagcctggcaggcccaggaaatgtgacccagtggaatgattttcatttattcaagtaatcatatacagtagctgcttttatgaacatggtgttcacttggctcgagtgcgttcttcaccagagctgaggggccaacattcccaagccatgagaactcaaagctcagggctctgatgaagatgaattaaggggctgggtcttgagcatcactctgggcatcgggaaaatcccatcagcctgaagcattcagaaaaaatgcactatctctccttcatgccacaggcctcctggccttccaaaccccacagatgtgggtgctgagggcggaggagagagagcagcaaggggaaggttagggcttctaacacaagcttcctctactagttgtcttttttcactttagttttgtacaggattctggggaaggccagggatatgagacaggctagagaaaagggcagaatggaaagaaaaaaaagtagtaaacttgaaaaaaaaatagaaacagaaaaaaaaaaagtgtgtatgttgagggggagtggatttgaatgatccaaaatcgaatgaccagagaagcaaagtacaatctacgcatccatggtcatgcatgcttaaacaatcatgttttaggagatccagatgtttaggagaggctgggttctcaaatgggcacattctaggcacggggaagtgggcaatggcttgagagtttcttgtccaagtcactcagttcctcccacttccccttcctccacctcaagatttcatttcctcactagagcttgcaaacaacacacgaaacctctcccttaaccaccatccagatcagaaataaattctctggaactgactgggcgggttactctccagggacatacaaagttagaacaggggggaggctggtgggtggagaggggccgtgacccaacaagaaggagaccaccagtttctgatcaaaatgttttctcgcttcgtttcctggcccatttgctaccctaaattcccttcccactttaaataatttacgtacttgactaggtaacacaggaacatgttttaaggagaaaaaagtatcaaagaatattctatggaaagtctcactcccaccattgtcttgaagccactgagttcctccctagaggcagccccagttaccagtgtttcattccagtatatcgttccagaaatagctaacgcacacgtgcacgcaccggtatcatcttttttaaaaaatcacacaaacaagagcgtactatgccaacactttttcaaaccttgtgtcttcacttagcaatgtatctttgaggccatttcatgtcattacagagaggcttcttatcttttcaaggcttatagaattccatcatgtggatctaccataattgagttagttactcctctttttttttttttttttttttttttttgagatagagtctcgctctgtcaccaggctggagtgcggtcttggcccactgcaatctccacctccccggtccaagagattcccctgccttagcctcccaagtagctgggactacaggcatgcaccaccatgcccagctaattttttgtattttggtagagatgcggtttcaccatgttgaccaggatggtctcaatctcctgacctcgtgatccacccaccttggcctcccaaagtgctgggattacaggcgtgagccacctcagctactcctctcttaatagatacattgtttttggtcttttgttatttaatgctgtagtaacttttgtgcgtgtgtgggaatatatcagtaagataaatttctaggagtggaattgctgatcagttgctatattcatcctttattctggtagatgctgccaaattgctctttatagagattataacagtatacacatcagaggacattaaatgagaattcctagtttctgtgccctcactaatgagagcatagtgtcaaacgcttttctctttgaaatctggccactaaaaatgggatctcacagttataacttacatttctcttattaggcatattctcttctgctcaaatgccattgatagttcttttcctgggaattttctgttttataaatgctgttcattctccagtgagtttagggttctgaatatagtaacaaaatgtattctttgacatatgtgtattgtatgtattttcatccagtttaccatttctgttcttcttttaaggtaatatttttcaagtagaagacaatttattactttttaaaaatggttttaattttttttgtcctgattagaaagatgttcctgattctgagtttattaaaaaaaactttttctggattttaatggttcttttttttttacatttgaatctttactccctttggaatttattttgatgtaagggataaagtcatacacatcaaactttattatcattataataaaataccattcagttgttccaacaccatgttttctctagtgatttaaaataacacttttactttatattcatttcagattaatttcattttacatccatgtatgtgttgggatctactgctggactctatgttgttcattgacctgtactggacttctcattagtgtagctttacttggaatgtttcaatcagttctgagctgaatttttcctggtgctgctgctcccaagcttgcccaccaacgactgaagtcctgtgcacagggcaggaaaccagggtccagagaggctcctaatgaggggtcttggttcagagccagcgtcagcctctgcccttcctctggcttcctgctcttccatgcaagcttactgtctcccaggcactccatcaaaaaccgcagagcttaaaagctaaattgtccagtaacccccagcaagtcttatgggactggtgatccagggtaaggcagtctttcgaggcttttaatgtaaagtagttcattatttacttggagaagaatactagtactactaatttgtttttaattctactgtatagcaagcattgttcccaggactttccatgcataatttcaattaatgcttactccagttctatgacacaatttttcttactgttcttacttcacagatgagggaattgaagctttagaggttaaatgatttccccaggctcacgtagctaagaggctattgtcatcagtctaaccttaaagctgtggcacaaatatgttcttgacctacattgattagttcatcctttttacctttaagacatcccttcattcatccattccacaaatattcactgagcatcctaacgaggaaaacaggaaagcttatgaaaaacccaccccccggtgtggcattaacctgttgacatggctagtgaacgccttcacatttatctcaagcaagttaacatcagtgaaagtgctttgtaaataagctgcaagcatgagagaagaagatggggaaaacatatgagggcagtttcaccgtgttcccataggcaaggctgtcccctcacccacgctcacatcacattgaaagagccacccatgcaggggtctccttatgtttctgtgctgtccttatttacttatttatttattcttgagacagggcctcactctgtcacccaggctggagtgcggcggagcaatcatggctcactgcagcctcgacctcaagcggttctcccacctcagcctccagagtagctgggactacaggcatgcgccatcatacctgccttttttttttttttaagcttttgtagagacaaggtcttgctatgttgcctaggttcctctcaaactcctgggctcaagtgatcctcctgccttggcctcccaaagtactggattacaggtgtgagccactgaaaccagccatgttgtcgctattaaaccaccatccactcagcatcatgtaccaagcaagacacagtcctcatctcagggatcttggagtctattgggaaagaaagtatggctgttctaaatgttgccagagaggtccactgaaagggctctgggagtcttggggccctgaggagcaagctactaaccagcccttcagaacagcaagaggttctcgtccagctacactgccagcaagatgggacactagcagtacgattcctttacagaaggtcagaggacacctctggcacagcccagtagccatcgagcgggtttttttttatactcaagcaagaaggagtcagaagttatcctccatccatttctcattctatatttcttttcaagagtagatcccgggtctctggctcccacctcgctctctgttcttctagccccgacccagctgcttccccacaagagcaggaaatccccgcatactcccttagggcagccacccaggcaggttgcagaggaaagaggaggacttggggtgatgtactgggaatgaatctgtgcatgcgagacaggaagtccagcgttcatgtgacaggaagtccagtgttcatgtgacaggaagtccagcgttcatgttctgaacaggtggtccacacacactctacaaaattagcatggaaagggccatttttttgttggtcccaggctccttggcctcacctgtcacattgggaaccaggtccttttccccataaaaattcctgctcctcaccatttctgttcctgcatgtccctggagaactatgattgtcttggacagcagtccccagcctttttggcaccagggaccagtttcatggaagactatttccatggacagggtgagtgatggggacatggggggacggtttggggatgaaactgttccacctcagatcatcaggcattagttagattctcagaaggagcaggcaacccagatccctcacatgcaaagttcacaacagggttcttgctcctatgagaatctaatgccactgctgatctgacaggaggtggagctcaggtggtcttgcaggcaatagggagtggctggaaaacaaatgaagcttcgctcacccaccgctcacctcctgctgtacagcccaggtcccgcacgggtatgggccgctgactggtatgggtctgcagcctgggggtcggggacccctggtctaggaggtaccagacctcttctagactcaaagtcaaaactgagaatgggcctttttgagggatagaaaacttgagacttaaaccaggaaagacagactgaggaaccacaagcagaaacaaagagacaggcagtgctggaaagggcttaagagatcacttgtgtctcctccccctccaccaaccgcctctctccttcttcccccaccacacacagtctgcagaaaagagaactgaggctgcaaggggaggaacctgcccaaggtcacacaattaggaagtagaaaagtcacgaaatagcaccctgagctctcatccctgctccagtagactccctctcagagtggacttgagaaaacagcttgtgtcatttcctggtctgttctttgaatggaataagttaccatctagggacttagtagaaactactctggaagtcaggacacctgagtggtagagcctcagctctaccccatgtggcacagaccatcccctgtgtccctgggccttggtttccttatcgtaaaggagggaaggtgagaggaaaccatgagagcctgcagcctcttcccatcctaacctttcaccattctgttcacccaggatgctcagacctcacggtggttgtctcacaaagagaagggaagggcacctggcagaggggcctactctctgcggcccagctggcatctgcagcactcctcatttgtaacccagtctctgctgtttgcccatgtcttccacagcccagcttccaagaagaatgcaagttcagagaaaccctcctgcccaacaattacaatgcctacgagtcagacttgtaccaagggacctacattgccctgagcaaatacggacgggtaaagcggggcagcaaggtgtccccgatcatgactgtcactcatttccttcccaggatctaaggacccacaaaagaaggctcacagatttaaagcatcatctgttcgattgaaattttgcaccagcgaagaattccccttgccctccatggcttctgaatcaggcttatcctgtgcttggggagacctcagttgttttccttggccactggaccccacggcatgtagcccattcaaacgagggctaaaatcagcaattttagaatggcaatttatcccatgctctgacctccctcgaggagagaaggtatcggtgacacttgtggaatgtgaccatgtgcataggaaaaggccagggtaggagtttgtgtgcattgttgtatatccatacagctttatacacattctcagagcaatggcatttcaaagcatcaggtttctttctcctagcatcatcgctgcaggaatctgcctgtaagaatgtcacttgtcaaaccagcaagattgatgtgtgctcccattctgcctctttccaatcatctttccattcagaggccactaactacatgggttgcataggtcagcagggagcagctgtcctcaaagtgcagagacggcagagtgagagggtgtgaggctgaactgcaaaccagaaagagagtgatcaggcacttcaagcttcctgccagagagggctctggggacactgggatgaactgtcagggaggctgggggagaagcggttcccttcttggaggaaaggggtagagcagcatctagggcagctgaggaaggcttgtggaggcagcagaagggactggatgttctaggagagccactctgcctggagaactcaggctgtgcatggctccaggaacaagcaggggccaggctgcctgcccataacgtttcctcactttgaactggtcttattttaacctcagatgacaaggatcctaataatggcaacctctttggcgaggagtagggggacaaaatagggcatgaaggaagtagagaggctttggactacagatggtaattcctctccaactatgtccaagaaacgcacccaagttctcatctgataccctcacttccttcttgctcatcctcatctcacatacgcgctgtgcctggatgcagcagaatgggcaccgtgacctccagagtttgtgctctcttcctccctgcagtagaagaggagtgataatcccacagagtcaagcagccaagctgaagcagctccttgctgcacagtgccttctgcctcctgtcctttgagaatatttaaagcagaggttccccaagtgactataaatgttgtctgcccggagccttcagattcctgaaccattggaatgttcctaaatctgaaaccagagagagccatatcagagtgcaaatatttttggcatatgtgaaccatggagttacaaaatgacctgatgacctctgcgactcttgggggccccggcctgcaagacaatccttcatctgttgcaaataccttcatcttcaacatacctcgctatttgcagttgcatccatctatagatagatctgggttgagggattctgagctgaagatgggaggttggcaatcgaagggggagacaccttacctgccacctcctctgccctgcaaatgtcagggaggacatgtgctgggtgaggaagaaaaggccacacccaggtacatgaagatggaagagactgtagaagcctcggaacacgtgtgcacatggccaacccttggatgttgtagaaaagggagaaaactggtccatcttgattccgtggaatgttgaagtgtgggtctgcttggaggcggggataaagctctccactgttttttagggagtcttgtccagtgcaatcagtctcttgaacagggtccatcagaaatgcaggcactccaaacctgaggtgcatatcagttcctagtggagcttggaatgtgggatggctggcggacggcgtgactgtgatccagagaaaaaaggagaaggaagttttaggtcccatagcatgctttccttttttccaagatctttcagctcacgtggcaggaaaggagccatcttcaagagagtctccaaagccttgggctgccagccttgtccttcatctctc

SEQ ID NO: 12852 - DNA, 4123 bp, Human
  misc_feature (1)...(4123): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggacccaaggaccccattcgactactgtgccctgcgacgctgcggtgagcactagtgacgcttgccccatgaccctgcctcagccctcaccaccaaaggctggctcccttaaccccagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgtcgttccaagctgcgcgtggctgggggccatccgggcaactcaccctggacagtcagcttgcggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaatggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatggtatgtggtgcctccagggaccaagtgtgagattgcaggctggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccggggccctcatcagttctcctacctgccagggtgactacgggggcccacttgcctgctttacccacaactgctgggtcctgaaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaacgaaaatggtttttccccctgcaagtaaacagtaatgaagaagagaattattcctagtgcagtttgttttcatggtcttaatttttgctaagactccactgcttttgccttatcaatacaagtgccaacacagtgaagaggcaaatatcatcttagtattactatgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaa

SEQ ID NO: 12853 - DNA, 48316 bp, Human
aggaattctggccgggaacagtggctcacgactgtaatcccagcactttgggaggccgaggagggtggatcacgaggtcaggaaaccgagaccatcctggccaacacggtgaaaccctgtctgaactaaaaatacaaaaaaattagccaggcgtggtggcaggcgcctgtagtcccagctactcgggaggctgaggcaggagaatggcatgaacccgggaggcggagcttgcagtgagccgagattgtgccactgtactagcctggatgaaagagcgagactctgtctcaaaaaaaaaaaaaaaaaaaaaaaaaaaagtgaaggaaacagaaccttccccaaagtcatgttgagaaaattagagatggctttttacaactttaaaagcagcagctaaatatttgctgaatgccagaaagaataaataggttgcttttgatctaagagttggggcaacaaaatggtttaggagatagaaagtagtagggtgcaaattgctatagtgagctcctcaagtaaaatagagaggccttcaacataaatttaccttttttactggccagaactcaatttggccagtaaaagaacctgccttctacaatgaagtctttggtttgtgtgtgcatcagaacatcttttaaaaatacggacttttcttctaacttcttttcctgcgaatgtggtgtaggtcaaattcgtgaactggttaagccgctgacaagagagggaagggcaccccagccaatgggaacccgtgctggtgatgtactgctcctaggctgcgattcattggctgcctagggtttgtcattctatccccggcgtctgcaagcagcgtgggtcgggttttccagctagctaaactggattttggccgctggcacgtgcagtttctattaactttagctcatctctacctcttaatagaagcagctgttatgtttctgattattctcctgattttgaaaaatcctgttcccttaacctacctcattggaggtcgttggaggtcccctgggacagaaccacgtgattatctaacatgtgcaaataaatacaatgtggaatcccctgaactatagagggaaaacctgccagaaactcagagcatgtgccccgtgcgtgaatcagttgcactcgcacattggtgggcggtggtagcgtgcttgtgtctctgccctttgggtcgcgaggtgtgtggccgtggcacctgcttgggcttcctggggtcactgggagaggaaggctctggaggagtgggactctggggtaggggggtctggcagctgcctgggacccaccatgggttcgaagggcagcggccagaccgcgacggcgcccaagaagggtggacagcttcgggtctgtgctcggggctgcgtgtacaccatcttcgcagggagtggggtttgtatctgcaggcaggtagaagagccagggctccgggcgcggacgccgtaggggtagcttccgagtccctacttggccaagggccggcacggaggggctgtcgatctactgggcacctaatagccgcacattctgtccagtccctggcgccggaacgtgaaggcccgggtcctggctgctatccgggatccggacgctcccttcggcttcggcctggtgctccaggccgtaaggcaaaggcggcggcagcagcagcggcagagaaagaagctgggtaaggcagtgacgtcatctgtggcggcccctcccccgcccgccagccctcaccgcagttcctgcccaacgacatccgggtctctgtagctgcgcgccgcgccgcagctgtagcggcggcggagccagcggggcggggcgagcggaggggtgggggaggggcgacgcggtcgtgagcgcgcctgcgcggggccgcgctagaggcggcggcggcggcggtggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcggtggcgcggggagggggcgcgaccctctggccgtccgcggccgagatgggtgtttgtggcggcgaagcaggcgacggccgcaggccggcctggccggagagcggcctgcagaacttttcccgagcggggagggggcgtccccgcgcccccacccgctcgggcgcgccgccccggctgtcctgggcttcagcccctgggagggaggcggggagacttcctttgaaccgggcttagcctcgaaaaacctaattctgtagaaattgcttaaggttttacagggggcagggctgagagactccttcagaactcaagtcagtgagtgatgcctctagttcattcattattaaggcatcgaacaaatccattgaagtaaattccgatttcttatccttttaactacgtaaatcgggtaaaacttcttgatgttagagcttggttgaggtatggttctgttctgcttgtagattttaaataaacttggagccttttcttgaaagacagctggctgtggagagccttctaccaactgcagttttagatacgttttgaaaatttcatcacctgaggtatttttcttctctcctgaaacaccacatggtacaaatccacaaaagtcatgcttcagttgtccaagccatgggatctgtgtgctagccccacctccccgcaagtttcctgctcattggaataatgagctgaatgtgttttaagaagtggttggaagagtatgagagataggtatcattttctcaaaggaaatgattttgacattattgagagaaattagacattttaacaattgttttgtaaaacagtcttttcaaacttgcacgttggggttttaaacacaaccactttacatgtgttgcgctccgaaaagtggagggatttgttgaaacactactctgctgagacttagggttccagagcacttgggaatttagcatagcttggtccccaactctctttgaaacactttacttttatacttttatcttgctacatattgggccttttccaaagattgtatttctgtaactccttattttacaaatgagaaaattgaaaataaggagattctctattcttagatgctgcttttactgacttaatgctttctttaccaataaataatttgaagcacaaagtaacatttcctagtgttatagttttgttcttgttatgtgtaacttatatgtatctgattaaactttcagtcatgtaaggatgattacttttaacctggaagtttacagcagtaccacattattgaaactataatgaacttcctgcacatggcagttgcctaagacattttaatttgatatcataaaacatttttagatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaaagccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaaggaacttgttatctctgaaatactcacccatgagagctggattaattttttaagatgtaaatctatgctcatgtagaaataatataacaaggtgatattttgatgatcctctcaaatgattatctaactcttgcctgggcacctgactctgagtcagtatactcttgaatactttccatccttaatcaaatcaggagaaagagatggccatgtaagaaaattggccacggcagggttttataagagttaagcaagaagataaaacaacacatggccctgtgaaatatataaaccttggagaagaggagaaggtatagtgaggcaactgggtaaaagttgtgtcttcctctaagtaattttatgtcacaatatgtcctgtcttccatctcaaataacaaattttaaaattaagttgtgtttgttattttgctattagccaagatatataaattaactgacctgggattattagccatttgtatatgaaataaacttgggttaacctatatcaaaatcaaaagattgattatattctttacccttcactctttcaaatgtcttatgttctccatattacgtaacaattttatacttcattctgagtctccagaatatattctttgatgattttgacctttgaatgtcctggctatccatgtactacctagataatctcgttaccaggcttttcttttgctgaggcaggtcagagctagagaaagtaagcaattgagagaggcaagtttctgtatacctgtatctaaaatgtaatagactttataatttttgtaaggaactgaggaaaggtacaggcttttaatgtgtatcagtaaactagactcttatacagtttttataatattagagatgttttaagcttccttgagtaaatatgtgataaaggggggatcttgagtttttataattcttaatatgtttatttggaatccattgaccaagtgtatgtagtatccatatttaagatctggattaaaagcgattagtttctgtggctgatacgatttagaattaagatcttttgagactaaactacttctagatacagaagaacgtcatgaaagccgtactttcttggccatttatttgtgttaggctttaattttttgccataaccctctaaaatatgtgatgttatcttcattttataaataaggaaatacagggtcagagaacctaaataacgtgccaggatcagatctgggtagatataaaagtatttttcaagatattactgagtggatttttcccaattagatgaacctccttattaccaggaaccaaaatttcaaaagctaaacattaacacttacgattcatagattcctagagttaagcaagtccatgttagtttatgtaaagtcttccaatgcaagactaatgttttcttctaaaacattcagaaaagatttaagaaattaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttaagacgtaatagaagaaagagaaagttgagtatgagtagctttatttggctctgcaaagctggcaagatgtcaagggtttggagttaatgattaggtgggagtagatggttaaattgcggataaagagtaacagtaataaagcaaaggtgaatgttcaggctagaatgatcagtcagtaaggaaggacaagggttggtattttgaagaggagttacagtttatggttagaaatgagcaggaagatatcattgctacaggaaaggatgcaaaagagtaaggaaactaaatcattctgattaactcagttattaccattttttaaaaatggagtctttataaaaggcgttaaggctttatatgtgagttctaggttaagtctgaaaaattgtcttggaatagtgtgggtcttactactgcagacccaaaccaagatattagcattccaactggtctctttcctgctagcatcttgtactgcatctcctccctgattctataaaccatcaaaattctttctaaactatggtttttcattatatcatttctctcagtatacttcagtgactcccatttacctctggaataaagttcagaattcttggtttggcttttgacactttccatgattggacctcaagacattagtctgttataaccaaactagtacacttgctatctctggaacacgctcttttctctccatggatctttgctcatgctagtgtgcagtctggaatttgtgtctttccttctccagctttggttttctcttttagcaaagctcatttctaatatttcttcttccacaaagtcatctctgacccccagagtgtttaatctctcctttctctgtacttaaagcaatgtctgtgtattatttctatcatatgttttttttttttttgttttgttttgtttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatcatatgttttacctttagatatttgtgtctaaattataattgcattcagttaattctaaagggaaaaataaatttttactttacacaaaggctagcggctagcacagtgctttatggatagtagacattcagatatttggtaagtattaagcaaaatctacctggagtgaaagtgattgttgtaggaggaggtagtagaagtagttacaagctttatcgtagcagacgtttctgactctcttcctgaatgttattttttctgaacctggatatttaagtgtgaagattatacaaatctgaagtgtggcagtgttcttatattgatgtagaagactaggttgactgatcctggacctacaagcttcattttaacttcctacattttggctttgagggttaacaggacatttataatcacatatctcttttcagagtattttacatttgcaaatattatcatgaactttgtgtccttttaaccagagaggaattgtggaatcacaggaattagatgatgtgttaaagaagagagataactatcagctgatttaatttgaacccaacaagtatctaataatatgcatactctgtgttcaaataaacctctaagctagactttcaagcttatcaaaatgctagactattttcagtgtttagaaaataccagccaggtgtggtggcttatgcctgtaatcccagcactttgggaggctgaggcaggtgaatcacaaggtcaggagatggagaccatcctggccaacatggtgaaactttgtctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaacgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttccacaagccatacacacttttttcttatggcttaaaattttattcatgtttactactttgcaacccactgatataaattatttcacagatcctttattcaaatgaaattctcagtgagtctgagaagatagtcttaaacacaagctagctgagtttacaatagagattatactataaatggtaacttcaatgtttattgaaaataaattccttaaaaacaggtcttgtttcattcatttaaagagattatcaatatatgactgttaaatttttatagtctccctgttcattttctgatgaacacatgacagaaaattgaatgtgagctggaaatacagcagactatgagaaagcatgggtcatgtataatcactttaaatttaggctggtgttttgtattcatctataatatgaccacctcagggagggatgtaagtaaacattctttttttagttatactttaggtggcttaattattttaaagaatatgttattcaagaattgtctattgtactgttttaaagaataagaatataattcattaccaactttgaatgtcttggattcttagtactacctttttctttatcatgactagtaggatcacatcataatttggtactgtgtgtataaagatgaagtgtgcttacctttattaccaaaattcagaaatgaaaatgtgaatgataaaagataagggatggctatatatttttttgtttttgtttttccaaacagaatctcataacttaccaggctttagaaaaacatctttgcagtatgccatcatacctcagaatgttaagtagataggaaataaaattttcactttttgtaaagcagtagggtattatcctttctgacagcctgtaagactgttttggttgccaaggggccaatcttagaagtggcagtttttgttttgtgaccaacccacagcttaccctttgttagtccatatctgtcatcttcattttctctttctgcgtaaatgcttcttgatacagtaagcaggtgtttcaactagtcagccatctagtgtgatcttttctggtttgctacagtcagtaaaataagtagctctataagtgtaaatagtattacttgttttatgtagtaaaactccaagattaagttagagatatttttggctagactacattgaatgcattgacaatggatttcccagctcccagaaattcgtttgtgtctgaattactttatacttggcttcttgtgtagagaaaactttagaaaaagttcatccatccatgaatgttgaatgaatgagcagattaataaataaatagctcagggaaagaaaatgtgtgggcttttagtcataactatgttttttctcttttgttcccttccttatgtgccatttttcaataatgggagtgtgtatctaatgatgttgataaactgtttaaagtcattgatgaacagtaatctgaaaatcaagttttgattaagccgtagatttcttttagggtccaatattttctttttagaaatccactatgatatttttgtagggataaaagacaaccatgtattctatagatggaaaatggtaggatacagtttgttggccggccaacttctctgaaaatactttttcctgcatagaagataatcagtgttgacaagggagaagccaaggtataatggctgttattcatctgtctcatgtattcgtcaagtgtcatgtgttaaatatgaacaaaaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacatacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaaggaagagaaaaaaggatggattggatcaggaagtcagttattgttttctgggttagtttgagtccaaatcctcaaatatgcggcgatttataagtagcaaactaggaatttaatccacttcagttttggataacttggataagacactttctgtctatagatctgtctatagataacttggataagacaagttatccaaaactgataaatctgaattagttaacagatgaggcaaattgagattgtaaatgctaaaagattattagaaaactttataaactaaatagttctatgccatgtctttttagtattttgcttgtactataattgtagtgaaaataggtcagtatctaatttttatagtcactagagctctccaactaaatttagcttagatgtttttctagcaattatatacttacaaagtttacttttaaaaattgtgtaatacatgcctttatagaaatttaagaaaacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaactttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaatcatagtaatcttttaaaattgctttataattcacatagcgtaacattcacccatttaaagtttacagttcagtagtctttagtatattcagacttatgcaacgattaacacaatttaattttagaacattttcatcacctccaaaagataccctgtactcattagcagtcactccccattcaccagtctcccagcccttatcaaccattaatccattttctgtctatagatttgtctagtttaggtattttatataaatggaatacaggtaactttttattagtgatttttcacttacatgtgtcttgcatgtctcatgagatagctatgaataagttagccttcttttacaacttaaataacaattcttgtctgaccgggaaaaagtattaagttattgagagactgcatcccaatttaaaccaagaaccagactccttactagtattataactcaaaagaatgtgtaccattagcccttacctctggtggtgcttttcactgtgaattgttcagcagcctctcaacttcccgaaaataccacttaagtcttaaactcagacttgcatgagtttactgagatatgtttacctttgcagctggcttgcctagagtctaccttcttactaccctactaagtccagaatgaggaagaattaaaagcaagaaaggagatacagaagaagagattgctcaggctgaggaggggcaaagtgataagagcaggattagaaagagacattaaaaattcaaggatactgagtttgttggcatcagaataaatcttggaggctgttttaagagagaataaaacctagagggaaggaataaaaggcaaagatgttataaaacataggtaaaatatttaaaatattttgtcctgaattttgaattttaggcatatgtcagtgaagcacaaaggatagcccccttttttgatgagctttagtatccttaagatattttctttctagaaccttgtgtaggaattttacagctgaccataatcatgtgttctctttggtttgttccaacatctttggattggaaccagtacagagtaggaaacccatatcaccttgggattatttttcagataaatcttccagaggattaaatggcaccatccccgtcaggtccaagtaggaggggaagaatcctattttgggtgctgtcagattcagtgggctgtttagttcactttttatccagaaaatggagctaaatgagaaattgcagcttccaaagaaaatcataccttgattttatagatcaaagcctttctgattagatcagaattgttcctgagattttaggggcattcagttaaagtgccccaagaagagtgataaatcacatataggtgtaaagtcaataaagtcctatagtaagcagactggaatttagggggaggggaatacacactgttagactgttggtacctatatttgactactaggatgattatatattttaaattctgtattcagtttcttatcagaaatactgcctacaatatcttatacttaattttttaaggaacaggtgataaagataggttatattttcttcagaataattgatattcattatttaatagataaaatgtgttatctgaatgtttatagtagtagaaaccaagtttacaaaatgtctatatataatttgtttttaataaccaaggattctttctttacaaaagatttcctctatataaatcttcctgttttatagatgatctgtattataggagaaatgagtatttgttgatttaactggctaatctacaggactgagcattattagaggagtatttaaacatagaagtctgtgaaaatatttttagtgctgagggaaattggagggactttctagaaccgcaaactaatagaaaaccaggcatagtggctcaagcctgtaatcccagcattttgggaagccgaggcgggaggattgctgaagccctggagtttgagaccagccagggcaacacagtgataccttgtctctacaaaaaaatttttaaaattagctggacgtggtggcacatctatactcccagctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttaatgcaataaatgttaaactttactactaccttagccatgttgcagggaattgacatgaatagttcctgggttttggctgggtgcggtggctcacgcctgtaatcctagcactttgggaggcttaggtgggcagatcaggagttcaagaccagcccggccaacatggcgaaaccctatctctaataaaaaacttaaaaattagccgaacgtggtggtgcacgcctgtagtcccatctactcaggaggccgaggcaggagaattgcttgaacctgggaggtggaggttgcagtaagccaagatggcaccactgctcctagcctgggtgacagagggagactccgtctcaaaaaaaaaagttcctgggcttcaagggcactctaatgtgcacatcttaaattcttagagcctacttctatggacgatttatgttactgttgatggagaatttgattttcttttttatcttcccctttcccttggcctttgtaggttttttgaagtgaacatacttttatgtatttacttatttattgagcagttcccaaatggcaactttattattttatttcttcaactcagttgtctagtttacttcatttgtatctaatctatttaactcatcctttgagtttttaatatcaacattttaaattttatttttttagcttcaaaggtgtgcatatgcttgttacatggatatagcatgtataatggtggaggttgggcttctagtgtacccatcacccaaatactgaaggttggacccaataggtagtttttcaaccctcaccctctcccacccaattgtttttatttctgaaagtaatatttctttcttggtctgcctgataatttttttatagtttcttatttttcgttagttttcaaaaaataccttgttgggcattttgtccatagatgtactatcttatgtttgctaattccaatatcggaagtccttaggaagttgtacttaaggtagtttgtttctttctgtatttggtgattttttttatgagctaatatttgattaaaccgaatatttctccatcctctgtatagttgcctacaatgtaatttctacttttttttttttagcataaaagagtttcattttcctttttatactcaataacttgtttaattagccagtatttttaccagtttctttacttattgttccttgcatcttctctgagtccacttttcttcttgctgaagtacatcctttagtaatccttttagtaagaggctggcttgtaaatgtccttagtttttgtgtgaaagtatattttatgcattactttgtttttcagctagatagggaattcttggttgataggtttcctcccatcagcaacctcagtatattatttcattgtcttgtgaaacttggcaaacttggatctctgagaagttcgatctctgcctaattgttatgcttctgtatataattttttttttctggtagttttttaaaagatttcttttctttattctgtcaccactacttactgtgtgaccttgggcaagttcaaaatggatataaaattgtatctgtgtcatagggttgtaatgaggattaagttttaaagcacttagaacagagccttgcatattataactgtgacatgttaatatttgttttattttgccatacttgatattctaaacacatttctatgatatgcttaagtatgttgttttatccatagctcctctttgaaatacattgttgatgggaagattcatatctttctttgtttctagaaaattccttagccttcatatctttgaatattcattttccaatattccttcttagtctctgtattatgttctaggtggttcctcagtatcattttctaatttactaattcacactttgactttgtccagctagagtttatgtggcctcagttccagtgaattttttttaaatattcaggctgtctctctaatagccacctattctggtttgatttctgcctatttttaatttttcttcctttaatgactattgtggcttccttttaacatttgaaattattttcagattgtcattttttcttctagaatgaattacagttgttgattttattggctgtccatcttagtttagttttctttgtgtgttttgagtttgcttttgcagtctcctattgactggaagtttttgttgtgttttctttttcactcttcttatccagtgtttttacatgcacctacatctctgtctaaaaccacatctttatattggaggcttgattcccttgattcttggtaacatcaggatcaggcttctctttccaagaataagacacaaactaagatctatatttcttctcactggacacataatttcatctaaaccgtagccccatgcaatggttagtagtagctttttctggctcctttcattggttggaagagcctctccaccctaggtattggtttcaagcagtgagcctgagttctatcccagccatgcatgggtacctttttagtccctgttactatccctacaggatgtggacttttggccatctctgttacttgagcccagaaggctcacagttttagcttcaaaaactgctttgtatttaaagagttcagtggcttggtcttttttaatattttgtttgtatagttaataaatatttaacatacattaaaatgtttggaacagatacatttcaaaagtgaatatacaaatccatttggttggaagttagtccattttgtgttgctatcacagaatatcacagactgggtaatttattaataatagaagtttatatagctcttggttctgagggtggtaagtctaagattgaggggctgcgtctggtgagggccttcttgccagatggaaggcaggaatgcaagagagcacaagtgcaaacaagggcaagacggggccagactcgattttaccaggaactcactcctaagataagggcattactcaattcatgagggcagagccttcatcacccagttactttttatggactcattggttattactgtcacaatgacaattcaatttcaacatgagttttggaggtgacattcaaatcatagcagaagtcaatgtttaaaatcaatgtatatcctacatacccttcagaaagatactagttgactctcctacttatgagaggtatatttttttattcctttgccaatattgggtgtaataattttttaatctttgagaaggtaatgtataaaaaacaaatttgtgtttaatagctagcaggattggtcattgctccatatatttattacccatttatattcttttatttatttaattgcctgttcacattcattgcccatttcttttcctttaaggtgttcatttttattgtcttttaaaatagctgtttgtatattgtagtaatgttaacttttgtgtatatattgcagatgcttaaaagacgtttgcttttcaggttaatgagctttattttatagtgtaggagtttcttttctctggagtcactttttcttattcctttggaatcagtcttttcttgtcatccttagaaagtcctttcctaccataagattacagaaatatttgcatacatctactggtattgttttattattaatacttcagacttcaatctttaatctcttggtatttattttaaggtgtgatgttgaagggattcagctacccaccactggagggcaggagtggaaaagatcagctttcaggcacccattattgaatctctctgttcccagagagctctttctggattctcagttctattccactgataaatttattcctgcattagtattgcctcttaaatactataatttggaatcaagtttaaatatcaggtattgcagattctcatgattttaagaatgttttggctattcacatttattcatatatattttgaaatgatttaatcaaggtctgggaacaaaaaggtccagttgtgattatattgaatttatagattaaataaagggaggataaccatcttcacaattttgaatcttcctatccaagaaaaagaagtgtgtgttattctgaagccctcttcttaaaaaggttctatttcttgttatttatttagatatacttttatttctgttttaactttctaagtgattactgttaatcattttcatatatggttttctatagtcaaataatcttattgagtatttttttccctatcatttcaggttttgagtttgccatcatgtcattaactgcaaatagttgatctccttataattttatgcctctttttgttagccttggcttatctcaataaccattatttctacacattgctgagttacagggataagagttggtgtccttgttcttttttctttcctgggaattgttctagtactgagatttcctctttggcttgaagtaagtattatattaaggaataaattttatcaaatccctttcagaatatgatgagatgatcatatggattgtttttaacttttaaaaagatgacttacattagtcagctgcctaatgttggctcattgttacgttcctaaaatgatccctatttggtgatttgtaatatatattttactgactttttggcatctgtattaataagtatgtttggactatagttttatttttttagtgctgtctttgtcaaattttatagaaggattatgataggtttgtaaaaagaattggaaatttttttcctgtaatctatagataacttaggtaatttgagagttacatgtttccttagggcttgaaggatcttgttttgaaatagtcttgcctgatgcacttttatttttaatagcttattttgagaacaatccaaatttaaaatttgcaaaaataatacagtgaacttccatatttatttaaatggccaattgttaacatttttccacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactgttactttcctccatattttcaaatttattaacagagaattgtacagagtgatttattttacaacaataaaattctatttgtgaggtgagtatagcctgtttggcttctaattttaaataatttttttagttagactatttagtggcttacctattttatttttttcacatataacatgtactataattttacgtaatatattccttcagcttttattttattttgtatgtgtgtgtggttcatttttctttttaggttgaatatttagtatactgattttctttagtatactggtttttttaactaagtgtgaatttttttttttctattttcaacacactattgctggcttaaaggtgaggtttcttaataaggtttggtcacatctcagaatttgataggagatttttctcattattgtttctaaatattctataattgtagaaatatgtaaactcaatgcaaaaaactggtgtaggagcttactttttaagcaatttccacgtttgaggttttcttctttctttacacattatcaatatctactattaatgtataattcagatgtgtcatttcattatttcattttcttttttttttttttggtctgtggggtaggatgggggagtgtgttagaaatctataagcttttctttccaacatataatccaataattatttgatttttcaattaatgttttaagtgtgtttgaacagaatatatagtcttgaaattttggaccacatcttttaccaatttaaaacatggctcttattctgtttattgctttattccttgtgatttactttgtctgaaattgaaattgcaattcttggtatcttttttgcctagtgtatttcgaccacaacaaagtacttttatactgacatctttatttttgagtttcttggttttgattagtctcttgattgcatgaatctatctttaaatagtttattttttcagaaatgaaacatggataacactactttagtgctggcatatttgatcatgtcttcttcatgtcttcttattgcgtttacatataaatgacaaccttgctggtcgtagtattcttggaataaaacctctttatcctcaacgtttataggcattacttcgttgcctatcatctgatgttgcaaagaagtctgggaccagcctgatttcttttttctttttcttttttggcatgtttattttattttttttatttgagacagtcttgctctgtcacccaggctggagtgcaatggtgcgatctaggctcactgcagcctccgcctcctgggttcaagtgattctcctacctcaacctcccgagtagctgggattacaggcgtgcgttattatgcccggctaatttttatatttttagtagagatggggttttgtcatgttggccaggctgatctcaaactcctgacctcaggtgatcctcctgccttggcctcccaaagtgctgggattataggcgtgagccatcgtgcccagccgatggcatgtttattttgtctgaattgtattcttaaaatttgtaatcttcaaattatgcttcggtattggtcagtttctactaaatgtatctagtacttgataaacgccattcaatcaccaagttcagtctttagtttatgatttatttcttctgcctttgaaatttaatttttcttccattatttggttttcttatttacaatgtgctaattgagctgttggatctgcattgtttgtatcttttctcaagtctacttgtttttgtttctttatgcttacttgcatactggatgatttttgtcctgttcgtttttaccccttgcagattgtttgctgtagtgtcttcattcctcattattgcttttcatgacatttaaaatattgcaatgatattttttctctgaaatatctttttttaaaagctctgttgatactttttatattctggtttcttttcatccctgtttcacaaattaggttttttaaaattttcttatatgtaagttgtcacctagttttctaaggtaaatcttttagactgtgacatcatgttcttgagtacttttttagttacttttttatttcagaatttttgtatgggttctataaatttttttctgcttttttacttaaagggtggcagttttctctgttgtttgcccaaaaataactagctactccttgcctgttctgtcattatactaggataccattacctctttcccccttggaatttaacaggctgaattatattaaattattttagttatcatatttcattatttttgagagaaatgatagggattttgtcctattaacctgttacaggtaagaaactttgtctttcttgatttttctcttgatgcttgttgaaattactgattattttagttatcatatttcattatttttgagagaaatgatagggattttgtcctattaacctgttacaggtaagaaactttgtctttcttgatttgtctcttgatgcttgttgaaattactgcacattttcatctttacaagtttggcagattttctttcccaacagaagaacttgactattgggcattctgctaatttccatggctgctataacaaattatcacgaacttggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactccaatctttaagaccagcgtcttcaaatctgtgtctgctctgtcttcacatcaccttctctgtgtgtgtcagatcttcccctgactctctattctaaggacatgtgggttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaaaattggattagagtaaagcctcatagattgtgctgtttgttagaatcacagatactgtcctctttaccgaatgatgcaaactctgatgccatggtggaaaagtatatgaattgaattggatgtggtcaataaggattgctagggactcgagaatgcatgttgttctagggagaggaaatacgtgaaggtcaaattcaggttatcaggttatcagtttgtaacctagtttgtagctgcttttttcttttcatttcttacaagctggtcttgctgtagtaaaataattttgtgtgtctcttataatcttgatattgagaataagaggttttttttttaatgggaattccatccacatgattttaaagtattactttactaatgatatttacctaggtattcctagaactttagtcttctcatgtaacattttatacatttctcagaacaaggtaattgacaaataatcaaggttgcttatttattgatgaggaaagttagacattaagccaaaggacttgtccagtatcgcatattggatagacctataatttttaactttaatcttgtggtgacaggtatttccatttttttttttttttgatgtttcatatgtgctttgatgttgatgtgtcatgtgacatgaagtgtctccctattgttggataattgggcaagtctaagttctttttactttatattcctgattttgtttttctagatgtgttatttttacagattcaggttacttctttttttaaatcatgttattagagttaaactaatgaaaaatcatatagagatgaacttggttttgaaatataatgagtagatacttgcttggctggaattttttctcacaagttttttataaagatggtatgagtgtatactttgtatccaggaatgtgtgtacactagggggagtgttggggggatgagggtggaagacattttaagacacacaggaggctggtgtggtggctcatgcctgtaatttcagcactttgagaggccaaggcaggggaatcacttgaggtcaggagtttgagaccagcgtagccaacatgatgaatccccatctctactaaaaataacaaaaaattaactgggcgtggtggcacatgcctgtaatcccaggtacttgggaggctgaggcacagaatcacttgaagccgggagccaagatcatgccgccacatcccagcctgggcgacagagtgagactctgtctcaaaaaaaaaaaaaaaaaaaaaaaaagacacagaagaccctaagtgtacactcagatgctctttatatccatatccattatcagtttggtgatacgttattctagtttcatgaacctttactcttagaacttggtttattctctaatatcttttggattcagttttgcagttgagatggctaatatcaatttgatactctttccttttatgattgctcatgtttttgtctagaaccttgcattatagtatttttttttcttttccttgcatttctatagttgtgaacaactaggagtgggtttttagcaattaattcagtgagcttgttaattttgaaaaggcttcaactgaggaacactttcttctcatttctttgatgatagcttctctgtttctccttcagaaagtcttgttttttatatgcatatttactttttgggtgcactctccttgttaatgagttatttgcatctgattttgagtttattcagcaaatatttattaatgatttactgtatactctgtgcttggggagttgacctagggaactcaaaggaggctcctttgaagaattgatgcttgagctgagatctcaggaatgagtaggaattatctaagacatgagagaacagctgttaaggtagggaaagtagcatttgtttatatatttggaggaaggaagtatgatgagtactaggtactgtaagaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagagttacttaggctgcagtttggagaatgaattagagggatgccaggatccacgtgaagagactaaagacgctagtattctgcagtgagaatgatggtaacttgagaccagggcattggtagaaaaaagtggacagatttgagaatgcttaggaagcatataacccatgggatttgatgatggactgatgggagatgaggtagagagaggtatcaaagatatccttagtttctgtttctttttctgagttggggtcttgctatattgcctaggctggtcttgaactcctggattcaagcaatcttaccgccccagcctccaagcagttgggactacaagtatgcaacaccgcacccagtgaatgttcttggtttgtattcaccttggtgggtgatggtgccattcactggtaaaagctgcagatatgtgagggtgctcagggaggcagcatagaatgggaaaagggcctacatgtaacccttgaggaatgccaatgtttaatggcttgggagatgaaaatgagcctgcagaggagacgacggaaaagcttaggggtaggaagaaagctgggagtgtgtgtgtagcatcttgaaaggccaatgggaagagtgtttctggagggagtgttatagttgaatgcttctgtgagcagtcaattagaggagggctaaaaatgtcccttagattaagtgacttggaggaacttgatttagtaaaatggccagacagccttttggagcatcaacattttttttaagaagtttaactgtaaagagaagagaggcacatgggtagctcgaggggaataagtcacatgaaaagttatttttaatgggtaacatgggtgacacttgtggctttaaaagtcacactccaactgagaaatgttgataaaaaggagaaaaaggaaaatagtgtaacattcctgaaaaaactgtcatttaagactcctttgaaacatgggcaccaaagctagtctagtagaggatttattatcagtgagaggacagagtcctattacagcagaaaagtaggaggagagggttatgaaagaattcattgaaatggttcactcatggccgggcgcggtggctcacgcttgtaatcccagcactttgggaggccgaggcgggcggatcacgaggtcaggagatcgagaccatctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattgcgccactgcactccagcctgggccacagagcgagactccgtctcaaaaaaaaaaaaaaaaaaaggaaaaaaaggaaatggttcactcatttattgatcttttttttctgtagtatccaatctgccattcattgtctctattgcaattttcagttcagtaaattgcttctcatttccatgaaactattttcagagtacctcttttttaattgacagtctgcaattgttttattcattcaatgtcatttcatatcttggttagtttctaattttgagctaatgaatactgagtctccctctttttaacttctgaattaaaaaaaaagtcatcttatttttctctgttcatttttacactttatttagcctaagtatctgaaattggctttgctagaaattacaattagttcactgttgttttctttcagtcccagacaaaaaagaaaaattttagatttctttcttttctcttcttcctttttttttttttttaaggtcatttatctttggcagttttggagatttagaaaagaaaatatatagacttgtaggcagaagaagatatggcactgagggaagttttagttttgttctgtgacagtcttccttatcttgtatgttgtctttaaaaagcctacacatttagattttcattacctcatttgcaaggatacaggatagcacatgtaggagaattggagtgtaagtccagaaacctaagtcttattcttagccttactgatgaaccagctttgtaaccttgggcaagttattctgtttctctgcaccttctcatttgtaaaataggtttacacaaatcatttctgcattttggctctgattcattatgcaagttatcaaaatcaaatttgtaactataaatgagtaatattttattatttttatttttttagagacagagtcttactctattgcccaggctggagtgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccatacatatgtaagcattagtgagcaatgtagaatataaagatttggtagcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcagtgttcttttgttatatgagtaagaataactctggtatttgctaagagaatataattttctccacattgtatgtatctatgtcctttgtttataaagcctggggggcgttccctattaggttaagtgtccctaggtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactctactatgagttcacctttgcttaataaaaggcaagactgaacattaattaatgacttcttggcccagccttagaatttttcagtttagggattagtttggtttttaaaaggtacaaaatgttcatgaaattttctgattatatcaaatattaattcagtcttgttttttgtcatagtactttgttttgaaaagttcagatcaactgataatactagtgctgtgatgagactcagcttgtactcaagaacagatttatgactaggtgagaactaaaatttctctcagaaactaactaaaaactttcatggacaaattgaatccccttgggatttactatttatggatatacgccaatttaattattggactaaataaaatactctttattagtccacttatggaagatgactgtgtaaacatagtatttgcaagtaagtactttttggtattatatttatataatcagctcttgtatccatgtagcttatagttggctgcttcaccaggactctacaaattgctcagaacccaaggaggtaagatttttatattgcctgttttcagtatgtaaaagtccagccacaaaactattacccttgactatatttttacagttgctgtggagctgaacctaaaattttgttagatggttacttggtttgttacatttttatatactaatttatatactataataatatactgtatatattttttaaagtctggggtttgtttttagaaagtatattctatcttcaaagaattatttggtagtttcatgtgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcagccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagatagaagtgaatcttagttaagttttaagataatcctatgtgcttttaaaagatttcatggtttgcggtttgcttttctttggctcccagtttctttttttttttttttgacttcttagtacaggtaacttttgaaggaattcagcttaccttagatgaaccaaaggaaagctaaaagccgagataatttagaaaaactaaagcagagattatgttcctaaattccctctttctgcttcaaagtccaggaaacaccacctgcagatacagttgtatcccattgttagaccctttcctgaagccatcctcttttctttgtcttcccagagagaaactagtcattcgacaaagattgaacttcttctgtgtgttaggctgtgctccaagtgctgggaagacaccagtgaataaaacaaaaagtccctgctctcatggagtttacagccactattctaaagtttgtctgtattctgcctgtccttgtttttatacttttagcaaatatgtgtatagaattgttttgcagccttgttcagcatattgtcttcttttgttttttaggaatatctgtttatgtaattagatctgtttttgataaattgtattctgttatttatccttcctaccttctaatgagcagttaggttatttccaacattgactattatggttctccaaaaagatcattgaatatgtcaccttggatggatggatgggagagtttcttcaagacagcatgtttcagactttttgttgtgaccacagtaagaattatgtgcacctcagcttagtaaatacaaatatacacttgggacaaaaacttcaagaaacagtatttacttacttttatcacctgggatgcactctattttgttctgttttgttttcttgagacgttgtttcgctcttgctgcccgggctagagtgcaatggcatgatcttggctcactgcaacctccacctcccaggttcaaacaattctcctgcctcagcctcctgagtagttgggattacaggcgccagccaccacacccggctaattttttgtattaatagagacagggtttcaccatgttggccagtctggtctcgaactcctgacctcaattaatccacccacctcagcctcccaaagtgctgagattacaggcgtgagccactgcgctcggcctattttatctttttcaaatgcagtttacacacaacccagctgattgggttgtgtgtaacccatactgattaaactgatttatcacccgtgttcattatttttaaaacgttgttttgagatctataattagaagtggaattgctgagtagttgcttaagtgtatcttcaacttcttcaactagctgttgccagttgcaattcagagtggttgaaccaatttaaactcctatcggcactctaggggagttcctgtttctccacattctgaccaactcttgatattgccagatggatgagaaatggcatttgttttaaatgtgccttcccctatttactaatgaagtgtttaaagtgtcttttaaaatatatcacatagaagtttaatttaatggtaatcagagctggcggcaaggaggaaatattattgtgattgactgcctcctctggcagaaaaaatggtgtaaaaattatataataatatctatattatattgagtatttataatttgctagacactatactttgtgcactgtatacattattttatttaatcgtcataagaatcttgtaaggttagtgccttcttatatacttttttttttgagacggagtctcgctctgtcgcccaggctggagtgcagtgatgtgatctcagcttggctcagtgcaacctctgcctccaggttcaagccattcttctgcctcagcctcccaagtagccgggattacgggcatgcgccaccatgcctggctaatttttgtatttttagtagagacggggtttcaccatattggccaggctggtctagaactcctgacctcatgatccacccacctcggcctcctaaagtgctgggattacaggcgtgagccaccacacctggctgccttcttatatgcttatacaggaacagatggagaaagagattcggaaaggttcagtagtcacactattactaagtagtagagccagaatttaaacccacattggtctaatttcataacttattttctttagtacttcatgctattggtgaattcgtagaggaaggaagtttgtcattactattcttttctgttggtttgtctcttaaatgtgtttaattttttgagtttcactcacgtctctttttttctttccttttctcaaggtagtggagtctttcctctgtaaaacttcaccttgttgtttctagtctaggatagtggtcttgtaacctaggatagtggtcttggttactgcaattttggttgattatttcttgttggcccttaatgtgcccccatcttctgccttaggcattccatctaatcttttccagcagtttgcaaccttactgtgcctcagaatcacatatgaaaatttaaaaatcatagatacctaggttccaaccctaccctggaaattctgatttggaaatatttatttttcaaaaagtccacagataattctgttgcacagccatggtagagacccattttcttaggggttaatgatgctttagagtcacgcagacttgaatcagagccctgattcctttaaacttattagttgagtgatcttggccaagttctttaatcttggctaaggttcttcatctataaattggagataatattattatctaccttagagagttgttgaagagattaaatgaagtaatgcttgtaaaacacttaccagagggacttagaatacttcttaaacattgcctgctaataaggtgtcattattacgttatcctttatccaatcaaaatactcacctttgcagtgtgtatcaacttgatgtcagaaaaataatctgataaatatcaccataagggatggatgatagctagttttcattacttacctttcgttagttgaactgtactaggaggcagaggagtaggcagatggttttatcacgccaatcagccagtcttttctgcctatgtatcagtttggacctataaggaaaatgaaggggaaaacaaatgtttttctttccttcctaggaggattttcttcttgccctttttctcccagtttcctctctgagctgagtatcattagcatcatcaataccctagtttcagagctgcgtagtgatttacctagatacttttctccaccattattccctactacctaactcctcttcacctccattaaatctctgttcatcatgctatccttcttttggattgcctttagttcagttgtgacttacttgattacttgaacccaggtgtctacatttctaagctattgttcaagtaagggccaaggtaaattctaaccagctgtctctttgccttgtgtgggcccattctagaccagcgggtgttaacttttgagtattggaaaaggattagattagctgagccttcaggcttgtcagcagggctgtcactagaccctttgatcttctttatatacctaatggtcatagagtataataataatggtacatgttattactatatgattaatagattactagtagtaattttgttatatatgtatacagtacacttcgttatgtatatatataattgcttgcaacttgaaatttgaggctacaacatttacagtaatttaataacttaactgactttatcaaaaactgaaaaacctcatggaaaaggtagaatgtaaggtagacttaaaaggataggtatacttttttctataaataggatgaggcaagagtttccagttaaggaaactgacatgagcaaaggcttgaaggagcatgcaaatttggagcattgtgagtagattattttttagtttttcagagttcatgcagtgggaataaaactagggagtttggaatcaagcttgaaaattcctgaatgttcaaccaagatatatttgagttagtagattttttgggtatgtcatgaattcgtttggcttttcttaattgatatacatacaacttagtcctgagcttacacatgttcattgtatcattaaacatttagcctggttggtttaagttgatggccactgccaggtctcctttctgccttctcccctttatcccaatgctttagtttttttctgcctttttgtctgttgtgatctgtgcttcatcaggctttcccccagttcctccttgttaatctccagattccaagtcagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatttttttttaaacaaatgttgactttttaaaattcttctgagggtatatatttgatactcaaatatttaattatagcatttgaatacttagatgtctttaaaaatgaatgtagttcctaaaagttgtcagtttttaaaattaatacaagttaaaagctggtttataaaccttaggtagttttacctcttatttcatatttctacttatgaagcgaatgtattagccccacaatttataatttattttaaatgtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaatctgagatccttgctttttgttcagatttaagactgtttttttttttaaggcaaaaaataatagatggtaaaaatttggcctttattctaaaaggacagtttgaaccatttaaagaaatattatgggtagccatgtctttaaaaattttgaggcctgatcaaaggacgaatctttatacacattgttattttcaaaggtatttacaaattgagaagcagaatgatgatttcttgccccactaatgacaaataaaataccatttcttaccataaacattgaaaaacaaactgaacaaaacttgaccatataacttacaaatacttttgacttgaatttgcatgtggagtatgtgtgctaaaactgcaagtgaagactttttatacttagaggaatagttgtagagttctttgtaaggttctttgttcataattttttatattttgtgatgtgaataatagtatgcatctgcatgacaacactgcagatcatattgctgtgcccttttaataactggatattttaaaattattttaaatgcagttgtatggtttatcaaatggttctctttttaaacattttataaggaaatttagaccttttctattcaaggctttgttgaagtaatcagtgaaggaaatggtattatatatctatacagtatattgtttaaaggtactttagagaagaattaaactgagacagtgatgttcaagtacataatctgtgcatgctatttaagtatcattttgcaaatataaatatatacataaaaataattgagttagtatataatctataaattcccctataattaagggttgttattttcaaatcttgaaattgtttattttttaaaattccacgcagtgtattatatagggcaaagttcaggaaacatgtttccagtctaaagagaggagtgatgtaagaagaaactagttgacatcttaagaaagggtattctcacttgtgcacacatatccttgattatataatatgctgatttaacatgaaatattttttcacattttaattttgatttgaagttaatcttatatgtcattttgtgcattttttgtcataaatcttcaaaggtcaacctgattttttttttttttaaatgataccagattagaaaaatctcagatgtggtaaatgccatctttaaaaagctaggttatctttgtttcggttttcttttcaattaaatttggataacacttacaaaaaaagtacttctgattcccagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatccctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgcaaatacctttagcttgaatttggatatagagtaaatgtgctaaaactacaagtgaagacttcttgtacttacagtgaagatatattattgactaattttctcgattctctactgtgttttgcaagtgtgaccatgttctttgtaatcactaaatagtgattgtaaaagctcctgtttgaagcttttattttttggaaactttttttttccatatgactttctatgaaacgatctataaaattgcttcaagtcaattttggaagtagggagactataacttataaatatactacagatttttaataaagtgttactcaaaactaattcctagacttgtcatggaaatgtcttatttgacatttcagttttaatagaacttttgaaaagggcattaagaaaagtagaagcttaaatataaagtataatctgagacttcaaaactacgatgcaactcaactagcttatgttagtattatatcttaagaatggcattgccattgatgactcataaccatttaaaccaattcaaatggaagtagactatatagactttttttttaatctgtaatttttagccttctattaactgggttggtagagtgttataacacattttagagtagactcacctctgctttaacataggagcccaaatatcttaaaagtgaggctcactattgacagcaagaaatagaactaaaataatatctgagtataagattatcttagaaattttaataaacacctggctatgagttactaagcaatgttttgctttctgaagaattaattttctgcatttttttacacttaggaggaatgttattgaagccgtttacaatagactgaatccttacaaaaatgacgacactgtaagtagcattttagctccctctgctttcccttcccctccactctaaatgcatatccttcctacctgtttttgcagagctgttcactgtacccattctcttacacacacccctgattgattgctctgaactctgcttgctctgatctctgcctgcaccacagttctagtgattgaggacataatcatggtgagtggccacctctctcaaaaaagaagaaagtccttttgaattattctagattttttaagtctttacaaacaatcaacttcagaaggtttgcctccactacatggttttttttttttttttttcccgaagttgggactatctctactcagaatattgtcttattctgagttttgtaagcagctgcagcagaacttcggaatgtctgtctcaactaaatagttcttatggttggaaatacctttgtcaggaatcctgaagtatatacttcacttaaatattagagaattgtttgcataaatagacattagaatgccatactctccagttaagtgttctgttgcaattctgttgtatgatgtttatagaaaagtgataacttaaagatcatgtgggcacagctctgaaatattttatgtattgcattatgaagcttcctcacatattgagttcttaatcttttctgatgcattaaaggtttataaaagtggtattctaaaactgtattggatttcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagcttaaggaattgtagatataaaaataacctaatttaatttaggcttaaattcctctgattaagcatgtgaaagtaagttttaaaatctgtcgcattgaaaagattactgttccgtgcccttctgtatttttgtctctttaggttgaatattgtatttatcaccatgtaatcattcagtaggcagattcccactagaaaactgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagaca

SEQ ID NO: 12854 - DNA, 8716 bp, Human
catgtacctacaaaaattaaaaaattaaaaaagataaagaacaaactaagctcaaagttagcagcaggaaggatataataacactttttgctctaaattttattatgatacttacgataaaacttagagcagaaataaataaaaatagagactagaaaaacaatagcaaaaaatcaatgaaacagagtttttttgaaagacacagaaaatttacaaacctctagatagactaagaaaaaaagaggaaacactcaaataaataaaatcgaagatgtgcttttctgctcctctcatgctgcttttgaaattcagatgcagccttctttaaatgatttgtattgtgttccacaaataatcttttgggacttctttctgaaacatgactttgtttccctgcggaacaaaggcaaggtagagtgacagggaaaagaagtgaggtagggaaggctattctgtgaagagtgattattgggcaatagagaggctccctaggttatgcaagagtcaaagggtaactggatcccagaggtgatagaagcacacttatcagagacagtgtctacttgtagggacaacagagtaaatctgcattctcatgggcactgtggcttgtcctggaagcatctcaggctggcatagtcatacctctaggagagttaatactctagaaagaggaacaagtctagaaataagatgatagaaatttccagagaatttgagaaaaagccaccatggatacaaagatacctctgagcacccttgctccaattttcgtttcttggtgagtctgcagtattatgcttcatattcatgcttcagtgctgccatctgaactctcactgctccagactgtttccagcatattttttcttctagatatttctactcttgctcatctttagagaggctgttgctttagtacaagttggcaaattttttaattttagggctttgtggacactatagtctctgtcacaactacacaactctgccactgtagcacaaaagcagccatatacaatagctaaacaaatgggcatggctgtgttccattaaaactttatttactgccggacgcattggctcacgcctgtaatcccagcactttgggaggccgaggcgggcggatcacgagttcaggagttcaagagcagcctggccaacatggtgaaaccccatttctgctaaaaacacaaaaattagccgggtgtggtggcgggcacctgtaatcccagctactcggggggctgaggcagataattgcttgaacccgggaggtggaggttgcagtgagccgagatcgtgccactgcactccagcctgggcgacagagtgagactctgtctcaaaaaaaaaaaaacagaaaacaaacaaacaaaaactttatttacaaaaattcagcagggtaaacttgacgtgtgggctgccatttgcagatgccctcttttaggtatactcccatccattccattggtttccattttactttctcatttctcaaccatgaacatgccattgttttcagttgctccatgtgttggcaagttccctaaaccccaacgaatagtaaggctcaggatcatttcggcgaatacaggttgagtttctgctataaaaacaaattgaatgctgaaacatggatgaatgtgggaggaaagagctacttggaagagtaactctcaaagctctctctcagagctctctctctggggagaaagaacagtggcggaaactcctgggtgaggaatccctgattcccaaacaactccaccccatgtccctggctgtcctcccctctgagtaatgcagacagccttttggggctgtgatgattctatctcctatgaagccatctgatgaaactctgatttcaccaaccactagcacccaggaagagcctggtgtgacataagctgaatggaataattttatgggttgaggggggactctttagaagcatctaactagcatattttggagaaaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaaggtgagggggttggccatatggggggccagcagcagctggctctctttgaacagtaagacattttcaagttcaagtgtacctcatgagagaaatttcttttcagattctgtgtgccaaggctgagaatgccaggctggtggtgaacattgacaatgccaagctggcctctgacgacttcagaagcaagtatgttgaacttcaaggtccctatggttctttcatggccctagggacctactattgcctggaagagaggagaaagccatttctctctatttctcctcctagggctggttatgtaaaattagtttcaaatagggaactagactcatgtgctgcctgctctttggtctatactggttttttttggaagtgtttcttaaaccacaaaattcagagattgaaatgaattgttctttgggaattgatttggtggtatattagctaacaaaaccgagaacacagtgagagacttcatctcatgtgtgcctgtgggctcctcgtggtgttaggtgagtcagggaacctcttcagcctatccatggacagcttgactgaagcatatggaagagaagaggcagaaaactgtaagttcaagaagattcaggccaattctacccaaacaacacatgagaggggaaggtggttttctttcctgacttatcctcccactccgacacgtgcaggtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggtatgaaacaaattcacaaaagcaggcctcagaactaagctactagcactgggaatcaggagaggattactgtctggatccctggtctgggacccttctctgaggaactcaagatgttctcagagagtgacggtgctacatccatatcaaggagtggagtgagctgctcattcttcagcggctgggtgagggttaggcaggtgttggaattactgaggagggacatcattcattgagccctgctctctgctgatcactgctaggtcctgaatttggtggtggagatggagggacaaaaaagaaataagacatggcccttttcttaaaagagctcacagtctagtatagaaagacagtcatataaacacagtgatataaacaagacagagtgaaacaagtaccatatgagatgtacaagcagtatgctctagaaataatccaggctgcccaagaggagatagggaactcttctcagatgcaaagaggaggattccagtacttgggtgtttcagtctgagggaagaggttgaacaaagacacagaagtggcagggcagggtgtatctgggtatggctgggcatgcagtacctccaagggatgaaagtgaagatgtgatgggaagcgaggaaggacttgcatatgccaaggagtttagacttagtcttgtagaaggtgtgaggttgtttccgtttctatgggacaacaattgacgtgatccctgttggagtttattgctataaaatgtgtgtgtcactctttgggaatgatcagaatcttccttttagtgcttttttttttttgacggagtcatgctctgtcaccaggctggagtgcagtggcgtgatctaggctcactgtaacatccgactccctggttcaagtgattcacttgcctcagcctcctgagtagctgggattacaggcacatgccaccacgcccagctaatttttgtattgttagtagagatggggtttcaccatgttggctaggatggtttcgatctcctgacttcgtgatccacctgcctctgcctcccaaagtgctgggattacaggcttgagccactgtgcccggccccttttagtgctttctgggcagcatcaagctcattttcccagagcaggaagatggcacatcttccatgggacagcaattgatgtgatccctgttggagtttattgctataaaatgtgtgtgtcactctttgggaatgatcagaatattccttttagtgctttttgggcagtattgtgctcatttccctggagcaggaaaatggcagatccattgccgtaggttcattgtttcccttttctccaacaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcaggtgggcatctaagcacatggccactcaggacccgaggtgccccagggccctggagacagggtctgatcctttccccacttgggtgtttcagaccgaggagctgaacaagcaggtggtatccagctcagagcagctgcagtcctgccaggcggagatcatcgagctgagacgcacagtcaacgccctggagatcgagctgcaggcccagcacaacctggtgtgtattgttcagacctgctggtgagcgatgggaacttgggaggcagagtcccggggatgtgcttggggccacacactctccttagctcttggagcttgtgacttccttgtaatcctgtgaagaaaccctttgaaggagcagctctctgacattcctgatcttccccaccacagcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagtgagtatggggcaaataatgtctgggaagaatgtgtacagtgggatattgtaggcacacaaatggtggccatgttttcaactagtcaggcaacacacattaactgtgtagcatgtgtccagtgatctgtgatagctaagcaaagggaggccaaaggtaagggaacagcccctatctcagggggctaacaatggaggagtggtggcaggagctggccagttgtaggaataacatttgtgtaaggcacattaagttccaggagacctcaagagtatgagataatatttttgaaaagcacaatttttccacctctgcacatggcattctgggagagagagaagggtttggtagtaatcagaacttgattctggctgggtgcaatggctcatgcctataatccactttgggaggttgaggtgggtggatcacttgaggtcaggagttcaagaccagcctggccaacatggtgaaaccccatcgctaccaaaaatacaaaaaattagccaggcatggtgacgcatgcctgtgatcctaactacttgggaggctgaggcaggagaatcgcttgaacctgggaggcatagtgagccttggctcccacttgcagtgagccaagatcgcaccactgcactccagcctaggcaacagagcaagaccctgtctcaaaaacaaaacaaaacaaaacaaaaagaacttgattccaactaactccagccactgagaattcataggttgtgtcattaagcccaaggtattgtgtgcattaaaacctcctcctaaagccattctaaacctccttgtcctcctaggctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataataaatgtttctcattcatattcatgcattgtaaattactcatcatggctgtttcataaaaataccccttcattaggagaataaaatgaagtaaatgactgagccaagcctttatgcttcaccagaaacactgatgtagacagggaaggacgtccttctgggagactcccacccagggtaggccatgcaggaaacctggccttcaatacccatgcttaccttgccttgactacagggcccttggcaattttgcaaagcctccccagacttcactgctatctccagctctcaccctcatcagaatagaatgttctgcttccctttctcctaaactgcctgaagaaactacagaaactgcttctacagaaactgttcaaagagcagtgattctctcctctcaacctctctgctgctgctgccttgctgatatagatacctactcctcccttaaaatacaccttcattgatttccataaccctgcacactctgggtcttcttgtaatatctctaattacctgttctctgttgtcttgttagctgtcttcccctttttgtcccaaatgaaggaaacacctatattcttagccctctgtctttctctttctacgtccctgttcgtgtagatctagctcctctatgctgatgactgccacatctccctctcatctcagctcagtttccaggttttctgttgcgcatatgacagcttcacttggtatcaggtcattacatcatgtttaattggactaaaacgtatttttcccaaactggttcatcttgccgcccacttgttatgcctgacatgttgtcctccagatagaccctttaaatgcagtccttacctttcccctcttcaagtttattctttcccctagatctttggtcttatccataatgttcttccatagcctctttatcatttcattttctataattccaagaaaggccaatgttcattaaacatctcccccaaaacattaatcttaccccacaccccaccccacttgcctcatccctgaatttttaaagctttcaattttataggccagtctcaattatccattttatttaatcctatctgattgacacaactgcaatcaatcatctatagtgtgtgctgggtactgtgggcggtactgagaaacacaaataagtgaatcccagtctcggcccacagcatgttttacagtttagagtggatgagacaaagctacagtcatcatagacaaatatcagtgtggctcaagaaaggtgcagataaagaattacgaatttcagatgtgtgagagaatgaaaagaagaggctccaagaaggagggagcactcaatcaaagccttgaaaacccaaatgttctgttgatataaattttgtctgcctgtcttgttgactgcaggcccttcagcagaggcaatatcatcacctaattaaagacgatgtaaaccatggaatactgtaagtggaataaataaggaagagtaacactaatgaaaattcatgagaaggttattaaaactttatatacttcccatagtttcaacttcaatcaatgattactgtatgatattagcataattctgaaataaagtttgctgggaaatgtctggtcaggtgagtgtgtttaggccatagaagagggaaagttttggccaggtgcagtggctcacgcctgtaatcccagcactttgggaggctgaggcaggtggatcacgaggtcaggagattgagaccatcctggctaacacggtgaaaccccatctgtactgaaaatacaaaaaaaaaaaaaaaaaaaattagccaggcatggtggcacacacctgtagtcccagctactcaggaggctgaggcaggggaatagcttgaacccaggaggcggaggttgcagtgagccaagatcgtgccactgcactccagcctggatgatagagtgagactctgtctcaaaaaaaaaaaagaagagggaaagttttcctgagcatgaactttgcctggaggagttatg

SEQ ID NO: 12855 - DNA, 13108 bp, Human
cgcctcctgggttcaagctattctcatgcctcagcttcctcagtagctgggactacaggtgcgtgccaccatgcccaatttgcctggctaattttttatatttttagtagagacggggttccaccatgttagccaggctggtttcaaacccttgacctcaagtgatctgcccaccttggcctcccaaagtgctgggattacaggcttgagccattgcgcctggccatttgacaccatttttaggaaacaatttcttgacttggctttcttaggtcttctatatccacatcaccctgaaaaccttctctgctgctctttttcacttctcctaacctgcctgacctccagatgccgagtgctccatgttaaccatcctcaggcctctcttgtctttctgcatccgctctttggtgaccccatctagtctcatagccacttccacactcccagctctgacaagtgcatctgcagctcccagcagctgcccactcaccctcctgcctactctccatcactccctggatgccaaataggctttgcaaactgaatgtcttcaaccaaactcctctctttggcattgtccctgactcctctctttcgctcactccctacatctgatcctttagcaagtcctgtcagctcaacctcaaaattacattgaaaactgttttttagagacagggtctcactgtgttgcccaggctggtcttgaactcctggcctcaagtgatcctcctgccttggcctcccaaaatgctgggattacagacgtgagccaccaccacatctaaatccacaactaccaccctagactattagcctgtaattggccaccacttctatcccccgtctcctcaataagcttcttccccacccggaagccagagtgaccttccccaacctaaggcagatcaaggtgtcagctgcttaaagccatccaggggctccttgtctcaacccaagcaaagccagagctctttgagctgcacagcctccttgttctctgatgtctgctggctcctggtttctgtttctccttcccagccttgctaattgttctccagccaggctgcttcccatgtgggtctcacacagccaagccccctctgcctcagggactcaggcttttatacttggggtttcttctggtacccctctccccctagattttcatatgacttgcacctcattttcttttcttcttcttcttttttttttttttttttttttttgagtcaggcccaggctggagtgcagtggcacaattgtggctcactgcagccttgatccccggggctcagacgattctcccacctcaccctcccaagtagctgggattacaggtgtgcaccactacgcccggctaatttttgtatttttagtaaaaatggggtttctctaagttgcacaggctggtctcgaactcctggactcaagcaatctgcccacctcagcctcccagagtgctgggattacaggtgtgaaccatcatgcctggctgccccctcattttcttgaagccttttaaaatgctaccctaacaaaagaagaccttcctgcataaaacagccacctcccagaattctgttctgtcctctctgctccagtttcccccgcagcactggtacccgcagcactggtacccgcagcactggtaccacttgctatagtatacattggtttgcttctggcctctccacaccactgtaaccctaagttccaggaatgcagggactgtgactgttttagtcacttgctgggtcccgagtgtttagagtagaggcttgcatgaagtgggctcccagtgaatgtttgttgaattatcagacaaaggaagaaggaacggagcacccggtggtggagacagtgctgggctctgacatgtgtttctctactgcccagatctggaagtcggaatcagcactgtgctgtgaccactcccacccacgctgacttctgtcttgtgtcttcttccaggtctacggctctcgcaggctctgtgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatggtaagcgggggtcgctggcaagggtaagtgggttggaaacgcaggagaaagcaaaatgggggtggagagcctgggggttcagggggagtggtgacctgagcattcagactcctcaaaaccagagcggcaggggtgccggcggaagcctgtggccacaccgcagagatcaaacgtttcacaaaggaattagagcatcgctcagtccccctgaagcagaagtcttgggtcaggccataagcaaagagcacaggggatatgtgagctttctggagtcccactgaaatgtagctggattgtcaacgtaggatccaggcgtttgccaagcctcgggaaggagagggagccctgttctcatctggaagcacagatgaagaggatgcaggccgggagttaaccgcttctctccccgggagactcgtgggggtgggtgcggtcttctcatttgctgccctggtgtgcattagctccttgttcaagctgcgcctgggggcatctttgaatacaggctggagttttgtcatccatttaccagagactagggcaaaggaggcccaggcactgagaaatccagccctcacaccagctcaagccctcgtgcgtcccacgagtggacactgaaatcaattttcctattcagtcctctgccccttgccctggggaaatgaatccccggctttgatttactaggaaagagcctcttatgtttgcatagagcattcagcttttcaaattaaggggcttgtaaactgtgaagcactctaccagggaaaattacagttttaaaaaaggatcgtgatttggagtgagcctcccaaccctgtaaggaggccaggtccgtgtccttgctccaggcttaatggaagaggcagtgaacaggaagaagggatggacctaaagagggacagcaagctcggccagcctgatgccctaacttgccccacacagagacctagagcaggagcctcaagatggtatttatcacctcgggagggctggggcaagctggtggcaggttgctatttcatagaacaaagtgcccaagtcgccattagggtttttccctcctaagagagatgacattcagctgcttcaaagcaacaggcaaggtctgctgagacaattgaccaagaggggtgctgcgtgcgctcagagagcccagactggctcaaggtcggcacgcgtgcctggggagggagggtgcaatgcgcgcgcaggggaggcatgagtcaccgcggtccttttcctctacagggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgaggccacacagggctcatgggtttgggtggtcagcggtttggcgccagtacccccctctccttctggtgccggccaatagcgtgcaaacacagaccgcgcaggcaagcggggctaatgtgctggctttatcacccaaagaaggggctccctgcaaaccatgttgggggatcgacttacatctgagcttcctcctgtccccaccatcaccctcatggctcctagatttcagtttcccaagtgagccattaaatcatgaagccggaagccagatgaccaaggcccagccaggctgtgggctgacctcccttccatcagctcccaggaggctcagaagaagaacaagccgtgcctgagttcaggcggggccaggggcccaagagagcacagaatgcatttgttgctttggagggagggactgcacccactagtaagagggaccctattggtggcaggtttcagtgatggaagtggccactccttgctgaagtgtaagtggaacttctatttggtgagctgagatggaaacctaggagaggaagtaaagagtcccccactcacacacttacacactcacacacactcactcacccggtcacacgtggaaatgaggcatctgtacctgaccgtgctggagaaccccataacctctgcatctattagtgggaaagcagcttttctcaccagcctggtggtctggatgactcatggagttcaagcccatcgttgaggctctttacatgctcgcacccagcttggtctgtccacgtgcctgcctcacccccagttcagagtccaaatctcagtctacacgcaaacccctggctatgtgcaagtcaacaaccagtggtttaacttgcccactgctggcagctgtatcacccccatttaacaccaatggtattggttttggtgtcagcctgatttctgtcatcgatgtttatgcccacatcctctgacctcacccctgcatgcacccagccctcctctctcctgtctactggagtaaagactacctcacaaattcactgctgtacccagtgactagtatcatgctggcttggatgcagagcccaatccacatctgtcaaacgaggaatcattttcttctcctcttgctcttcttctctatttccacccctatcccccatcaaaatttggccaagagcaatgatgaaaaccgaagccacaggttagacccatgtgtctctggatcttggccatctggggtcatgggagaccaaggccagtctggctgaatcttaagagtgaatgaagtccagagcatgtggctctacagaatggattcttggaactagcctggaagccaccttcacatttcctttcacagtagaaatttccccttgccctcagtgaaacactgcacagtcctggagaaaatccgaccctacccaggatgcgtgcttgggaccaagaatttcattccaaggccaaccctgtattcatgccacgaagggagtgacacagtcatggctgaggcatgggcctggctttgaacctcagcttgaccacttatgatccaggtgattgtaaatacattagccatggtggcaatggggtatagtgattaaactgttgggatcaaatctctactcttatactttatattttatatatatatatatataatatatatatatattagccctcaggctggtcacttcaccagctgtttgctatcataacctctctgtgcctcagtttcattgatgtaaattgaggactactaatagtacctacttcatcgggttgtaaggaatagatgagcaaatgtatggcttggcacttaataacactacaaattattagtgaaagtatgtttataataatatacttctgtgtggctaggcgtggtggctcacgcctgcaatcccagcactttgggaggcagaggcaggcagagcacttgaggtcaggaattcgagatcagcctggccaacatgaggaaaccccgtctctactaaaaatacaaaaatcagccaggcatggtggcaggtgtctgtaatcccagctacttgggaggctgaggcaggagaatcagaggggaggcggaggttgcagtgagccaagatcacgccactacaccccagcctaggtgacaaagcgagacttctcaaatattaacaataataatatactatgtgtcattatacatgatgattattattttatcattttactatatagcctagctcgataacctggggaaaaggtcacagcaatgttcagcttactttcagattggacaaaggctggaatgcctaacaccgggccaccgcatccggagtggcttggttattttaggcagctgagctgtcacttccctgggtaaggacactcacctcttggcactctgtctccaccccaccctcggcaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagtacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccaggcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtccgagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgactcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccctctagagccacgtgtatctgccctcctctcccctcgctgcggtgtggcagctccctgggacttctccccttggaacaggaaagatgacgtcccttccaccagcgaagggggtgaggaaggcagcacagggcagtgggaaaggggcccccggggtcagacaggcttcagctggcccctgcccccatcgcctaccccgggaccttatctgtgaaatgagaggaaaagggacccagggacaggtgtccatgtagagtcagagcgtcctctccaaaagagagcccctccccacccaaactgcacgccctaccgtctgctcacctcaccagccaactcctgggtctactgcatatggcctcctggcaaaagaccagcatggctacaattgccactgccccagggccccctggtggggcaggtgcagtcaccatcatggccatctgtccagccttcttggttccagcctacctggtgcccccttgacaaccttccctaccatcccgggcccacagcctaggcccagagggctgctgctcaggtggtgggagacagaagggacatgttacgaggaaattgataatgcaaggcagcatagggggcacataaggggcagatgacaaggcctctgcggtggggaaggttagtgtagacgggggtccggggagatgcaggcaggagaagacctggggcaagggtaggacacaagaggagcgggagagaggagaagaccagaaaagtgtctccggggcgggcgttcacacagctccctgcccacctgtgatgggaaaagagcagcaccggggactggagaggcaggagggccagggtgcaggggcccccagagaagctcaactcactgagccaggacaggagccaagttgtgattaacatataagccccagctttgggacaaaggggtcatgtcagacctgtggtaactcttccctgtcttcctcctagacctggcccaggctggtgacctcactaaaacatccctctcactaatcacacccttgggtcaccccttcctgtttaattctagtaggcccagagactcattttaaccaatgggatagagcaggagtgatgctctgccagttttagcctaagcctagaaggcctagcagcttctacttctattctattatttgagacaggatctcactctgtcactcaggcttgagagggcaatggtgcgatcatggcccactgaggccttcacctcatgggctcaagcaatcctcctgcctcagcctcccaagtagctagaaccacgagcatgcaccaccatacctggctcattttttattttttttctggagatgggagggtctcactatgttgcccaggctggtctcaaactcctggcctcaagccatcctcccaccttggcctcccaaattgctgggaatacaggcatgagcccctgtgcctggcccacttccgcttttatactctcgggagccctaagctgccacagaagaagcccaccctcccattttgctggaaaggccacgtagggtaggaggggccacttgtcccagagtctcagctaggtcccgtatccagctgagtgcagctgagtgactacccaggacgcagccgaccccatggggagcagagccttgttccccactctgccctgccacagtccttaccctcagatccctaagcaccgtaaatgaccatgtgtttaagccactgaagtcagggggatctattacatggcataaaaatacatcaccagaatgcctatcagcacgctcctttgcttgccacttgacaagcctgtctccatccaaagggctcagaatgacataaaaaaagcacccctagaaaagcacaaggcgggccaggtgcggtggctcacacctgtaatcccagcactttgggaggctgaggcgggcagatcatctgaggtcaggagttcgagaccagactggccaacatggcaaaaccctgtctctgctaaaaatacaaaaattagctgggcatggtggtgcaag

SEQ ID NO: 12856 - DNA, 7873 bp, Human
gagcaagaatctgtctcaaaaaaaaaaaaaaaagaaagaaatgtttagagtgtgctaattatcctgacttgattattacacactttatgcatgtatcaaaatattactgtgtgccataaatatgtacaattattacatgtcaactgaaagtaaagaggaaaaaaaagtaaaccaaaacaagacctgagtgtctcagagtcctctaatcccatgaggaatcatatttaaagccgaccaaaattaggtctttatttttaattatgcaaaaagagaaaattcctttaatatgtgccaaagggaatagggaaaatgataagattatattcaaattatttgaaatttgaaaacaaagcagtaaagatcccactacacagaaaggcatgaaaatgaaaagattcggggttgattcaaatggaagaaagcacaactcacttcacgggtaacaatttttatttgagaacacaagtttcacaagaaaatcatcttttttttttaaattgtgacttttatcttaacactgtgtgaagtactcaaggtccaagaagcttaatggtcatttgtcaaaatagtaattatccaattttttcctatgaattatgaaattttttcaaaaccagaaataaaccaatgaaaataaataaaaattccctagaatttcctcaatggaatgcatgcccctattacctttgagtctgatgtatatgaatttaaaccattttgtaaaattgcaaatccaatcatacttaatacttcaggtttccaagcaaagcttgaagcctacaacatattacaggaattatctttactgacaactgatggaaacatctctaaaataagcttttgaagttagtacattaagcctaatttaatataaaggcaatttaatcttatcttcatatgaaagaaaaatacactgtcaggatgaaggatttactaaagttacaattaactggagatatatcaccagtaaaaacctaattccctgttataattaaatcaaagcctcattaggttagagggtgtggaagggcatgacccagtgggaggtgggaatctcaccaataaaaggccctcatgtgccccttccgcacaagacctgagcgcccagtggaagcagctggaggacagaggagcttccagcagaagaggtgagcccatgcctgtgtgtgtgtttttcctccttagatgcctagaaatgggggttatgccttgggggatgaatgagagaaattcgtaattaatgaattcaacaaaggctgtctgagtgctgcctcagagttgaaaaccagtcaccctggatccccagatctccagtctaggagtggtggcagtcaatttggtattcatttccaaggctggagaaggatgtgatttttttttttttttttttggtgagacagggtcttaactctgttgtccaggttggagtgacctggtgtgatctctgctcactgctaatttttctattatttgtagagagggggtcttcctgtgttgcccaggctgatctcaaactccttggctcaagggatcttccagccttggcctcgcaaagtgctgggattacagatgtgagctactgcatccagtccctctctttttttttttttttttttttgagatggtgtctcactctgttgtccaggccggagtgcaatggctggatcttggctcactgcaacctttgcctcccaggttcaagcaattctcctgcctcagcctcccaagtatctgggattacaggcgtgtgccaccacgcctggctaattcttttgtattttcagtagagatggggtttcacccatcaggctggtctcgaacttttgacgacctcagatgatccactcacgtcagcctcccaaagtgctgggattataggcctgagccaccacgcccggcctcccagcccctaattcttatgttcatcaatcaatctcttgctggggttcccctaggaggaggtgaaatgaccccagctcgctgttcctcacatgggtgctgccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaaggtgagggatctgtatacactgcccccttcctacgaccagaccaggaaaaatcatctgtgcaactggcccctcattccatatggggattagctgctgtctggcacctaaaattgagatgcttcttcatcatcagattctcagccctgacaacatacagaatcacctggtgatctccaaaaaaaaggctggctgggcatggtggctcatgcctgtaatgtcagcactttgggaggccgaggcgggtggatcacgaggtcaggagatcgggaccatcctggataacacggtgaaaccctgtctctactaaaaatacaaaaaattagccaggcttggtggtgggtgcctgtagtcccagctacttgggggttgaggcaggagaatggcgttaacctggggggggcggagcttgcagtgagccaagattgcaccactgcactccagcctgggtgacagagtgagactccgtctcaaaaaaaaaaacctgatgtctatgtcatgggttagacaagggattctctaaacttagtgtgctcagattacctggggatcttgttaaaatgcagatgctgaactgggaagtctcaggattgatcccgctggcttggggactttgctgagtagcaaaaacacagagcaacttaatttgaatttctctctagcaaaggttcccaggactctgacatttaaatgggcctggtaattctaatgcacagtgagtattggcacccactgtaccaaacaacctcaccccagggttgggaagagtttggaatggagcacctatggtgtttgtttctgtgagtggggcgagttgcagacgctggtctcctcatcggtgtgccatggacttcaacaggggtcctggctacagaaaatactatcactctccataactctggggaatagggacatttaaatgaagaggttatggtcagcctgggcaaagaattacacctataaatggtggtggcttctgccctgacacccatgatctctactcatccacctacccatacctgactgtgtctctgctgaaatatggaggacagattcaccctgcctaagtcatgtttggaaccctcttcctccttccttgtccatgtccactcatctcatttcattccctaattcaccatcaaacagcaatcagtctcctcaagtcttactgtaatctataaaatctatattggtgatcatcagttttttgacttgaaggatcatatgttctgtagatttttttttcagaatgctctggacaattaattttctttaggccagatcacactgcctcctccatgagaattggcagcttcacctatcaaccacatacccaatgcattaaattattgacctttgtatttactgcccttattctctacgatcagtcagttatgacgaacaactttctttttttttttattttttgagatggagtctcgctctgccgcctaggctggaggtgcagtggcatgatctctgctcattgcaagctccgcctcctgggttcatgccattctcctgcctcagtctaccgagtagctaggactacaggcacccgccaccatgtccggctaatttttttgtatgttttttagtagagacagggtttcacgtgttagccaggatggtctcgatctcctgacctcgtgatccacccgtctcggcctcccaaagtgctgggattacaggtgtgagccaccgcgctcagccaacaaacaactttcaaatacctttctcttcactccaaaatttaccattgttttgcttaaggtttcacctcccatgtaggatggaaaacattctttcatctaaggcccccctcttcctcctggccttggagcctcctaatgtccaggaccggcacctctgtcatcacattgtcagctgcagagataccctacctgctgtcagaaccatgcacaattaatttgcttacaaacatggaaaacaaaggcctggaatcatgctctatatactgagttgagcaatacaagatggaagcagaaacatatttaacatcgaccatttgcattgtcttaattatcattcattttttcatgcatcaaggtggtagaaagggggtcatggtgtctgccttcagagaccctccactctaaatgaagaaaagtccaatgaagcaaacacgtgacataaagtaaaataattgctactgtgaataagagttgggtattgccacaaagcatacctatgagaatttgaactagtcagggaagttgcctcatgaaaagttttgattttgggggaagaagagaattaaagaaaccaaagtcaagagatatttgggcctttgaagtagaggagaggcatggggttggcttctgtccattttctgatcaactttttttccttttcacagtggatacgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatcacctaatggattatgtgactttctttcctcagcctcctgagtagctgggattacaggcaactgccaccacgcctagctaattttttgtatttttagtagagacaggatttcaccatgttggccaggctggtctcgaacccttgacctcatgattcacccacctcagcctcccaaagtgccgggattacaggcatgagccactgcacccagccggattatgtgattttctaaatgataggagtacgatagattttattcatagtaaatgcgtgagcgtgtgtatgtgtgtgcgtgtgtgtgtgtgtatttggacagagagctggataaatgcctatgtcctaaccagaactgaaaaaacaagttgttgccatcattgctcagtataggtaacattttcctggatgtgcattcatctacattaacaacgataattccccccaattaattattataattattaattataattgttaacaattaataaacctctgcaggctaacaaagcaaaaaaaaaaaaaacaaacaaaccacacattactcatattagaaatgaaagaggggccacgtctaccaaactgttgagcattaaaaggataatcagggactgttatgaatgactctattcccacagtttgataacacagtctctcaattccttgagagacataatcttcccaaggtcacactagaaacagacaatctgaacagcctctgcctattaagtgaattgacattaagaacattccaaaaagacaacaccagaaccaaatgatttctcttatgaaatccaccaaattcttatgaatcctaacatattttcacaatataatccaaaaattgtgctcctaggtatgtactcagctgaaatgaaaagttatgtccacacaaagcctgcacaggaatgtttacagcagctttatctataaccacccaaactagaagcaagatgttcaagaggtgaatgaaaaaaaaaatcatccataaaacacagtattattctgtgatttaaaggagttctccaacaaggcatagaaaagacaatggcatatatcagaaagactgtgagggcatgccttcactggatgagacacacagaaaggcggcagagcagggtgactttatgttaattagtgaagtaagttcatctgaaaaagctacataatactgggttggtgcaaaactagttgcggtttctggcatttaaagaatgggaaaaccgcaattacttttgcgtcaacctaatacatgactccaactacatgacattctggaaaaggcaaaaccaaggggacggtaaaaatatcaatagttggtaaggtttctggagaaagaggacagagattcacaagtaaagaagagggaagttttggagcggggagagtattcctcctgagatcaaaatggtaaacataacatcataaatatttcaaaattcatagaaatgtgtaacaggaagaaagaacactatgtgaatgacagactttagttactaatgtatccctttggcctttctcttcaaggatccctgaggagacagagccccagtgccctcaggcatccatgcttagaatgaagccacaccccacccctggtatccagaatggtccggttccaaacgtccctgggagaactgtgagcagaaggtcctgtgcggcagaaccccaggccggaggggtggcagggctgaccctgcacatccagcagttctgttttctctccctcccaccccaggctcttctcctgtcatttccctgcatctccctgtttcttcctgtctggatctttctccttccctccctctctctctcgcgttgagtgtgcgtggtctctgtcactgctgccttggccacctgcagacgtctctctctgattccacccatgggttcactgacatccgacatgggatgctcttggtgcttcctagcacaccagcccagtcctgagagggaactggcagccacaggcacacagactcatagggcacaggagcctacgaataca

SEQ ID NO: 12857 - DNA, 21360 bp, Human
ctgaaagcagcaacccacatatttgttcacccatgttcatagacatattatttaccatagccaaaggcagaagcaacctaggtgtccaggaaaggataaataaggccgggcgaggtggctcatgcggtaatcccagcactttgggaggccaaggtgggcagatctcttgaccccaggagtttgagaccagcctgggcaacatggcgaaaccccatctctgctaaaattacaaaaattagctgggcatagtggcacatgcctgtaaccccagctactcaggaggctgaggcacaaggattgcttgagcccaggaggtggagtgcagtgagccgagatcacgccattgcactccagtctgagcaacagagcaagactgtctcaaaaaaaaaaaaaagaaagaaagataaatagatccagaaaaatccagaaatttgatatctacatacaatagaatacaattctattctattgtatgtagatttaggaactgactaatttaggaactctttaaaaaatgtttaaataaagcattaaaaagaagtaaattggggacaggcgaggtggctcacacccccagcactttgggaggccaaagagggcagatcacctgaggtcaggcgttcgagaccagcctggccaacatggtgaaactctatctctactacaatacaaaaatcagccgggagtagtggtgggcgcctgtaatcctggctactcaggaagctgagtcaggagaatcacttgaacctgggaggcagaggttgcggtggctgagcgccactgcactccagcctgggcaacgagagcgagactccatctccaaaggaaaaaaaaagaagtaaattggccggtggcagtggctcacacctgtaatcccagcactttgagaggtcgaggcaggaggattgcttgaacctaggagttcgagaccagcctgggcaacagaaggagacacacatctctaccaaaaattaaaattaaaattaaaacaattagccaggcctggtagtgcgtgcgtgtagtcccagatacttaggaggctcaggttggaggcttgcttgaatccaggagttgaagcctgcagtgagcaatgatcacaccactgcacttcagcctgggctacagagcaaaaccctgtctcttaaaaaaaaaaaaaagaagaagaggccgggcgtggtggctcacgcctgtaatcccaacgctttgggaggccgaggccggcagatcacgaggtcaggagatcgagaccatcctgactaacacagtgaaaccccgtctctactaaaaaaatacaaaaaattagccgggcgtggtggcgggcgcctgtattcccagctactcgtgaggctgaggcaggagaatggcgtgaacccgggaggcggagcttgcagtgagccgagatgcgccactgcactccagcctgggcgacagagcgagactccgtctcaaaaaaaaaaaaaaaaagaagaaataaatcctaacacatactacaaggtgaagctcgaggacattatgctaagtgaaataagcacgtcaggaaaggacaaatactttatgacgccatttacatgagattcccacagtcaaattcacgaactcagacaatggaatggaggttgcaaaagaccctgagggaaggaggtgcacggggagttgtgcaacgagacagatttcagtgttgcaagatgaaaacaattctggaaattggcttcacaatgtgaatgtatttaacagtactgaagagaacacttaaaatggatgggaggcaaagaacacattcggtttaaacgcaaacgtcctggcggggacaagccggactgaagccaggccagctcaaccacgccccttcctgctccgctgtcactcagtgataaagaggcggggccattggatctgtccaatcaggacctcagctgaaaagatgtgagcggcgccacgctgggcctgcgcagtgcggacgtcgccattcctggcccatgggaagattgcgtttcacctgctcctgaaggccgaaggtggctctagcgcatcctttgtcgcgccgtgacctgcaggtactgacagatccgtagggaggacaccgtgacttcccggacgctgggaaatggtgagtgtgcggggccagtgtccgaggggaggtttctggttggaaccgtctgtggccgaggccggggacctccttgcagtcaactccggggtttgcagacccgggggccaccgcgggcgcagttcggccctcggtcctctctgtgggagctggacccgcagccgggagccccagcgtcctgtcccgtccccgcggggcgacctcggcccccggtcctggagccctctatgggcagctctgcgcccgcagccccgcgtctccccggattgttcggtgacagcgggagggtcctggggagatcccatctcggtctgtggggtttgtgcgtttaagaaaccacttggttggaaaccttacgatgaatccacgggtgcgtttcctcacttgtgagaaccgaagcctggctaggtccttgctgccggggtcaggttcctgtggctgttcaaacgcccctgccctcatcaccagggactgaccccctctagtgctcccagcactcaagtctgggggtgtttttgaccttctgaatgtgggctttcttttcgaactgcggggaaggggactccttatcttaactgatcagaaagtttgtgtttcttccctttggactccttgatcaaatattaattctagccacccttaattccagtttcccttcgctctgggtaattttgttcccttgcgtgaatgtgtgcgatttttagtttctttggtttctggatggaatttattgtgagcttgttcaggttcttttaaattttcttgtttgtgtgtgtttatctgtgtggtttctacccaagagatttcgcctatgttggagtgccatgatgatgcaaaatctctgtatgtcatttgttccgtatataagtggtaagcatttttttgtgtgtgtgacggagtctcgctctgtcgcccgggatggagtgcagtggcgcgatctccagctcactgcaagctccgcctcccaggttcaagccattctgcctcagccttcccagtagctgggactacaggcgcccgccaccacgcccagctaatttttttgtatttttagtagagacggggtttcaccgtgttagccaggatggtctcgatctcctgaccttgtgatctgcccgccttggcctcccaaagtgctgggattacaggcgtgagccaccgcgcccggctaagtggtaagctttgaggtgtttgtgagagtgatgtttatgacacacaccactttgatacattctgattgtaagtgtatgttgtgattttttctttcctcgtgtggttgtaataggtcagtgtgtttttctctgagcaattaaccagtggaaggttcctaagtctagagtcattgtgggtagttttgttgttgttttttttcttttttttgagatggaatctcactctgtcgcccaggctggagtgcaacggcatgatcacagctcactgcaacctctgcctccctggttcaagcagttctcctgcttcagcctcctgcatagctgggattacaggcacccaccaccacacccggctaattcttttattttttagcagagatggggtttcaccatgttggccaggctggtcttgaactcctgacctcaggtggtctgcctgcctcaacctcccaaagttctgggattacaggcatgagccaccgcgcctggctgattgtgggtattcttttgatgctgatatgtcagtttgggtaccatatctagtttgggtaccctatcctgaaaggtgtagtatatagtttttcagaattggaatactaattatttttgtataaaataatcaataaataatggtttttctaaggtggttatttgtagattatatcttttatctgtctgtgtacttgggtcaaaagctagttgtgagtctcctcatcttaattcaagtaggcttaatatacgtgaccttgaatcttcacatcctgatggtttggatgtatccagttgaactacagctgctttatgccagtgttttgtaaataattttcctgattgtattgggtttctttttttatattttctttcttcttttgagatggagtttcactcttgttgcccaggctggagtgcaatggggtgatctcggctcaccgcaacctccgccttccaggttcaagcgattctccttcctcagcctccctagtagctgggattacaggcatgcgccaccacgcccagctaattttgtatttttagtagagacagggtttctccatgttaatcaagctggtctcgaactcccaacctcaggtgatccgcccgcctcagcttcccaaagtgctgggattacaggcatgagccactgcgcccggcctgtattggatttcttatgttattccaagtctgagttagtataagtacttcgcttagtacattgggtttgcagtcagtctttcaccgtcaagtttattaatgtaaatagattggtttttaagatgcctaccttgtaattgatactgtaattaaacaccttttgatattctgtgaggtcatttatatgagtcatcattgattgtatttcattgtctgtgagatagaggagagtatgaaagtggtagttgacatgtgggagttaagtttgtgtttaaaatcaaaccctgcccttaaataaaactgcgggctgggcacggtgggtcacgcctgtaatcccagcactttgggaggccgaggcgggcggatcacctgaggtaaggagttcaagaccaccctgaccaacatagtgaaatccatctctactaaaaatacaaaaaaaaattagccgagcctggtggcacacacctgtaatctcagctactcaggaggttgaggcaggagaattagaattgcttgaacccaggaggcagaggttgcagtgagctaatgccactgcactccagccttgagactctgtctcaaaaaaaactaactaaataaataaaggtagtttgcatatattgtagccaagcttgccacgaatgtgaatttagtatgtgttgaattatgtcagattctgaatggtgctgtgtctgttcattcagtttgatttgtaaagcttatcggtctaggtatatgtagccattttagtaaattatattgaaaaatgggtgagggtaaggtttttcacctgtaggatgatgaaatacagctctaatatatgttaaggtggaagcatattaatgttggtcatcccttaaaatatgtgtctcattgggtgattctgtacatttttttttataagtttctcagttgtggtgtttaattggtacccttgaaaacaagtatatttaggacaactctgtctacataatcttctgttgttttagcatgtgtttcagaagtcgtgtgtgtaggcccaggtgtggtggctcatgcctgtaatcccagcactttgagaaaccgagatgagtgaatcacctgagtcaggagttcgagaccagcctggccaacgtggtgaaactttgtctctcctgaaaatacaaaaaattagctggatgtgggggctggcgcctataattccagctactcgggaggctgaggcaggagaattgcttgaacccaggaggctgaggttgcagcgagctgagattgcgccattgcactccagcctggatgacagaggaagactgcctcaaaaaaaaaaaaaaagttgtgtgtgtaaagtgatgaggatcagttaagattattgggtgggccaggcacaatggctcacacctgtaatcccagcactttgggaggccaaggtgggtggatcacgaggttaggagttccagaccagcctggccaacatggtaaaacactgtctctactaaaaaatacaaaaattagctgggtgtggtggtgggtgcctttaatcccagctacttgggaggctgaggcaggagaatcgcttgaacctgggaggcggaggttgcggcgagctgagatcacgccactgtactccagcctgggcaacagagcaagactccgtcttgtgggggggaaaagattactgggtgtaatctttgtttccaatctaattctactatgaggatttttttagttctgtcaaagaattgtggttctgtcaaataagtttgacttttggcataattataacaaggttggaaggcaattaatagaaaaagagggaatcctccctaactcattttatgaggccagcatcatcctgataccaaagcctggcagaaacacaacaaaaaaaagagaattttagaccaatatccctgacgaatattgaatcaaaaatcctaaataaaatactggcaaactgaatccagcagcacatcaaaaagcttatccaccatgatcaagttggcttcatccctgggatgcaaggctggttcaacatacacaaatcaataaatgtaatccatcatataaacagaaccaaagacaaaaaccacatgattatctcaatagatgcagaaaaggccttcaacaaaattcaacagcccttccttcatgctaaaaactcccaataaactaggtattgattggatgtatctcaaaataataagagctatctatgacaaacccacagccaatatcatactgaatgggcataaactggaagcattccctttgaaaactggcacaagacagggatgccctctctcaccactcctattcaatatagtgttggaagttctggccagggcaatcaggcaggagaaagaaataaagggtattcaattaggaaaagaggaagtcaaattgtccctgtttgcagattttatgtttagaaaacccatcgtctcagcccaaaatctccttaagctgataagcaacttcagcaaagtctcaggatacaaaatcaatgtgcaaaaatcacaagcattcctatataccaatatcaggcaaaagagagccaaatcatgagtgaactcccattcacaattgctacaaagagaataaaatacctaggaatccaacttacaagggatgtgaaggacctcttcaaggagaactattcaaggagaactacaaaccactgctcaatgaaataaaaggggacacaaacaaatggaagaacattccatgctcatggataggaagaatcaatatagtgaaaatggccatactgccgaaggtaatttatagattcaatgccatccccatcaagctaccaatgactttcttcacagaattggaaaaaactactttaaagttcatatggaaccaaaaaagagcccatatagcaaagacaatcctaagccaaaagaacaaagctggaggcatcacgctacctgacttcaaactatactacaaggctacagcaaccaaaacagcatggtactggtaccaaaacagagatacagaccagtggaacagaacggagcactcagaaataataccacacatctacgaccctgatctttgacaaacctgacaaaaacaagaaatggggaaaggattccctgtttaataaatggtgttgggaaaactggctagccatatgtagaataaggtgagacataggagatcttagaaaggctaaaggtgatcttggagaaactaagtctccatgctgggagtgcactgttgctgtcagtctgcaaattattaatcagatactgtgcttggcaagcagatggtgtaatttgtcatttgtctgcagtggtgtgtatgcttgtgttaccctggtttatgtggttggaatttaagtaataacaagacagtaaagtcactctgatgactagcagaggtgaatgagaaaggcggtaagaccaactgagaagctacacaaatttgtagccaggttgttctttttttttttttttttgagactgagtcttgctctgtcacccaggctggagtgcaatggcgcaatgttggctcactgcatactctgcctcctgggttcaagcaattctcctgcctctacctccctagtaggtgggattacaggtggctgccaccatacctggctaatttttgtattttttagtagagacagggtttcaccatgttgatcaggctggtcttgaactcctgacctcaggtgatccacccacctcggcctcccaaagtgctaggattacaggcatgagccaccacaccaagcccaggttgttgttcttaagcaagtaaacgagttattccagtgatggctacaggtgatgttgaagttaaaaatacgaggtgagtggcaagtaaaactggattgaagtataccttcaattattcttatggaaatattgatgcaatcagtgacttgaagaaaacagtgtagtgccactgttgtaaaaggtgtaacaaatctaggtctagtgagaatttggagaaaagttggagattttgcataattctaagtctcctcttttacctgtagtcaataagtattttcatatccatgggccaagatgtcctgctgggagatagagttggcatttagtcaaatgctccccttgtaaggtataatctttgtatcattgtcttccttatcctttgtgactattaaggttggttgattaaagtaagagtaggaagggccgggggtggtggctcatgcctgtaatcctagcactttgggaggccaaggcgggcagatcatgaggtcaggagttcaagaccagcctgactaacatggtgaaaccccgtctctactaaaaatacaaaaattagccgggcatggtggtgcgtgcctatagtcctagctacttgagagactgaggcaggaggatcacttgaacccgggaggtggaggttgcagtgagccaagatcgcgccactgcgctccaacctgagtgacagagcaagactctgtctcaaaaaaatcaataaataaataaagtaagagtaggaggttgttcttatgaatgctttctcttttatttaaattaaaacatgccgggttaagagcttcttgggatgtgctcactttgtctagggttttcaattctctttttagtagcctggttaatttctatatacatcttgctgctgtgggattatagggtaggtggaaattccattgtgtatctcattgatctgatgtcacttgtgtagtccttgatgtaaaatgagttccctgattatttttaattttaggggcttccaattattttaggagctcttagaaaattgagctgcccaatttcctggcagggcatggtggctcatgcctgtaatcccagcactttgggaggccgaggcggacagatcacttgaggtcaggaccttgagaccagcctggccaacatggcgaaaccccgtctctactaaaaatacaaaaaaattagccaggcatggtggcaggcgcctgttatttaagttactcggaaagctgaggcaggagaattacttgaacccaggaagcagaggttgcagtgacccgaggttgtgtcattgcactccagcctgggcaacaagagcgagactccatctcaaaaaaaaaaaaaaaagatatgttttatgttccagaatgtgggctaccttggtgaatgttccatgtgaacttgagaagaatgtatatcctgctattgctggtctaagtgttttgattttccgttcagtccagttgtttgatggtactgttcagttcaacaatgtccttcctcattttctgcctgctggatctgctattgctgatagacaggtattgaagtctccagctatacttcatggctccatgcagttctccctgccgttccatcagttttgcctcattattttgccactctgtttttatgcacatacacactaaggattgccttgtcttcttggtgaattgatcactttgttattacataatgcccctgtgtcactgagatttccaggatgtgaagtcagctttgtctgaaatgaacatagctgtgttacttttctttttcttagtgttagcatggcatatctttcttcattcctttatttttaatgtatctataactgtatatttaaaatgtgtttcttttcaacaccgtatatttgatccattattgacagtatctgtccaccatttgttgtatttagaccattgatgtttaacatgttattgatttagttgtattaatgtctccctttttctttttatgtttttctatttgttgttgttcttcctttcccatcttctattctttttctaccttatctgctttcattaagcattttacttgatgccatttttctccccacttagcacatcaattatagttttttgttgttttttaagttttactcattgcctttgagtttgtagtacatgcttacaagtaacccaagtcctcttgtaaagaacactgtactacctcactggttgtgcaagtacctcatgaaaaagtattcccaattcctcctttcctgtcctttgtaacattgctaccatacgtatcatttatccataagctggacttaccaaatatattgttcctgttagtgttttggacaaactcatctgtcagattacaaaaaagagattgtattttacttgtatttattttttctctaatacccttctttatcgtttttcttttttgtagggaattttttaacagttctttcaaggcaggtacgctagtgacagattatcttttcttatctcataaagctttcatttctcttccattttgagggatattcttgctctatacagaattctatgtggttgggggttttgtcttataatgttttaaacatttcactccagtctcttcttgctttcactttctgtaaagagtcttgggctggtcctggtggctcacgtctgtaatcccagccctttgggaggtcgaggtgggcagatcacttggggccaggagtttgacacccacctggccaacatggcaaaaccccatctctactgaaaatacaaaaaattagctggacatggtggtgcgtacctgtaatctcagctactcggaggctgaggcaggagaattgcttgaacccaggaagtggaggttgcagtgggccaggatcgtcccactgcactccagcctgggcaacagagtgtgacaatgtctcaaaaaaaagagtctgacttaattcttttatgtttttataacaaagatgttgtttgttccccctgtaacttctttcaaagtttttctttgtcttttaattttctccttgaatatgatacacccaggtgtggatttgggggtatttatgttgcttggcattcctggatatttcctttcatgtataacattaattttgggaaattatcagtcattattgcttcagttatttcttctgtttctttcttgtctttagttagtactattatgtgtatgttccactttttgtaattttctgacagtttttggatcttctgatgtcttgtttctccttttcagtttgacgggttatactgacagttcttcaagatcactcatcatctcttcagacatttccactgtattgatgaacctgtaaggctgttcttcatttctgttgcagtgtattttatgtccttcgttaccttttgattctttgttagaatttctatatatatgcttaaattgtctattttttctttcatattgttcaacatttccatgagaacccttagtatattaatcatatttggtttaaatttctgatctgacaattccaacatctcttctatacctaatctggttctggtgcttgacctctgtcttctaattctgttcttaaaacctttttgtatttcgtataatttttgttgaaaactcgacaagatgtactgggaaaaagaaactgaggtaaataggccttgagtgtgaggttttaggtttatcctactgggttttgtctctgtttactgttttcagtagccgtagatgtcagaggttaaaatttcctttgatgtccttgcttttctctctcctgtcatctttgggcttctctagacacttgttaaataaagtctgaaacatgcagaaagaaacagtgcaatattctttcattgcagtcacctgtttttaaacagaaaccctaatgacaatagtggtaaggtgtaggtggaagggaaacatgttatagtcctatgatttgatctcagtcttttagtgagcctgtgcccgagctgtgatgttttgtgatatgataagaaagatacttagtctttgtgtgtgattcctagcacagagctcctaaatcccttgaatttcacaagtgagaagggtgaaaggatcctccttgtttgcaaagcagcactcttaggagatcctagatgactttaggattaggattggtgaccagaaagacctgcccttgaactttcagccctagcccccagcctcacaagagaaaagaggagctggagattgaattaatcattagtgtgtaatgatttaatcaatcatatctgtgtgttgggaccttcataaatattggggttctgagaacttccatgttggtgaacatattgaggtgctgtgaggatggcacacccagggaatgcatggaaacatcccacctgctctgcataccgaccaatgggcctcttccacttggctgttcctgagttgtatgttttgtaattaaaccggtgatgctaagtatatcactctcctgacttctgagggaggccctagtgaattactgaactataaagggtggtgtgggaactccagatttgtagttggcgtgtagaagcatgggtggcctgggcaccctaccgtgtggcttgcatctgacatgggggcagtcttgtgggactgagtccttaacctgtggagtctgactaattctgggtacttagaattgaattaaattttagggcacagtcgatgtcagagatttggagaatggcgttggaaaagacaccttgtattggtgttgggaagacaaaaaacggttcaccttcacacatgcttctgtgtccctgcccccaggtcacataggctttggtaaaatcatagtaggttgggcttttgttgaaatggaattttttgagaacaggtcttcttaagaagaacattatgttctgggaatattacaaaactgttacttttcctattcatctctcaaattttagagagaaaactttgccttatgaccctcaattctttaatggatccaagaagggtaattgatttgatgtttattttttacttgcacggctgggattgacaatttctacgttccttacttgtgagaccagaaattggaagtctctgacttcatttttttgtgatgtttgatggatgatagctttaaaatctcattattgccaggcatggggactcacacctataatcccagcactttgggaggcggaggcaggcagatcgcttgagcccaggagttcaagcccagcctggccaacatggcaaaaccctgtctctactaaaaacacaaaaattagacgggtgtggtggtgcacatctgtaatcccagctattcaggaggctgaggcacaagaatcgcttgaacctgggaggcgaaggttgcagtgagccgagatcacgctacagcactccaacctgggcaacagcgaaactcggtctcaaaacaaatgaaataaaataaataaaataaaatctcattcctccttttctactatgtaccctacatccagatgtggtaggaagaaagcctgggtcaccctcatttggtgctggtgagacattcaatccacattagcccctgcttgtatgcttgaactcccacactagcccactccctaacctcagtgaaaacccctagccagcctacccgagtcttcccaaagtctcaagtaaacgcgtaataaaccctctcctggtatacaaattttgtagaggtgtaagttgccatacgttcctcctcaggcctgagctctaacttcctagtaatctcctagatccatgaaatgtgagagagagaaaaaggaagaactgagcctgtgataaatattacacaaacaagttgaaattaatacttctgcaaagaaatattttcattcagccagctggatttgagtacttatagtggaacaggaattaaaagaaattttaaaaatgtataagcaaaaactcagttgtatgtaagaaaaaccagttccccctgaggaagagaaagatctgaagtcctttaaaaattgactgcctatttttctgtagctagtgagccttatctctccctttcccaggcattgtgaagactgtttctctagctgtgcagctgcaaggtcactaaacagataatctcaagtcgtaaaacatgttgtcgttccttgaaaagtaagaagtaatgtaatgcgtgttttaattgaataactgtctttgtttctcgcttctgtaatacacttccccctgcacaaatctcctccccaccccacgaaatggttaaaaggtagcttgactctgtttggggctcagttctttggatgttaatccaactgggtcggtgcacctaaataattaaataattcctcctcaacccctcaatctctctgattccttaattactccactgcagtagtggcctggagtccttcaggacatggccagcagctccttgtgacaatttagctttccacaggcctcctggcctctcgtttgttgatgggaataaaagaaaagcctacagttcttgaaggtgtatttatttattaaaaccttatccagattgattccatgcgtaatgaaatgctgagtgatatggtacgtaataaggtaggaaatgagtttttctcacaagggattaatggtcttaaaatttgtttcatttgtatagcatttctcttacttttccagtgtgagcttgagtccacctttagagaacaataaggtttcacatgatcacagtaaaaatttagaagtaattgaccaggcacagtggctcacgcctgtaatcctagcactttgggaggccgaggcgggcaaattgcctgagctcaggagttcgagaccagcctggccaacatggtgaaaccccgtctctactaaaaatacaaaaaattagataggtatggtacacacctgtagtcccagctacttaggaggctggggcacgagaatcatttgagctccagaggcagaggttgcagtgagccaagatcgcaccactgaactccagcctgggcaataaagcaagactctgtctcaaaaaaaaaaaaaaaaaaaaagaaaaagaaaaaggaaaaagaaaaaaatagaagtaatttctgtgtgttcatgacagcatgaattttatgaggaagtcagtgtggacagtcgtagttctgacagctgagtcatacaccaaatgtttggagaacacagaattgtatgggaacttcttacaaatcaagtatagatccccagtactgccagtcttacccatcctctgtaaacatatgtggaatgtttcaggactcagtctcctttgaggatgtggccgtgaacttcaccctggaggagtgggctttgctggattcttcacagaaaaagctctatgaagatgtgatgcaggagaccttcaaaaacctggtttgtctaggtaaggatatcaacatttctttcctcagttaaatatagaacacagaacaagtgtttcttgctcaacagctgtgttccaagatttgaaatgtggaaagggaatctttcagtgattgaatcagacagtcacagctaatcatgaaactagactgtaacaattttctataatttctaataatttttaatggtctttctgggtatgcattttaggaaaaaagtgggaagaccaggacattgaagatgaccacagaaaccaggggaaaaatcgaaggtgagttgcatccacagaaaaatagtggcccgtgggggaatttcaaaagaaagcaagcaaaacaattaagcacagcttcaaatttatttattcctagaaaactttcactgaaaatgttttcttaaaaacatcatagatgttcaggatgtgaaaaataaatcacttcgaaatagcatttagaaaccccttttataaatattattattttggccaggcacaatagttcatgtaggtaatcccagcagtttgggaggctgaggtaggaggatcacttgaggcctggaattcaagaccagcctgggtaatatagcaagacctcatctggggaaaaaaaaaaaaaaaaaaaaaaggcctggcacagtggctcatgcctgtaatcctagcactttgggaggccaaggcgggcagatcatctgaggtcaggagttcaagaccagcctggccaacatggcaaaaccccatctctactaaaaatacaaaaattagccagctgtggtggtgtgctcctataatcccagctacccaggaggctgaggcaggaaaattgctggaacccaggaggcagaagctgcagtgagcctagatcgtgccactgtactccagcctgggcaacagagcaagactccatctcggaaaaaaaaaaaaaattagccaggcatggtggcactctctagtcccacctgctcaggaggctgagatgggaggattggttgagcccaggaattcaaggcttcagtgagctgtgatcatgccactgtactccagcctgggtgagagaatgagactccatctcttatttaaacaacaacaacaaaaaaattgactgttttgatcataactatggttgagtcttcttccagagcattgaatatattaactttaaaacaattcagacagggcagatatcctatactttttctgaaaatggttaaaatgtaattctcatacctactaataaatacaaaataattaaaaagccactaataatgtgctattcattttttacagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatcttataaattataacatttttctttaaaactggaacatattctcattatgctttccaaaggacatattgatttagatgtgactcattcttcagtggattctacagaagaaaccatatgagagctaatttccaattcagcaacagcattttttacttctgtagttatttttttctatccaatctggctgagtcttggttgagtagttcatgctgctatttgaggtctctgggtatgaggtagggatccttaagttttctctcataatatgtcctctgttgagacctacactattaagattttcaacacaaggtaactcttggactggccttgtagtaaaaatggagagtaaacatttgacgcactttgtctgtagaagcttggtgcacactgctgctggtatctcattcgttctgtagatggacttctaatttttctctttcttgtcttgctctttcttcaatctctcatttaaacttctctacatattctatagcacgttcatttccatatgactttttagatttactacttctgttacaggcttgccaatgcaccacagtgtagcagttttttgttttctgaggtactatgtggagttatttgtcttacttccaagaagattaaggaatgcagacacaagggtgagattggagcaaaagtttaataagcaaaaaaagaaagctctgtgcagcagagagtggagcccaaatgggttgcccactatgaggctgggtctgggatttttatagactggaaaggggaagaaatgtgctgactagtctgaaggctgtcttggcaaagcatgattcagcctggcccaggaccttggcctgggaccaatcagaggctgaagtgatgattcatagaggctaaagaatgtttaaaaaaaggaagtgcccaccagaacccaccagagcccaccaggtatatgcccataaaaggagtagaggctatttcctggaagcccactaattatacaaaggactaaggcatttctatgttgggccttgttcctttatttaagtgggctaaaggtttgtgcaagtttccttatctgagtgggctaaaagttctatctgtgcagctgtgggcatatctctaggcatgactccctgtgctaattattattattttttaatccaatcagagaccttgttatatgtgggaataaggcactaaccagtgggtcgggggctctccaaaaacccttcccttgctgtttacctgaggcaagctagctaactcctctcacttcttgttccaacacctttttattcttctcaaattctttacatttctgttgtatcgttttcatagataataattcctgttgaagaacttgattgttttcagccagatacagacattttgaagatgcaccttccagttctgctataagattatcagtcttatgttttatctttttaatctgaatatccatttcaagttgactggtttttaaatatccgtggaatctaaactcttcagtttcatattcatttaacttttctgtcatttctgagtttcttgtgcatcctagttcattttgagaccatgaaaccatgcacacatttaagagcagcttcttgaatgtaagcaatatggaaatgtcttcaagtacatatgcaaccctttccactgccttaggacaaattgaaggactgaggagaaaggacttgggtcccaacaggcctttcttggaaccccgtctgaagttaagaaacactcccagcccttagcttacgtacgtgactgcacagaattgagagggctcccacaatctgcctttgaacttttcatcagtgtccttgggtcagatctttggggatgctgtggttctgaaaacaaaggtacatcccacagttctccagtgggatctgcctgtggacaccctaattcatggctgtcaacatcatgttattccaaggccgtctggaggtcatgtccagctccgtttcccatccaaacccacactgtggat

SEQ ID NO: 12858 - DNA, 50775 bp, Human
  misc_feature (1)...(50775): n = A,T,C or G
agatgggaactgtttcttcccgccctgccattcttcccatgttgagatctttcccaaaggcaaagatcatttccctttttggccatggagcactctgatggtaagaattagtcctctcatcacccaccacactcaacccgaataggaaatttccaagaatgggaaccatgtctttgggcacttaggcgagattactcaatcaaaagagtgagactcagggactgaaacattcaatcaaggttaaaaacagattaaaatgtggcagttaccttttttcccctgatatagaatacgcactggagtcacagttaccttttagtaactgatttccttgagtgaatagtgtatcagaaaatgggacttttatggtggcaaagaattcagagggcctggggcacacagatctggatttgtataccgatttgccacttaaccagctatgtgactgtgcaatttaccaacctctcagggccacattttttcatctgtcaaaaaggtcaatatggccaggtacggtggctcacacctctaatcccagcactttgggaggccgaaatgggcagatcacgaggtcaggagttcgagaccagcctgaccaacatggtgaaaccccgtctctactaaaaatacaaaaattagccaggtgtggtggcgtgcgcctttaatcccagctactcaggaggccgaggcaagagaatcgcttgaacccaggaggcgaaggttgcagtgagccgagatcgcaccactgcactccagcctgggagtcagagagagactccgtctcaaaacaaaacaaaacaaaacaaaggttgaataataataataggacctatattgtagacttgttgagaggattaaatgagataatgtacgaaatgccttactacagagtctggcacttattaaagaaagagttgatgtgggctgggtgccgtggctcacgtctgtaatcccagcactttgcggggttggggtaggaagatccttagaggccaggagttcgagaccagcctgggcaacaaggcgagaccctcgtctctacaaaaaatatataaattatccgggtgtggtggctcatgcctatagtcctaggtacttgggaggctgaggtgggaggataccttgattgcagtgagctgtgatcttgagccattgcgctccagcctgggcgacagaaggcggccgtatttaaaaaagaaaaaagaaagaaagaaagaaaagaaaagaaaaaaagggtcgttgtggaaaattcttgtggggaattaaagggaccacgtgtgcgcgaaagagcttggcgaagataagtacctggaggccaagatgaggcggcgagccctgcctccctagcagtgtggtctcctggcttagggtcagtgcttcgcacaaaaaaatccactgcctctcatgagaccttgaactgccaatgaccgcaggttgcccagactcccgagtgaggaaggcggccaggagtcaactaggcttcttgcggaaaagcccactctaagaaggcctggggcattccggctccaggcaggtagcacccgcgggcctcaggccctttcacttacccgggaaacgtaacggtccttaacggcagccaataacggctcccagcggcccaggcactggcaagggcaggctgaaatcaaacctcggattttggaacctccacgcctgaaaccctaaaccagcatcgaactacaactcccatcatgccaggcggccgcccggttcccaagggtcggtcccaccaaccttgcgccccttctttcctcaaagcgtggccgaatgcctaggcttccgggtatcagtggccccgcctcttaatccgaccggagccgtccctcgtgattcctgggtattgtagtcagtttcctgggaaagagtcgctcctagtggcagctcgcttcgccagaaaaactacaaaacccagaatgcagcgcaaattccccttgtccaataggaaccccccatgtagtggggcgcggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccgggggtaacgaaatcctcggagtccaattcccgtccagcctcccacaacctgggtctctggggtgcggggaagtcaccgggagcttagtctagccccaccctcatgttcttattggctaagtcactaggattctgcctggcgattggttattgcctttgtcatttaccaagggtgggtgctctggatattaagggccggagacgttcagtacttttattatataaaagttctatgcagtgttccactcgtgtgcttcaggccattcctgggaaaagagcatgttggacgatggttttcgatggtacaacacaggacagtctagtaacagtacagttcaaagggaacgttacttatagacgtgttgtttgaacaacgtgactagcaataaacgaatcataaaacatttcgcagcagttcaccctcagtgaggaaactcatcagactatacaaactgtatgtataattatattgtaaaatatcactaccagagaatcccaaaatataaactcaccttataaacctatgtaattaacggtatggtaatgctttgatttacatagtttccattgctccaaataatccataagtatcctgaacgatatattaatataattaagtcttcgaacatctttgccttgttacctttgcagagcagccccaggcttcaagaaatgagcgatgttgtttcttggagagtatttggaatcctcgggctccatactgcctatcctgtactttagggtcttgccattagttactatttgttcctagggatgaagaaacacaccaggcatttgaatgttgaattcttttcccaaattagtttttacttctgtaagccacagcttattcatctttcttcacatggttagtgcctggcactggcactcacgctgtctctccccatcttcctgtctatatttgtagatatatttttaaactgaaagtcgtgagagatttttgggtgtataacttgctgagtctgaggtagtctgattttcgtagccagcttgttattcgcagtattggtggcagtgcagatataaaggtataaagaccaaggactgcgtagaagagatggtcccacaagattatagtacatatttttattgtatcctttctatgtttaggtatgcttagatacacaaatacttaccattgtattatagttgcctgcagtactcagtaacatgcagcagcctattgctcctaggctacaaacctgtatagcatgttactgtaatgtacaccatatagcctaggcatttagtaggctataccatctagatttgtgtaagtacaccctataatgttggcaaggcaaaaatcacctaaccatgcatttcccagcacatatgcctgacgttcagtgaagcatgactgtatttaagtggtttataatctgcttgtggtaaatcttaggttaaaagatctagcttttatgttcttcagccggcattaaaaatcacaggaagggccgggcatggtggctcatgcctgtaatcccagtactttgggaggcagatcacgaggtcaggagatcgagaccatcctggctaacactgtgaaatcccatctctactaaaaatacaaaaaatttagccgggcgtggtggcgggcgcctgtagtcccaactactcgggaggctaaggcaggagaatggcgtgaacccaggaggcagagcttgcagtgagctgagatcacgccactgcactccagcctgggcgacagagcgagactccgactcaaaaaaaaaaaaaaaaaaaaaaatcacaggaagaaagtagaggaataggaagcttgccaaatttagtttttataagactgttctgttgctgtaactcacaacagatctaatgtaataaaagtcttcttttgaagtttgatattcctaaaaatggaagagctgagaaagaggaagtaggaacaggaagaagggaaagtgaagctctcctgagtagagatctgaatcacagatgagagttggtgaatgtgaaagtcattccagaagtgaaagtgtggcattttctttgctctttttgtagttgcttttatttttatcttcttaactgttgtcctgaccagtgtccttaggtttgtgccctataatctgtgaatcacttttcaaaactgtgtgccagaaagttattttattggcctggcgtggtagctcacacctgtaatcccagcactttgggaggccgaggcaggtggatcacttgaggtcagcagttcgagaacagcatggccaacatggtgaaaccccgtctccactaaaaatacaaaatttagctgggcatggtggcgtacgcctatagtcccagctactccggagactgaggcaggagaatcacttgaacctgggaggtggaggctgcagtgagttgagattgcaccactgcactccagcctgggcaatagagcaaagccctgtctcagaaaaaaaagtggcacacagtggctcatgcctgtaatcccatcactctgggaggccgaggcgggtggatcacgaggtcaagagattgagaccatcctggctaacatggtgaaaccctgtctctattaaaaatagaaaaattagctgggcatggtggtgcatacctgtagtcccagctactcgggaggctgaggcaggagaatcactcgaacccgggaggcggaggttgcagtgagctgagattgcgccactgcacaccagcttggcaacggagcgagactccatctcaaaaaaataaataaataaaattattttatttgtagtagaagtaagtgataaccttaaaaactttgacagtttgcagtggtgtctctgtgcatggttatggtctgggtgaaaaaattatgtttattagcgtcccaaatctaaagatctgtgaaaatgagtttggaggtagtaggtgaaaaaccaagggcctagtctggaggagagagtctaattctggcactaagaatctggggtagagtcaacatttttccatgaactttgagaggaaatggttttggggagaagcagcaatgtgggaaaatgcagcacggcacagtagaaaagcatggactttggaataatttaaatctggtctgaggccaggcgcggtggcgcacatctgtaatcccagcactttgggaggctgaggtgggcagatcgcttgtggtcaggagtttgagaccagcctggccagcatagtgaaacctcatctctactaaaaatacaaaaattagctgggcatgatggcaggcgcctgtaatcctagctacttaggaggctgaggcaggagaatcacttgaaaacaggaggcagaggttgcactgagctgagatctctccagtgcactccagcctgggcgacagagcaagcctctgatctcaaaatctcatctcaaagcttggctctgacacttaacagtcctgtgaccttgggaaaggtacttaactcagagttgtagggattaatgagataacatctggaatgcactccttttcctccctcctcctctttcttcagatcgtccctaacctcccagcttgcccctctgctcttatcacatactgtattgtagcttttatcgtaacaatagttataataacaataaatataactacatgtttggtaatttttcttaatgtgtctggtacctgtctcatctgacagtaaggagcatgtaaacaggattgtgtcttcgaaatgcctagcacttagtgggcattaatgagtatttgctgtatgaatgaatggcagatattaaagtgcctagcccagtattagtggagtttcatctcccctcaccaagtgagaggatgtcagatttttcttacatacacattttctctccccaaataattctcattgtaagcctcactacagtttttatgaaatacctacagaggcagggcatggtggctcacacctgtaatcccagcactttgggaggctaaggcgggcgggatcatgaggtcaggagatcgagaccatcctggctaacacagtgaaaccccatctctaataaaaatacaaaaaattagccaggtgtggtggcgcatgcctgtagtcccagctactcgggaggctgaggcaggagaatggtgtgaccctgtgaggcggagcttgcagtgagccgagattgcgccattgcactccagcctgggcgacagagccagactctgtctcaaaaaaaaaaaaaaaaaaaaagaaatacctacagaaaccaggaagctccaatttgctgtggagctttccactgttgtgtgctttccactgtgttttgcttcttgaaatgttttttgtcttaatattatttaaaatgttctcaaaaatcatgtaaaaattgacagagaagttttcctttcaatgctagagagtctaaaatgtgtaatatataataaaggttaatgatagttcgagctaacccttattctcctgggcctttttttttttttaaagagactgtgtctcgctatgttgctcagactagtctcaaactcctgggttcaagtgatcctcctgccttagcctcccaaagtgctgggattgtaagcatgagccaccacacccagcctcctgcccctttttttcaggaactaaagtcatagtactctatgctaataaaatgagctaaattcatgtactggattctgttgcccgggctggagtgctgtggcgcgatcttggctcactgcaacctctgcctcccgggttcaagaaattctcctgcctcagcctcctgagtagctgggactacaggagcacactgccacacccggctaatttttcatattttagtagagacggggtttcaccgttgttgcccaggctggtcttgaactcctgagctcaggcaatccacctgccttggcctccgaaagtgctaggattacaggtgtgagccaccacgcccggccagttgtattagttacttatgtctctttgtatatgaatttagttcttgacttttctggtcttgtgtttcctccgtaattaaatcagcataaacatttggtgaatataaaacttcatgtggttgtgtgtagtggctcatgcctgtaatctcagcactttgggaggctgaggcagaaaaatcacttgagctcaggagttcgagaccagcctgggcaacatggtgagaccccatctctataaataaaaacaaaaaaacccaaacccttcatgtatacatataggtatacatgcatacatatgcagtgtgtatgggtgcgtctcttcagtttttctatttaaaaattttttaatttaattttaaaattattgttattactttggaaacagggcctcgctctgtcgtccaggctatagtacagtggtgtgatcatggcttactgcagcctttgacctgggctcaagcgatcctcccacctcagcctcccaagtagctactaggattgtagacatgcaccatcatccctggctaattttctttttaaaaagtttctgtagagatggggtctcactatttagcccaggctggtctcaaactgctggcctcaagtgatgctgccaccttggcctcccaaactgctgggattgtgggcataagctcctgcatccagctggttttgtttgtttttttactgcactcaatttcccccagttacgtgcctagcgtaattatcctgaacaattgagaggagagtcagataagataacctttatgcagcatccccctgtagttcgtgattcatctatatggtttaatttgatttttttttttttttaatgagagtctttccaagaagtattgccaaagaataaatctcatcagttggcagattttaatttgggggtaataagtgaagattgtctgagtgttttggaacaaaaaagaacttttagactattgtgttctaggaatctttcggaatttattttgcagtgtcttcagtgtcattgagatcctggtaagcacgggtcaagagccctctgacaagaggtgtctcatctccatcctgctctcttactccctgggacaggttaacatggattctttataagttctcctcatttcctggttgtgagatactatcccttatgaaaacttaggaggagagaaaagtctttctgaaaataaattccataaagctagccttacttgtttttgtttttttcttcagcttctccaagagtcgttctttccctatttatttgatggcttatagctgcagctagctcttggaaataagaaatctttttagttcctttttaatttctcccttcaacttttggtttttcaaaactagatcaaagcagaatggaaagagaaacctcatcactgatatcaaataagtgttctaattttgtttcccaattaaatggcaattaaaaagaaactaatcaagagctgcttcaaagagaagagactggaaagcagaagaaatggaaagtaaatgagagcctatttcagggactcgctgctcatggcacagcagttttgctgatttttcacattgttcaactaatatgctcacgctaaaattccccagctttactaagttggcagttaaccctttccctatagagcccatagatttatgagccatacatttagtaacttcaggaggatgcttctttaactctttctcttcagctttttatctgaaatctctacccttcaggcctctcttccaattcctcaaagaagatgtccttgtgattgttacatttaagggacaaaaatatggtgttctctattgagagcgccaaaaatactaaaccggaattcctccataggctcagtatttgcctcaaaaatgtcccagcactttgagaggctgaagtgcgcagatcacttgaggtcaggagttcgagaccagccgggccaacatggcaaaaccccatctctactaaaaatacaaaaattagctgggcgtggtggcacacacctgtagtcccagctacatgggaggctgagacaagagaatcacttgaacccgggaggcagaggttgcagtgagcccagatggcgccattgcacttcagtctgggcgacagagagagcctccatctcaaaaaaataaacagaacaacaactttctagagctgctctcttgagagacaactgaggagtcactatggttaagtgtttagtaaatgttactattattactacgtagtgggcattgtgctaagccctttacttggattatatcctccatgatttcacttatgaagactttagcgatttttgtttgtttgtttctttttttgagtctcactctgtcgcccaggctggagtacagtggcacgatcttagctcactacaacctctgccttacaggttcaagcaattcttgtgtcttaacctcccaaatagctgggatcacaggtgtgcaccaccattcccggctaatttctgtatttttaatagagacacggttttgccatgttggtcaggctggtctcgaactcctggcctcaagcagtccacctgccttggcctcccaaagtgctgggattattacaggcgtgagccaccatgcctggactttagttttttgtttttttgggtttttttgagacagagtctcactctgtcgcccaggctggagtgcagtggcgcgatctcggctcactgcaacctctgccacccaggttcaagcgactctcctgcgtcagcctcctaagtagctgggattacaggtgcctgccactgtgcctaactaacttttgtagttttagtagagacggggtttcaccatcttggccaggctggtcttgaactcctgacctcgtgatccatcctccttgtcctcccaaagtgctgggattacaggcgtgagccaccatgcctggccagactttattttttattatttatttatttatttatttatttatttatttatttatttttgagacagagtctcgctctgttgcccaggctggagtgcagtggcgtgatcttggctcaccacaacctccacctcccaggttccagtgattctcctgcctcagcctcctggatagctgggactacaggcacatgccaccacgcccagctgatttttgtatttttagtagagatggggtttcaccatcttggccaggctggtcttggaactcctaatctcgtgatctgcccacctcagcctcccaaagtgctgggattacaggcatgagccaccactgcgcccagctagactttagtttttatagtgaggcttgagatttgcatctccactggtctctttgacatctcagaggatccattctgaacttgctaggtttctttcccctgctgaattgagttctgcatcttgagtctgcagcagtgtgaatcctatctttggctccatttaacagcctatggacgttcccaaacttgggacccagtttgtctcttcatgatagacaaatattattttcagaagtcattctaatcgcaccactgcactccagcctggcaacagtgagactccatctcaaaaaaaaaaaaaaaagtcattctagtaggtgagatttctgccagcattgagccactgctcaacatattcttgataatggtctctgaacagcatttgattttaccttggagttgcaaagtcaaagtctaactcgccaaacaaactcagtgtggaatatacacatttgtctcattccggttttaaggagtttagtataccagagcttttgtgacctctaaaaagcagttatcgtccatgacaagaattggctcgttcaccctcagtactctggcttactatcccagggagggccgagggtggcagcaaaagtggtcttttgtaatccctttttataacctgctgttctcttcacagacctcccagggtacctttttttgtgtgtgtgtgtgtgagatggagtctcactctcacccaggctggagtgcagtggcgtaatctcggctcactgcaacctctgcctcctgggttcaaactattctcttgcctcagcctctcaagtagctgggattacaggcacccgccaccatgcctagctaatttttattttttatttttgagacagagtctcgctctgtcacccaggctggagtacagtggcgcggtcttggctcactgcaagctgcgtctcccgggctcacgccattctcctgcctcagcctcctgggtagctgggactgtagtcgcccgtcaccacgcccggctaattttttgtatttttagtagagacggggtttcaccgtattagccaggatggtctcgatctcctgacctcatgatccgcccacctcggcctccctaagagctggaattacaggcgtgagccaccgcgcctggccaatttttgtaatttttagtagagaagggttttgctatgttggccaggcttgtctcgagctccagaccttaggtgatctgcccgccttggcctcccaaagtgctgggattacaggcatgagccactgtgcccagccccagggtaccttgatggcagtactaaagtgtttttatttttcccatcatttgggattcacaagcagtttttgatataactaattggtgggaatgtgcggagttgggggtattgcactgagtgatccttagccgcagaagtacagagactagacagctgatactgattcatgccatgtcatttccttctgggcatctttgccatttcattcacctctctttggtctttctgagtactaataggattattagtgaacttaccatacttcaagagttaattgatttgcaaaaggatttcctgatgtctaaaagtagaatcaaaaggatattagaggttagagtttattttaataagtttctctggaaaatttgaatttctgcccaaaaaattcattttttatttgagacaaggtttcactctgtcacccagatcgtagtgccatggtgcagtcctcctacttcagcctcccgagtgactgggactacaggctaatttttttgtctgtgtgtgtagagacaagatctcactatgttgcccaggctgatctctaactcctgtctttttgtttttcagaggtagaaaacaagtggtggctggtccaagtgcagtggtgtttacgactaatttgtcataaccagttatagatttctttgttccttttccactcccactgcttcacttgactagcctttgaaaaataaaagtaaaaagcaagtggccatgagatctgagagctacagtgaaaaagaaaagtggccaaatttgtgaattttatttcccaaacttttttttcttatgttgtaaacctgtggtctgtgtttaagacattgaaaccattagaagtagttacattagagcttttttgtttgtgctttatttacttattagagatggggtctcactttgtcacccaggatggagtacagtggctattcacaagcgtggtcgtggggcactactacatcgtgagactcctgggctcaagagatcctcccgcctcagcttcctcagtagctgggactacaagttcacaccaccacacctggctggacctgttttagcttctcaaggagtaggacagagcctaaggagagagaagacaatgaataagaaaattagggctggacatggtagctcacatctgtaatcccagcattttgggaaattgaagcaggtggatagcttgagtccaggaattcaagaccagcctgggcaacatagagaaactttgtctctacaaaacatataaaaattagccaggtatggtggcgtacgcctgtagtcccagctacgcaggaggctgaggtgagatgatcgcttgaacctgggaggttgaggctgcagtgagccatgattgtgccactgcactccagcctgggtaacagagtaagaaactgtctttacaaaaaaaaaaaaactcagtatttttttatttgagatggagtctcactcaggctggagtgcagtagtgtgatctcagctcactgcaacctccccctcccaggttcaagcgattcttctgcnnnnnnnnnnnnnnnnnnnncccaccttggtctcccaaagtgctgggattacaggtgtgagccaccgcacctggcctatttttttttttgagatggagtctctctctcttgcccaggctggagtgcagtggcgcgatctcagctcactgcaagctccgcctcccgggttcacgccattctcctgcctcagcctcccgagtagctgggactacaggcgcccgccacgatgcctgcctaattttttgcgtttttagtagagacggggtttcaccatgttagccaggatggtctcgatctcctgacgtcgtgatccacccgcctcggcctcccaaagtgctgggattacaggcgtgagccaccgcgcctggcctattttttttaataaaaaaagaaagttgataatttaaaatcccaatcagtagctcaagagcacagcatttccattgctctcatagaatattaacacagctgtcctgtgcaaacagaactgaagatgttttgctgaccctcttttgggctctagcttttcaaggtcttattttagtctattatgcctgtaaagcatcagtcaagcatataattgttgaactgttaactgtgtgctcagcacaactagaggcgctgtgggaagcagctgtataagatgtagtctggccgggcgcggtggctcacacccgtaatcccagcactgtaggaggctgaggcagatcacttgaggccaggagttcgagaccagcctggccaacatggtgaaaccctgtctctactaaaaatacaaaaattagccaggcatgatggcacatgcctgaaatcccagcttttcaggaggctgaggaagagaatcgcttgaacccaggaggcggaggttgcagtgagccaagatcacgccactgcactccagcctgggcaacagagcaagactctgtctcaaaaaaaaaaaagatgtagtccctattcttaggaaattgttaatgtcatcgggaagccaagaaagcaatatattattatatattaagtgttttaggagattatagttttaaaacaggcagacatcagagaactagaatagtcagagctgactttctggataaaacatgactcactttcctcattacttctaatgcttgctcctctcaaacaccaaagctgtgttctatagcccagtgtgaggaaacaatattctcttggctttggaggattctcaaatcaattcttacagggaacgaagccatagcctttggggggaaatggccccaagccaagtctttagagattgatggctcctccctagatgctagttggttggttgataaccaatttgcctcacatctctgggccttagtttcctcatctgtaaacaacaagttaagccagatggttctgagattccagtgttggaagctcagcttcccctcccctacgatagagctttttcttcccaggcatgcagttttgagcggattgcatcatccagtaagactgagaggaggcccacatatggaccctcgctgctcctgttgtctagaagttcctcttctcctgccgttcatctgccagcttacccttacctcccacccgctcacatacccagcattgcgctctatttctagaaataagtactgaagttagttttccatctcctccccaaggtctgaatttatacaggagcatccttaggatgtcttacatctttgaacttgtaacattttggtcttcattaaaagatgactttttttttttttttttgagacagagtctcgctcagtcgcccaggccggagtgcagtggctggttctctgctcactgcaagctccgcctcctgggttcacgccattctcctgcctcagcctcccgagtagctgggactacaggcgcccaccaccacgcccagctaatttttttgtattgttttttagtagagacggggtttcaccatgttagccaggatggtcgcgatctcctgacctcgtgatctgcccacctcggcctcccaaagtgctggtattacaggcgtgagccatcgtgcccggccgagatgacatttcttgattgcttttctgctctgttcctggatcttttattctaattcaccctgtatttgctaggttggtcattgatgacttcttgagttgatcaactttagaatataagtctcacaatttttgtatgaactgccatctgccttctgggggaggaggcacttctgttgctgcaccaaggcaaactttactgaattctctactctttattttggaaccaagtgaaacaagttggactttggtttgctgtattctaagattctggttctggccaatctcagtttgaaataaggtgactggcagcttagatctgtgagagatttctatttcagtgtgccgaatcgcagcatgccctaggattcccacccagtgggtgtggacttcaaatccctttaaaaaggatgccagccaggcacggtggctcattcccataatcccagcacttttggaggccaaggcaggaggattgcttgagcccaggagtttgagcccagcctaaaattagccaggcatggtggtgcacacctgtagccccaattactcaggatgctgaagcaggaggattgtttgagccaggagttggaggcaggagctggaggctgcagtgagccatgatcgtgccactgcactccagcctgggtgacagagcaagaccctgtctcaaaaatgaacaaacagccaggtgcggtggctcacgcctgtaatcctagcatgttgggaggctgaggtgagtggatcacttgaggtcaggagtccaagaccagactggccaacatggtgagaccccgtctctactaaaaatataaaaattagctgggcctgatggtgggcgcctgtaatcccagctactcaggaggccgaggtgtgaggatttgcttgaacctgggaggtggaggttgcagtgagccgagatcacaccactgcactagaggctgggcaacagagcgagactcttgtcttaaaaaaaaaaaaatggctgggcgtggtggctcacgcctgtaatcccagcactttgggaggccaaggctggcagatcatgaggtcaggagttcaagaccagcctggccaacatggtgaaaccccgtctctactaaaagtatgaaaaattagccgggcatggtggtagtcccagctactcaggaggctgaggcaggagaatcgctgaacccaggaggcggaggttgcagtgagctgagaacacggcactgcactccaggctggcaacagagcaagactccgtctcaaaacaaaacaaaaaaagaggccaggcacggcggcttacgcctgtaatcctagcactttgagcggctgaggcaggcagatcacctgaagtcaggagttcaagaccagcctgaccaacatggcgagacctcatctctactaaaaatacacagattagctgggtatggtggtatgtgcctgtattcccagctacccaggaggctgaggcagaagaatcactggaacctgtgatgaggaggctgcagtgagccaagattgtgccattgtactccagcctgggtgacagagcgagactccatctcaaaaacaaaaaacatgaatcaagaaacaaacaaaaaatgatgccagattcctggagaaggattagcctggcttctgtggggtcctctagttttgttttcccttagtccaaattgaggccattcttctgtgaagtggcgttggcttgctaggatgctttttgaagttctactctcaaggcctctgagcttggttccctatgaataattaaaattattataattaccatgaaagctaactggagtgggctccttggaagtctggttttgctgaattggttgtcttctgtttgggggtgttgactgtaagactatgtgtactcataatgtgtcctcacggatggggctcaatacttggtagctcagtgaaaatgactcattaaagaaaaaaaaaaaaaagtggccaggcacggtggctcatgcctgtaatcctagtactttgggaagctgaggcaggtgaatcacctgaggtcaggagtttgagaccagactgaccaacttggtgagaccctgtctctactaaaaatacaaaaattagctgggtgtgatggcacatgcttataatcccaactacttgggaagctgaggcaggagaatcccttgaacctaggaggcggaggctgcagtgagctgagatcgtgccattgcactccagcctgggcaacaagagtgaaactctgtctcaaaaaaaaaaaaagaaaagaaaaaacaacttccctgtgttcttcagccgtgtgcttgatgtacaagttgaaacaggatttttgctcagtaactggctgcttgtacaaattcaagccaatataaagaaaatgaaatttgctctctgattttagtttcggtcttggagatttctagatacttgtattggcaatgcataaagcagaacaagagttcagcccaagatccttccacaaaaattgggttcatgaggtgatagctacatggaagtatctccgctaaataggaagaacaaaggcaggaaggtagtttttacagtgattttgcatatttgtaaagacttttaaagttggaagaagtaattattttccccatgtgaaattatgtttagtaagtatccagttggttaatctacagcagttcttcaccttacctttttgattctttcttttgtagaattataaaaagttattcttatggtaattcatattaccataatttgttccataagctgttatggaaccagctaatttgtggttatggaccagataatttgttccataagctgttatgaataagaatttatattataaattgtatccaacaatgggacactgctttgtctcctaatatcagccaggtcttgtttgtttgttttttgagatggagttttgatcttcttacccaggctgtagtatagtggtgcaatcttggcttaccacaatcttcacctcccaggttcaagtgattctcctgcctcagcctcccgagtagctgggattacaggcatgtgccaccacgcccggctaattttgtatttttagtagagacagggtttctccttattggtcaggctggtctcgaactcccgacctcaggtgatccgcctgccttggcctcccaaagtgctgagattacaggcgtgagccaccgcacccagcctatgagccagtttttaaatcttataatgcttcacgtaatcctgagactgaagtgaaaatatctggagtaggaaaaccacagagttgtcctaggctgcagatggtcctgtgtgcaataacaaaattgagttactaagaagaagaagttatctttaggccataaatgactttatggtttctgttgtttgccatggccttgggggttttgctgagcatctggttttaaggaagttaccttatttcccctttgaatgttctcagtcttccttccatgttaatgccttctgggtctcattaatatcataccaagtaggtgtacttgcatctagacttcatgaccttatgcttggactaaaggaaccttcagacttaactggatctctccctgtcacagtctttctgcatcaggggcactgagaggcccggccagatggaagctgtgggaggcaagagtggacagcgtaagtgggaaatgagggtgataggcctagggaaaaattgggcttgataccttccaagttaagaagccgctgttactctaggatttcaagcatgggggggacacatggaaagccattttcacagaggtgagtcccacagctatatagagttcaggtgatgcagaaagattgtgaaggcaaagagatccagaaaaggctggaggtaacttaagtccaagggtaaggtcatgaagtctggatgtgagcattcctcccaggaacaggaagagataggagaatctgaagacattctgtgaagagaattggcagcatgtgatttcagatcactttctccctgtatatatatatatacacagtatctgtctgtgagatgatagtaatattcataataactccaaggcattttgagaccctgaagtctttctgaattataaattgtatttaacataatgttaatggaaaattgtattttatattgttttaattcttgggggttttggtgtttttttgtttgtttgtttgtttgttttgagacagtgtctggctgtattgcccaggctggagtatagttgtgcgattttagctcactgcaggctcctcctcccaggcttcaagccaacctctcaactcagcctccccagtagttgggactacaagtgtgcaccaccacacctggctaatttttggatttgtgttagagacggggtttcgccatgttgcccaggctggtctcaaactcctgagctcaagtgatccgcctgccttttcctcccaaagtgttgggattacaggcatgacccaccatgctggacctttcaattatttgaaaattgattgtctaaaatatacagttaaaattacctctgtgtttagctgattctacagattaggattcactgtactcaggttggactcctaattttgacttttctttttttcttttcttttctttttctttttttttttttccccaagatggagtcttgctctgtcgcccagagctggagtgcaatggcatgatattggctcactgcaaccacagcctcccgggttcaagcagttctcctgcctcagcctcccaagtagctgggattacaggcgcatgcctccacgcctggctaattttgtatttttagtagagacggggtttcaccatgtgggtcaggctggtctcgaactcctgacctcatgatctgtccgccgcggcttcccaaagtgctgggattacaggcataagccaccgcgcccagccaattttgacttttcagtgtggctaagaggctgagcatggtggctcacacctgtaatcccagcactttgggagttcaaggcagcaggatcactcaaacctagaatttgagaccagcctgggtaacatagggagacccctgtctctattttttaatttaataaaacattaatgaggctaagaaactttttgcttcattcatggggtgtgtcatgtaggggaaagcagcacaaggaagtccccttgatcacgtgcacacatgcacacgtgcatacacacagacatgtttcttttatttatttatttatttttattttttgagacggagtctcgctctgtcgcccaggctggagtgcagtggcgcaatctcggctcactgcaagctccgcctcccaggttcacgccattctcctacctcagcctcccaagtagctgggactataggcgcctgccaccacgcctggctaattttttgtatttttagtagagacggtgttttaccatttagccagaatggtctcaatctcctgacctagtgatccgcccgcctcggcctcccaaaatactgggattacaggcgtgagccactgcgcccggccacatgtttcttgtaatctctccatggcaggagtaactgggtgctattgttgttttagtttcccaagattcctaatgctgggttttgccagtggtgatccctcagtctgagcttgccgacagttgtcctcaatcctgcagatctggtttaggcatttcttttttttttcccttttttttttgagacggagtttcgctcttgtttcccaggctggagtgccgtggcgcgatcttggctcacaacaacctctgcctcctgggttcaagcgattctcctgccttagcctcccgagtagctgggattacaggcatgcgccaccatgcccggcttattttgtatttttagtagagacaggctttctccatgttggtcaggctggtctcgaactctgcacctcaggtgatccgcctgccttggcctcccaaagtgctgagattacaggtgtgagccaccacacccagccttttccttttttttttttttttttttgagacagagtctcgctttgtcacccaggctgaaatgcagtggcatgatctcggctcactgcaagctctacctcccaggttcacaccattctcctgcctcagcctcccgagtagctgggactacaggcgcccgccaccgtgcccggctaatttttttgtatttttagtagagatggggtttcaacatgttagccaggatggtcttgatctcctgacctcatgatctgcccgcctcggcctcccaaagtgctgagattacaggtgtgagccaccgcgcattgctgccttttcctttttttgagacgaggtctgtctctgtcatacaggctggagtgcaatgacgtgatctcaactcactgcaacctccacctcccgggttcaagcagttctcctgcctcgtcctcctgagtagctgggactacaggcatgtgccaccaggccccagctaatgtttatatttttagtagaaacagggttttgccatgttggccagtctggccttaaactcctgacctcaagtgatccacctgcctcggcctcccaaagtgttgggattacaggtgtgagctaccacgcctggctgatttgggcatttctcatgactgaccattttggacacagattgtggcaatgttaatgtgcctttttcctcatccctcactcccttttcatactgtcttgtgctccagatccagctggggaaaatcatgaaacctaatacatttgggaggtggaggaaggaagggcaaagcattccagaaagcccatcactgccttttggctgtcatccttttacattcagagttcaaggaagtattgtggtatgaatgccttgttaacaattatcattcgtctttggtgccattaccctggcaatataaagaaaataagcaacataaaagcaagaacggaaaaggccctttcacacaaataggacatcccttgcccagcactccctccctgaaagccgagggggcgcgagtcaggaggagtgctggtgtcctccaaatgccctttctggacctgggttcttcagcctgcttctgaagccaacaggcttgattaaggaaggtctggctccacagaaagctctttgtcaggggtagcacaaaacagattttttttaaaccctgcattagtatttactttttgttacagtggtttgagtccagccaatgacactggagccaaaaagaagaaaaagaaacaaaaaaagaagaaagaaaaaggcagtgagacagattcagcccaggatcagcctgtgaaggtaacaaggaggttctgttttttgtgactcagtcactttttcacatgagagagttttgaggtgaatgtataggatcaacttggattgacgttctccactggtattacttcaagatggaagagttggatcccagtgctgtcctctgctgccctagacctaggtgatgaaactgctctcagtaccctaaaagacacagcaggtcagacactgactcccaagcatggtgcccatcagaatggacaggtgcgtactgcatgtgctgctgtgccagtgccctggggagctacgtgtgacagcccctggcgcctagagcagtggttctctgtcttaagtccccaccgctctgacaatgaaaggccccccctttctttttgagacagagtcttactctgttgcccaggctagagtgtagttcatgattatagctcactgcagcctccactcctgggctcaagtgatcctcccacctcagcctcccaagtagctgggactgcaggtgcatgccaccacacctgtccagtttttttttttttttaattttttgtaaagatggagtctcactatgttacccaagctgggtcttgaactcctgggctcaagcaatcctcctgccctagcctcccaaagtgctgggattacaagcgtgagccactgcattcagccaaagacttcttcttaagacctttatatatttgcaaacattctcttaatgccatagtcattataatgaaagccatgagtcccacagagtctttctgagttctactccatgagaaccactggcctaaaggcttacaacctgagagtgatgcactggcatgaaacccagagatatgggtaaggattgttttgtttcttaaataaaacaacattacaaaataaaacaattgcaggtaagtgttgtcttcttcaaagtaggctgacagaggcagggggacaactcaaacatattcataattcaccttttaaaactgcctctgagacctggggtggtggtttatgcctgtaataccagcactttgggaggccaaggcgggtggatcacctgaggtcaggagttcaagaccaccctggccaacatggtaaaaccctgtctctgctaaaaatataaaaaattagttgggcgtggtggcaggcgcctgtaatcccagctacttgggaggacaaggcaggagaatcgcttgaacccaggaggcagaggttgaagtgagctgagatcacgccactgcactccagcctgggcaacagagtgagactctgtctcaaaaaataaaaattaagtggccaggcatggtggctcacgcttgtaatctcagcactttgggaggccaaggcgggtggatcacgaggtcaggaatttgagaccagcctggccaacatggtgaaaccctgcctctactgaagatacaaaaaaaaattagccaggcgtggtggcacgcacctgtaatctcagctactcaggaggctgagacaggagaatcacttgaacccaggcggcagaggttgcagtgagccgagatcacgccattgcacttcagcctgggcgaaagggtgagactttgtctcaaaaaaaaaaaaaaattaaaaaaaaatttaaaaaaaggaacagcctctgaaacagtttataagcctcgcaaaaatccatattcattccaatatacccacactttgctgtatgcctcaaatgttatgcctcagcttgaatctgctaccttattgagatatgacttcaagtaatttttttactatttccaatataaaacccgctatgaaaaaataccattattatttaataccatgttgcacttcatttaaattagctccaaaccatcaccatccctacaaggtaggtaggggtcttccctttttattcatttaatttatttttgagactctgtcattcaggttggagtgcagaagtacgaacatggctgaccgcagcctcaacctcctgggctcaagcaatcttcccacctcagcctcccgagtagccaggactacaggtgtgcaccacgacacccagctaatttttttattatttgtagacatggggtctccctgcattactcaggttgatctctaactcaggctcaagagatctgcctgccatggcctcctaaattgctgagattacaggagtgagccatcacacatggccgagaatttatttaataaactgcaaggggaagaaaattaaaatgccacttcccaggcctaagcaatatgaacatattggtttatattctttctttcctttataatctaagtgaaaaacagaaaactaaataaaaatattagaagaaaatgtatgtagttttattaatctaagtctgacataggacccagaagccataaaacagaaattgacaaatttaaaactttgtagaagtcaaaagataaacaataatctgggaaaatatttgcaacatatgtattagtttaaaataattgaatgaataggcagttcagaaagaaaaaatgtgtaatcagtaaataataagatggttaaagtcataatggaagaaatgaccattaaagcaataattatttctcttagattggcatagattaaggcttggtaaactttttttttttttttgcgagacggagtctcgctctgtcgcccaggctagagtgcagtggcgcagtcttggctcactgccagctccacctcctgggttcacgccattctcctgcctcagcctcccgagtagctgggactacagccgcccgtgaccacactggctaattttttgtatttttagtagggacggggtttcactgtgttagccaggatggtctcgatctcctgacctcgtgatccacccgcctcgacctcccaaagtgctaggattacaggcgtgagccaccgcgcccggccacttttttttttttaatagggacaggggtctcactatattgcccaggctggccttgaactcctgggcttaagcagtcctcccgcctcagcctcccaaagtgctgggattacaggtgtgagccaccaagctcagctgaggcttggtaaatctaatggtgagggtcaggagctactctcatacactgttcgttggattactgatagtctctttttagagagcaaattgatgataaatcatttcaaaagtgcataccttttgacccagcaggcctctttcttaacttcatcctacagaaatatatatcccagtgggtaaaaatagatgtataagaaaatttatgctgggtgtggtggcctgtaatcccagcattttgggaggctgagttgggcagatcgcttgagcccaggagttcgaggccagcccaggcaacatagtgagaccccgtctcgacaaaaaaacaaacaaaaaaattacctgggcctggtggcacacgcctatagttccagctactcaagaggctgaagtgggagaatcccttcagcccatgaggttgaagccgcagtaagccatgattgtgccactgcactccagcctgggcaacagagcgagaccctgtctcaaaaaaaaaagaaattcactgcaacattgttgtattactaaagaacaaaatcaccaaaatgcccatgagtagggggctggctaaatatactgtggtccatacatacagtggacttggtagaatgggtaggtccaggtgttttcacctggaaaggtctctaagacagtctttaaagagcagtttgtacgataatattatatgatccaattttagtttttgaaaagtgtgtgtgcatttggaacttgtatgcaaaaaagtctggaattatatttgcctcttctcaccttcccaagtgaagactattgatcacaaagattatatttgggggatgggattgttgggtgtttactttctatgtgtcttacacatttctgcattgtttgaaatttacattgagcatgtattacttttgccatcaaacaacataagactaataaggggagaaaccctgcgggcagcacccacccatcatatagctcattgtcaaccactttttctctggttgtaatgacctctgggattaggacagaggaaccaaaccccttctttgaattgtaccctttaactctttttttttttttcttttttgagatggattcttgctctgtcacccaggctggagtgcagtggtgtgatcttagcttactgcaacatctgcctcccaggttcaagcaattctcgtgtctcagcctcctgagtagctgggattacagggacacgccgccatgcctggctaattttttgtattttagtagagacagggtttcaccatgttgcccaggctggtcttgaactcctgagctcaggcaatccacctccctcggcctcccaaagtgctgggattacaggcatgagccactgcgcccagcactctttttttttttttttttgagacggagtctagctttgtcgcccaggctggagtgcaatggcgccatctcggttcactgcatcctctgcctcccaggttcaagtgattctcctgcctcagcctcccaaaatagctaggattacaggtgcccgccaccacgcctggctaatttttgtatttttagtagagacagggtttcaccatgttggtcaggtgggtctcgaactcctaacctcaagtgatctgcccgccttggcctcccaaagtgttgggattacaggcatgagccactgcacccagctccccttaactcttgaactcataattaatcaaaagtcttactaacataatgggccttttttctccccaactttgtcttgtccagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggtatgtacatgcttgctttctttgccaggtcaggggcgagggatctgcctcagctgtgccttcatgagggtttcatgctgaattactgtagggagggcagtagagtcctggagttccttggtagttgttttcagagggtggtttttaaaaatgcagcataaagactatcattcagagaccttaccattttatagcagcacaccttgagaacaaataatgattcttgccaacagcactggctcacacctataatctcagcactttgggaggccgaggtgggaggattgtttgagcccaaaagttcgagaccagcctgggcaacatagaccttgtttccacaaaaagtaaaaaaaaaaaaaatagccaggcatagtgacatgcacctgtagtcccagctactcaggaggctgaggtgggaagatcacttgaacctgggaggtcaaggcggcagtgagctgagatcacgccaccgcactccagcctatgtgacaggagtgagacccccaactcaaaaaacgaacaaaccaaaaaacccaaaaaaaaaacaaaacaaaactattggcacatgaagagtgggaatgtctgcccagaggtcttttttccacttaggtttatagagactttgtcttgtttgtctgggcacatgtttattcctggaatgggcaaagtccccagcctcttcccctttgtctcctagccaatgcatgcttactaaatgcaaagtggtttgagattttgcttagcagtgatggttcaacaacaggaatactatatatagatttcattagcaccccttaaaaaagctataatgaattgctaaaggggtggaataggcagaatatctaaaaggattctggaagggactggatcctgttagacgtgcctgccaagactgagccaagccaaccttgatggctgacttcaggactcagctgacaaagtttctgaagtggttgtaacatgattctggacccattggtggcctagttcctgttttctttgtgactgggaaagtaagtatgttgaaaaaaacatattccaacaccaaatgtaaatgactttcagcttgtccacattactgctcccctccagaaacacaatgagacttcactagtatgttcggtgcagaggaggagggtggggcagggccagacagggtagggccaaagactggtgaggtgaggaaggcagctgtgcccaaggagatttgtttgctgcagaggttgggagcagctaatccatgaggcctgcagacctgcaggatgggcattgcctaattgctagtagaaatgcagtttgtcgggccccaccccaaagctgcagaatcagaactgccagaggatttctgtccactttgaaagttagagaagctctgctctagagcggatgcagttcttagaagcttggtcacaatagaagcaagctgaggaggtgcatccccacgggtgagggagagcagagcactgcccaggtggacaagaggggtgctgattcccccatcaccgtgtgtgtttggctgccctcatcggccaggtcccaggcccactggctaagccctccagcaaggctttgggccacagggtagggtcccagtgaccagtttctcgctgaggagcaggaaagatgcagagagccacacatctcacctctgaatgaaatccctgatgaggtgttgtgtggtggctgccatgtatcttggctctgttttcagatggcattttggagttttggtttgattttatttttcctgaggaatttgcaaatgagtaaccttgctacattcttcacagatagtggcacttgggaaagaggcagattgaggctgggcgcagtggctcacgcctgtaatcccagcactttgggaggtcgaggcaggcggatgacctgaggtcaggagttcgagaccagcctggccaacatggtaaaacctcgtctctactaaaaatacaaaaactagctgggctggtggcatgggcctgtgatcccagctacttgagagtctgaggtgggagaatcacttgaacctaggagacagaggttgcagtaagctgagatcgcaccactgcactccagcctgggcagcagagcaagaatgcatctcaaaaatgaatttaaaaaaaaaaaaaaagaggcagcttgggattaatttgcttctgttcctcttcagcccagcatactttgttttcctttcacctgtaaatgtagaaagtgcttcagtttagttctcagaaagctcaagagaaaaccacacagttgctcatacgggccctgacactttgaggaaggaggaacaaggtctggttttatttcttctggctttgccttctgtgcagtgtgtggtgtcggactccatggaagagcagtcaccctgagcatctgactagtctgcctttgaggtccagggtcagtcaagccccagttagattcctttgtttgtgtcagcctgtaaaaagtgccaccttggcaggcgtgttagcctgcatggctgaggcgtcaccctagttctgagttttctcaggggtggtggtacctacagcttcttgccctaatttttttttcacttaattggaggactaatgattataaatctcgtgcatatcagctgcactgtgtttttacagtactctccaccttcttgggagagttttaattagatggtattccactaaagaaacctacaagtctctctgatttatttatttatttatgagacagagtctcactctgtcgcccaggctggagtgcagtggcgttttctcggctcactgcaacctctgcctcccaggttcaagcagttctctgcctcagcctcccgagtagttgggattacaggtgcccaccaccacgcccggctaatttttgtatttttagtagagacagggtttcaccatcttggccaggctggtcttgaactcctgacctcgtgatccacgtgccttggcctcccaaagtgctaggattacaggcatgagctaccgcacccggccctctcttttattttcttgagacaggatctcgctctgctgcccaggctggagtgcagtggtatgatcatggctcactgcagccttgatctcctgggctcaagcaatcctcccaccttagcctcctgagtagctgggactacaggtgcctgtcacatgcctggctaatttttaaattttttgtggagacatggtttcactatgttgaccaggctggtctcaaactcctaggctcaagctgtcctcctgtcttagcctcccaaagtgctgggattataggcgtgcagctgcacctgactgagacctgcaattctttagaagcttaaaattatcctaggtttaccatggaaaggccttcttaggccgggtgtagtggctcaatgcctgtaatcccagcactttgggaggccaaggcaggaggattgcttgagcccagcagctcaagaccagcctggacaacagggaaagacctcgtctctacaaaaaaatttaaaaattagccagacatggtagcacatgcctatggtcccagtttctcaggagactgaggtgggaggatcgtttgagtcctggaggtcgaggctgtagtgagccatgatcgtgccactgcactctagcctgggtgacaaagcgagtccctgtctcaaagattaaaaaataaataaataaaaatgaaaggccttcttagcagaagtgttttagtctgtgtaacaactgtaagagccgcagatgaacttttgatcccccactcgagatcatgtcgttcttctttttaaagtcacccctttcccactcatgtcaacggaagcagtatccttttctgtctttggtcagtggaatgcagtgtggccactctgttttaaaaagtcactatcaaagggaggatgtgcactcacctggtttccatgggtcccagagagaagcttcccctctctttttcctctccttggcctttgtttggtttaatgttttccgcatctcagacattctcatttctccgaagtccttcacagttgcaccgcattgcttagttttgggtctctgatgtttgatgtcatggagagaattttgagggaagagtgtgcagaaagaaacccattgaaagctcagggttttctttaaacttccagattcttttaaagcaagttcgaagtgtcatccttagtcatttattggttcatgttggccttgagagaatcagctgcattcttgctgtgctctgcagagcagccttccacccctgctcagcaggaggtactcaaaggccattgtaagggagaaggcaggctgctccccacagagcaggacaagcagaggccatgatgctggcaccacaccgaggacagcacaggagccttgggctgcttcttggcatcgagggcactccacagtgggagtctagtaaaagtggctgctcccttttcagtgtttcctgtagctctactttttcacacccaccctgccccacatagtccacctgcagcctggctgattcctaattatccttgaggtcttgtcgttagatatttcctctgagaggtctttcctgacacacacacacacacacacacacacacacacacacacacacacacacgtcccatagcaccctgtacttcattcttactggccctcaccatgccgggtggcatgtgcatccttgctcatctctttggtgtccatgatggtgaggacctgtgtctgtttcattcgccagcccctgccacagaactggcacattctaggattcagtgaacacttggtgaaggagtgagtgaatggaagtgcctgttgcgtgtaggacctagtagccagcctaaatgagaagatttagccttgaggttattttagtacaatagggaagaccatcagtattcttggccatggaaataattcagggggaaaaaaagaaggttctgaagtgtataggaaaaggtataaattcaatacaagttgggaaattagcacctagataagactagagggtctggccctcagttttgtaggctcaaaaatgtttttttaatatacatagctgtcagttggaagcggattgacttaaattcacaagagctactttatgaataatcaaatggtgggttttggctgggcgccgtggctcatgctataatcccagcattttgggaggccaaggcaggaggatcacttgagtctaggagtttgagaccagcctgggcaacagtgagacctcatctctatgaaaaataaaattagccaggcgtagtggcgcatgcctatagtcccaaccactcgagaggctgagatgggaggatcgtttgggcctaggaggtcgaggctgtagtgaaccaaggttacgccactgcattccagcctgggcaacagagcaagaccccatctcgccggtcatgagtttcctaactagggaagaaaaatatgacctctctcccaagcaaacctgttgggaagcctgattaccaacagagcaggctgcttccctgttgtgtgtccctgcactttccagatcctgacctgcagcacgtggataatgactcatttatttactatttccccagaagatggtatgtctcatgaggacagggacttggtcctttttcctgctgtacactaggggctggcatggtcactgagtcactggtgcacggttggtgctcagtaatgtgtctgatggaagagggtgagatgatcagtgccagcggtggtgtcgtgtgctgcagcctgatgcagccctttccaccacacttgccccacagattatcattctgggaaggtctagagcttcctgttacatgttagaatgaaatgtttggactttgggaggccgaggcgggtggatcacttgaggccaggggtttgaaaccagcctggccaacatggtgaaactccatctctactgaaaaaaaaaaaacaaaacaccaaaattagccagcgtggtggcggacacctgtaattccagccactcgggagtctgaggcaggagaattgcttgaaccagggaggtgaaggttgcagtgagccaagatcgcaccactgtactccaacctgggcgacagaatgagactgtctcaaaaaaaaaaaaaagaaaagaaaaaaaaaatatttgggatcaggagtctgaaagtcagtaaaagcatgaattgagtgcctagtctatacagagccctttgctaggaacactgttactgggttggtcccttttgaagactccattttccaaaatgcactaaacattgcattcttcccagtgtaaacatgagtgagcccattgtagaaccgaaatcatcccaagggccagaattcagtggtgaatctctcagcatatatgagtccgattgagctctggataggaatgagggctgtgtctttggagcactccccacatgctcccacagaggaggggcctatcctgctcagggaggggatgttgtgtcagggtgacttcccggcagcactgtgtagacttggtgattcagcccaaaggcacttgcaggactctaaacactgagggcctgagttggcagtagcagttaactggctcacgctgctgaaagccaaggctggcagggccacgattgagcctggcgcctagaagccatcatctggttcagaaatgggcccagtacattgttgttgctgttgacacaaaagcagccttgttgtgactccttacaaacccatccagactgatgggcctgggccagggccctgacagcactctttacaccaaccaggaggcaggaagccaaattactaaagataaatgtttgtcattcagtgacccaagggagatttaaatggatttccaaaacacgaaccaccttggatcccagtgattgtcctgaggttttgccatgaattggccctcagttaggggctaagggtagctggaaagatggtttgcagttgccaagcacagaatgttcttcagatagagggctcctagggacaggaggaatttgctctggttgagttttgaactgagccctttactgccccgagggggcaaagggtgaggctcacagctgtgctcttctttcaggcgaagtggtgaacacccatggccccgtggagcctgacaaggacaatatccgccaggagccctacaccctgccccagggcttcacctgggatgctttggacctgggcgatcgtggtgtggtgagtgggccctcagaaggttacacctgcgggtaggagccactttcacagtaagccctgcagtctcacctagactacgtttactcgagccctagagagctgagccaaggaggtctgaacagactcccgtctgtaacttcctggggcatggccaagactccacataaatagctcttagcttttctggcaggttggaagttaacctctgtaggtccccgatgtggatacctgtttttcatttattcttttttgttcattcatttcctcattttctttctagtctgtctcctgactggagcagctggggctgctaaatgaggccctgtcctcccctttccaccccggccacccagagccccttgttttgacctgagggatttatttcccttataaagaatgatgaaaatgtcgccgggcgtggtggctcacacctgtaatcccaccgttttgggaggctgaggcaggcggatcatgaggtcaggagtttgagaccagtctgaccaacataataaaaccccatttctactaaaaatacaaaaaattagccaggtgtggtggtgtacgcctgtatcccagctactcaggaggctgaggcaggagaatctcgtgaacctgggagggggatgttgtagtgaactgagatctcaccattgcactccagcccaggtgacagtgcgagactctttgtctcaaaaaaaaaaaaaagtcaacagaattttttttttttttgagatggagtctcgctctgttgcccaggctggagtgcagtgacaccatctcagttcactgcagtctctgcctcctgggttcaagcgattctcctgcctcagcctcccgagtagctgggattacaggtgagtgccaccacgcccagctaatttttatatttttagaaaagatggtgtttcaccatgttggccaggctggtttcgaactcctgacctcaggtgatctgcccatcttggcctcccaaagtgctgggattacaggcaatgagccactaggcctggcttttttttttttttttgagacagagtctggttctgttgcccaggctggagtgcagtggcgcgatcttggcttaccccaacctccaccttccaggttcaagtgattctcctgcctcagcctcccaggtagctgagattacaaccatctgtcaccatgcatggataatttttgtatttttagtagagatggggtttcactgtgttggccagtctggtctcgaactcctgacctcatgatccacccatctcggcctcccaaagtgctgggattacaggcatgagccactgcgcccagtcttttttttttttttgagatggagtcttgctctgttgctcagactggagtgcaatggcacaatcttggctcactgcaacgtccacctcctgtgttcaagcaattctcctgcctcagcctccccagtggctgggattacaggtgtctgtcaccacgccaggctaatttttttattttttagtagagatggggtttcaccacattggccaggctggtcttaaacttctgacctcaggtgatccgcccacctcagcctcccaaagtgctgggattacaggcttgagccaccacaccgggccaacagaattttttaataccaaagttgggccagcagatggagatagctgagaaggcagaaaaaggcctttgtggttgggtgtggtggctcacacctgtaattccaacaatttgggagtctaaggtgggaagatcgattgagcccaggagttcaaaatcaatcagccgggtcaatatagtgagactgcccccgctacaaaagaaaaaaatttaataattagccggacatggtagtatgccccagtagtctcagctacccaggaggctgaagtaggaggatcgcttgaaaccaggagttggaggctgcagtgagccatgatcacaccagtgcactccagcctgggtaacagagtgagagtctatcttgaaaagaaaggaaaaaaggcctttgtttgggccagatggtaaaaaatcagacaaggtgggaaacagcagtgactctccgtggtaattccttgactagcttcgagagtcgtccctctatagcacttcacagaagctgagaccagtggctctccattgttgatggcgcagaatgatgaagtggttggttagttaggtggcattctcggtctgccactctaccacgtgatggctcagttttctactataactagggtgtttgctccaagagttcctaccatgccagggggcagaaggatttgtgagactccacgtcgtttttggtagtttgcttcatccttctgaaaagcctagagccccagggtattggagttggtctactacctggcagaatacctccaagtgagctgcttatttctttacagctaaaagaactgtacaccctcctgaatgagaactatgtggaagatgatgacaacatgttccgatttgattattccccggagtttcttttgtggtaagttgtgggggctttcttgaggttcttgagaggaaggcatagagcagatccaccagagggcaccagagttttcatccctgccaggggccaacctttgaatggcaaattagtgtgtcatttttgagttcctgcatctgaaggacacttgctttcattagcacttagaattgcagccttgtttaagacaattgactgggtgagggagaccttcgtagagctagtacccagggaagaggtattcattgtctggtgactttatataagaaaggaacgggcatgagacctactaagactgaaagaaaagaaggcacattttctatctagttcctgagcatgctcagttgtatagccttgcctggctgagccatccacctgcccaggccacgtttaatatccaggaagagagaggcatgggccgaaatggagagggactacctgaaagggaaggaagaatttgtaccagaaagagggagacaggacaccagagctccagggttgccacagtcagctctcaaccatgggacccactggcctccgaaccaaagatgccagtaccttggttcaagctgtcaaagtgaacacagaaattggatcaggcatgaaatcctcagtatgataaccttgggttggatgagtaactaggccaaatgggatgagcagccagaaatggtgatggctcgattctgtgtgtccaggagggcttggccctaaagagaatccagctattaaccctcagggaggtggtagcaccaggtccgaaccaaatttggctgtggagcccaagcggcttgtccagcctgccggcaagcagcacaaccaccccagcctctcttttccagggctctccggccacccggctggctcccccagtggcactgtggggttcgagtggtctcaagtcggaaattggttgggttcattagcgccatcccagcaaacatccatatctatgacacgtaagcacctgcacctacccccaccccccacaacaccgccatcctgcttggtctgggagagagtagaaaaaggctgcacaatgtgccccatgaaaggaagagggaaggtctcaggaagggaggatgcccaggtgcggggactgcagattcatcctaggaaccacctgttctgctcagagtcccagccagctcccttgtttgtggcccaggttggaaggagcccaccctgaggcctggtgtgcctgctcagcagaggcttgtttttgtttttgtttattattttttacattttatagaggcaaggtcttgctatgttgcccacgctagtctcaaactcctgagctcaagtgatccactcacctctgcctcccaagagtgttgggaatatagacgtgagccattgtgcctggccagaggcttttcttagtctcactctgttgcccgggctggagtgcagtggtgcgatcttggttcactgcaagctccacctccagggttcaaacgattctcctgcctcagcctcccaagtagctgggattacaggcatgcgccaccacacctggctaatcagaggctcatttttgaacgcctgtaccagtcacacatggaagcacttgaacagcagcagaaatgggccagagcgagtgtgacccagattcagatagtccttggggcctgtgatctctgctcttcattttccctggaagtgttgaaaccatctgcctgccacagtcttcagggcttattaccagctgtgttcttgagggaatcagaacccttgaaaccctagaattgccttgacctgccccgtgggttccctgtgctgcttccctgcatgctaaaggtgggattccccagccaactcctagggactcatcagggagatgctggtggtaccttcaaataaaggtgtttgcttgggtcccaccttcctttggaaatagattctgttgaagtgaggcaggctccttgcctggtggagtgtggtggggagtcccagtactgagtgcaggtggcagctaaaagtacacccgtgctgcagacctggtccttctaggtgtggctgcacgtgcttgatgggatcaccattcccttccctgttaaaaaccttgtcacctggatttttccccctcttagagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtaaaactgtcttcctgtaaggccccaaaaatgcgggtgtctgcactgtagttgaggagcatgtgccactgtgagtcacagctccgcccttagcatcccacctctggcgtatctggtaaggcgggcacttggtgcctgcaggagccagatggggagcatggagagggcgggagggttgtagggatggcagattggcaagtccctgccttgtctggagggctcttggtgtctgctggctgctgccatttggagatggtggggggcggtactggtggtttgtttttgtttttagggatgagcccaaatctggatttttatgggaaatgtcctaaagttttaaatggttggctcaaattgttttgaatattgtgtgcaccaaatagagcaagtcagctatgtgatctaagggcaacctctgccttagaaagttgtttaaaacaattgaataatctctccttagagaactttaaaagtaaaaacaccaggtgtgaaagcagaaggggaggagggaggagggtgagtgcctctgccatcatcttctgggcatgactacagtccttttccgttgacttgattctaggagtgaggattggtctccccagacaaccgctgtagcaaaggaatagtttttgaaattgagcaagaaaaatagggagaaagaaaatccaggaggagctttggcagcactcactgtggggagggggaggctggcgagcagggtgacaccactgactccggaggcacctgatgtgtctctcacgccacctgctggccagctggggtctccctgccattgtccttgtaatagggattggccagaaccctgaggacaggacatttgtgtccccacaggtattggcatcggtccctaaacccacggaagctgattgaagtgaagttctcccacctgagcagaaatatgaccatgcagcgcaccatgaagctctaccgactgccagaggccagtgctgccccgggtggtgggcagggggcagagagagggcaaggagagcctggctgtcagcaggagagaagggctctgggtggagagggagctttctcctactggaaaagcgaaccagcccatagtcttcagatttcctggactttctatttctgttatctgaagcaggattttattttagtttaactttctcagttcctctgagtctgtgcctggactagcttctctgccatctgttgaaaggctcagagaacacctattctctgtaattttagcctaagtaaagcataaatagaatgatgaatccacttagtgaaccttcatacacacggcagcgcgttccaaagcccagcgcagatgcactacagggtctgtgacgcccctctgccgggtcaggtaaagggtgacctgagcttgtgagggatccccgatttctaatcccaatttccccacccagatttggctgaaggactgggcaaccttaaagtgagctgcttttctgttctgggtctcagttttcctagtttcccaaagaaacaaatgctccaactgtggctggcttcaggtagggattcttttttttttgttttgagacagggtctcattctgttgcccaggctggagtgcagtggcacagtcacagctcactgcagcctcgacctcccagactcaactgattctcccacctcagcctcccaagtagctgggactacaggcgtgtgccgccatgcccggccaatttttgtttttatagaaacggggttttgctgccaggcgcagtggctcacgcctgtaatcccagcactttgggaggctgaggtgggcagatcacgagatcaggagatcaagaccatcctggctaacacggtgaaaccccgtctctagtaaaaatataaaaaattagccagtcgtggtgtggtgggtgcctgtagtcccagctacttgggaggctgaggcaggagaatggcatggacccgggaggtggagcttgcagtgagccaagatcacgtcattgcactccagcctaggcgacagagcgagactccgtctcaaaataaaagaagcccgggcgtggtggctcacgcctgtaatcccagcactttgggaggccaaggcaggcggatcacgaggtcaggagatcgagaccatcctggccaacacggtgaaaccctgtctctaataaaaatacaaaaaattagctggtcgtggcgtggcgggcacctgtagtcccagctacttgggaggctgaggcaggagaatggcatgaacctgggaggcggagcttgcagtgagccaagatcgcaccactgcactccaacctaggcaacagagcaagactccgtnnnnnnnnnnnnnnnnnnnnacaacaacaacaaaaaaaggattttgccatgttgcccaggctcatctgaattcctgggctcaagtgatccacccacctcagcctctcaaagtgctgggattacaggcatgagccactgtgcccatcccagtagggattcttaaaatcccttctcaggtgggcggtggctcacgcctgtaatcccagcactttggcaggacaaggcgggtggatcacgaggtcaagagattgagaccatcctgccaacatggtgaaaccctgtctctactaaaaacacaaaaattagctgggtgtggtatgtgcctgtaatcccagctacttgggaagctgaggcagcagagttgcttgaacctgggaggcagaggttgcagcgagccgagatcgcaccattggactccagcctggcgacagagcaagactccgtcgcaaaaaaaaaaaaaaaaaaaaaaggaaagaaagaaaaaatctcttctctttcctcggagtgcttcttcctattggtcatcagtgcacacagtcactgcgttcctgctgacatgaggctgcctgcctggactcctcagcctctaaacaggattgatcactctgaaatcaggctaatccacctagtgattggggtcattagtgtcccatcttgagagactgctgcagtaccgttagacactgccaaaagcacaggcttgggggactgtggtatgtgtcttctcccttctgttctcatgacagatctgccttgcgttctaggccggtgggcaggcaggcagagagcattcttagagtgctgcagcagcagaagaatgtctcacccatgtctgggtggaaaccccagcatggctgtgttttcagtccaggatttgaggtatcattgtgggagctgccatgtagaatgaggtcattgagcgttcccctaaagagacgaggatttagcaaggaattttagaggctggaggttctagaactgaagttttaaaagcaattcctgcactgggaagcattgtgtcaggcactgactgaggcctgtaaactgtgacaccaccctgtttgcagattgccccaaggccacctttgtgtatctgagcctctggggatgttctaccagccccggtatttgctccacaggatcacatggtttcattccactgaagcatttttctagcaaaagcagctgccgggtgggacgctgactggggataaaatcctgggagtatgctgcttttcttctgaatgtaacccacagccgtgtctctctgggaagtactggtgtaatagtgtctgggtgggcagaccctggctgggccctggggtctgtccgcgaagtgctctaagtctagcagagaaagagcagtgagtgtgggatggcatcagtcacagttcagtgagaagcctgtgaggactgttgggctgcgtgggcagaaggtacagctagaaaggccaacctggcccaagggtagaaattcttgtcttctggggtggggagtttgaaacaagggtggagcatgaagggttgtgttttcttagggagtcagcctggggccatgtagatggttgattgatgtagcagtctgagtctgcctggactaggagggaaagggccagaagatacggaagaggcaggccctgtgcctgaggagatatgcacgggggtgcagggagccgccgaatgaccagggattctctcttgagggcctgatctgtccttgccatggatagatccagggtgatcagctcatctcactccatctcttctgtcttgcctccagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggaggtgagtcagggagtggtgttccaggtctctaacacgttcccagagaggcacccccctgagtggccgggttcccagggctcgagtgttggcaccttagacttccttgaccatccgtgtttggtcctccctaaaaacagggagttggtgcttgaatttgctgaaaagatacctctggatctggcttgagcccttctccccctctgccccactttgataacacaaaatagagagaactgagccccgcttaatccttcaggaaagcctgcaattccctgcctgtcccagcttaacccagtgctgaccagacataggagacacagtctggggggatgtgagctgcaagaagaggtccctggcggtgcccatgctgggaaagaggtctggcaggttcagcccacgatcacggctctgtcctcaagtgccctgagccaatgtccctcctcctccccacatgtcctgttgcagtttccagccatttatctagaggggcagagctgcctgaaggtggagtgagagaaacattttgttcccgggccgcagtgccactgtgcatgcttgacattgcctctttattgccttcccttcagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatggtgaggagcagacgggggggtctctggagatgtgcagggaaggggcagtggagccatggtgagcacagctcccgggacgcagcctcccatgggctggaggctctgagccctcctcatctgttctgcttaggcagggttcccgcagtttttaggcagaaactcaaaacttggagggaacaaggagcatccgaagtgaaggcattgaactcctcctgattcatttcagtgagtttcgttctcacaggaggcgccaccaaggagcctgaatagccaggccttccctgggaggacagggcttctcctcacagctttcccagcgtgggaaaggggtgattgctgtctgtcgtggtgagtcattggagcatccaactgccagtagcggatggcgagcccgtctgtcagtgctttgctgtgggttctggtaacctgtgcccagcccagcccagcctgctgtaggcaatctggtccctgccctgtgagagcttctgctccagttggtgaggtttaggaagcatcttcacagtctccaagcaacacagcaggtgtcatacaacatgaggtgcactgagggcctgagagttggggcatccatggagtaaggaagcaacacaaaccccatgtagctgaccagagccagcttctcagaggaatgggctcagggtttggactccagagaggactgtggaaattactagagtttcagggaggcataaccaggaatagcaagagccccggcctggacactgagtacatatgtgtacactctgagggacactgggcagaggccaggctggagggggcgctcagagtgtcctgagaaccacccggagagcggggattaacgtggaagcagcggagcttctgagggaaccttgttcttgtggctgcccacaggacagctttgaaatggcagcaaaggggtaggaaggaggctgtccccacctgtcctcacctgttcttgtttgtccctgctgctttgcagaaagggtttgatgtgttcaatgcactggatctcatggagaacaaaaccttcctggagaagctcaagtttggcataggggacggcaacctgcagtattacctttacaattggaaatgccccagcatgggggcagagaaggtaggcgacacatagccagagtccaggctgcccggcccagggtgtccatgtctccagcagaaaccgggccatgggttgaggagacagccgcagtctgggtccttgttacctcgagttgaacctttgaaaatgccctccctctgctggccagaccagcaggtcagcgttcccctctcagcaactggtgtgaggatggcagaggggacagagccacacagtagcacgaagatcatctccaatgaggccttcccacgtgagggaaccgtggaagttgagttgcccacggtttgccaggagggtagggctgggggaactctgaggaggtttcctctcctgagctgctgccctcttctggcatgacactttcttagcccttcctcccccagtgccacaggggacataggggtgagctggagcgtgggccagttttccctgggaggtctgatggacgtgtgaaccctggtgtggaggttgagtgtggggccggctgggtgtgagtctgctcccacagcacaggcggtggacccgggcccagccactcggaacttcagggatagggggtgtgggagagtctttgggccactgtcaactcagctctgcctctccctgttggctttcctaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtgcccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccctcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactctggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagacccttcccacccgccagagacgagctgctattgacccaggttcactccaagttagagcagcaactgggctctcagccagcacctgagcacctcagcacaggagccggcccaggcttccctagctgggcacagagcagcccccttggtccaggtcagcagtggctcctctggtggaggtgcaggccccgtgccttcccactgtgcccaggtgccacatctctcctcctgcaccactggccgggtggttctttgagtcactaggggtgcattttaacatggcaagttgctgggccccagtagctgtgtttaagacttcccattccccctcttctcatcctctggaacttacccattccctgaccccctgatcctttcaggtccatgactggtgcctccaagcccctttccagggaaactgagaggacacaggacctgcctgacccctctaaagccccccaaccctcctgtcccaaaccaagtcactcaggctcctatggcccatgccttttttcctgcccttagctttgggctgagagaacatagccctatgtgttgtttctacccatgggcctctgggataaaaagctgtgatttcaggctgggcatggtggctcacgcctgtaatcccagcactttgggagggcgaggcgggtggatcacgaggtcaggagatcgagaccatcctggctaacactatgaaaccctgtctctactaaaaacacaaaaaaattagccgggcatggtggtgggcgcctgtagtcccagctacttgggaagctgaggcaggagaatggtgtgaacccgggaggcggagcttgcagtgagccaaggtcgtgccactgcactctagcctaggcgacagagcgagactccatctcaaaaaaacaaacaaaaaaaaaaccctgtgatttctcccttgcttctgcttcccagttcacttccttaaagactcttgcccttttggctgggtgcagtggctcacgcctgtaatcccagcactttgggaggtcaaggcgggtggatcacctgaggtcaggagttcgagaccagcctggccaacatggtgaaaccccgtctctactaaaaatacaaaaattagctgggtatggtggcgggcgcctgtaatcccagctactccggaggctgaggcaagagaatcgcttgaacccgggaggcagaggttgcagtgagccgagatcacgccatcgcactccatcctgggggacgagcaagactttgtctcaaaagaaaaaaaaaaaaagactcttgccctttcaaggcagccttctcagtattgggccctcatcctagccttca

SEQ ID NO: 12859 - DNA, 51101 bp, Human
  misc_feature (1)...(51101): n = A,T,C or G
aaagtctgagttaaagtttagagaggaaaagacagtttatcctggccctatttgtcaataaattatttgaatagttaaagtaaaaattttgtgagggatagagttataggttttctctcttgtattttcaaataaaataattcattctgatgttgcctgaccttgttgatttagtcttcatttttcttatttcttttatagctctctagcctttcttttcccttttcttttgacaaacaactagaggggcaccatgctcttttcttatccttttacttctttggcttgacaaaaataacacagcataaaatgcacctagcattatcatgtttgttcttgttcctcttctgataaggactaaatgtataattaaggaaaatggtgttcacaacagtacctagaaagtaactggttcacaatttttgctcaaattaaattttatttattaaatgaaagaatagattaatcttgaagtgagaaaatgaaaatataaggagtgactttagcaaagaagaacaatggttcccaaatgtatatcaccaatccttttctctcattttctttagccccacctctttaattgcttataggctatttctagctgaacttttatgatgttgaaaacaaaagtctccttccttccttcctttcttttcttttctttctttcctttctttcccttcttttctttctttctttcctttctttcccttcttttctttctttctttcaagtcttgctccgtcgcccaggctggagtgcagtggtggggtctcggctcactgcaacctctgcctcttgggttcaaacgattctcctgcctcagcctcctgagtagctgggactacaggcgcgtgccaccacacccagctaatttttgtatttttagtagagatggggtttcactatgttggccaggctaatcttgaactcctgagctgtgatcagcccacctcggcctcccaaagtgttgggattacaggcgtaagcctctgcacccagccaaaactcaccatctttcttatcttccaaactcagttttatgatgactttccttctccaatgcattttaatcctctgcattcctacattccatttatgtaacctccatacctgaataatgactgacactaactccacttttcccagctgtcatggcatagtgaaaattccagatctgccacttagtggacaggtactttgaacaaatttcttaacctctgggaacattactttctataaaatggggatagtaatatgaattagaataaatatatatgttatagatatacaacatagatgtaattcatatatattaacctttcaatagtagatgttcaataaattacagctattgttaccctgaaatcagtttttctttttttttttttttggaaatggagtttcgctcttgttgcccaggctggagtgcaatggtgcaatctcagctcaccgcaacctccgcctcccaggttcaagtgattcttctgccttagcctcctgagtagctgggattataggcgcccgccaccacacccagctaattttttttttgtatttttagtagagacggggtttcaccatgtgggccaggctgctgacctaaaacgatccgcctgcctgggccttccaaagtgctaggattatatgcgtgaaccaccgcgcctgaccatggaatcagtttttcaatctgtgctcgaggtgttgtgttcttaactatcttctactcctttgcaaagataatctttcttaaacatagattttctaatcagttctctagcattgtttcattctgtctttggcatgttttcactttgctgtgctgtacttttacacattctttttaactatagcttcctgctttgctctggatcaggaagctattgaagctgacacccacagagttaaactcagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatctccggtgagtccttagattcaatcctgcctctgagaggaatggcctccctcttttggctctcttccttgggctctggagcttccagctgagctgtattagggtattaaaatgcttctctcttggatttagaattcacctgaaaccaaatctaaacagaagcttcctttacataagaagacaaagcagcaggaagaggtagtcaaagttcttcagttgggatccagggacttgctgaatttcattgcatattctgtttccctgggggaaaaaagcaattcgaatgtccagggaaacttggcaagcattcttgtctgaagaactgtgtgtgattgttctttctttaccaatataaaaactctgcccttagttctccctgtgtgcagagtcttctgctgaacaccaatggaagtttcagaatagatccaatttctgttactatgtgttcccagtttactgtgggagataggacagagaaacagagaatagtaatgttttgcatttatatactcgctaaagcacttctaaactcatcatctcagtcaattcttacactaaaattctgtaagtggggaggatatagtaatgatagccaaaatttactgagttcttaccgtgggccaaaaggtgatgttattctcatttctttggaataacagaacagaggttttgagacaggtgtagtgacaatgccagtatcagtatgttaacacagccagtggcagtgttgcctaactagctaacagtgtgtcggctaaactccagattgcataattctcaagctgtgagctgcaaaggtaagaagcccagttcattgtatgtttcaaacaagctattataaaacattaaaatatattaatatttaggaggatcatttatatatatccctagggttaaaagaataatacattactttattattttgcctatttttttagttaatgatatctcttctggtcccaaagaatttagggctacttgcaaagatgtatatacttctcatgaaatgaggcaatataaatcttacaagatttgactgtactgaggacagatacctctatgtctcttctcatgttagttggtctattgtaatagatagggaattaaaataaaacataacattccttatattctgactgatatattacatgaaaagcataattcttttaatgtccagtaggattatcatgaaaatgttatagaatctctttagtaggaagagtagacatttaattttacaggatttaagaactctgcctaaagtcaaggtgatcaattagcttacccttaggaatctctgtcctccatgttgggctctgtgcctgactccagcagcctctgaagtagaagctatcatattgccaggattcctcccagcatggcaaacagaacagctggggacaagagtccccatagtggggctaagcagagactgacatctgaatctcactgcttggatatcaggtattccataggctacctctttattctgttcctaggaagtaaatatcaccattcttctgccccagagccctaggcttttcatttagtagttgtgggaagatgagcaggtccaaggaatatttgagcaagtccatgtaaaataaataagaaacaaaataatattcagagtagcttctattatttctaaatcagtaatataagcacttttagtgttacctaataggtgtgtcatgaagagtagagaccattgctccattacctaccaagatgatttgaaataaatgaatttttcagttttgaagaaatctaattgttgaaacagggaaaaacagctcatgcttgaatcattgccttcttgttgaatagacaatctgtggctccaactatccactgagcattgccttcattgtggtgaatgaattctgcgagcgcttttcctattatggaatgaaaggtaattttgtgtccaagagtcctacctactctcctccacccaccctcaccccatgtttgtgacagcctggtctctttatatgcacttatttcccgagtccactctttctgccttggtccaaattggtcctttactttggccaagacttccaataaatctctcataggatttcacctaatatgtaggccaagatcagaaaggcctgagacaaaccagaacatagactttgagaatgggtaagtgggtggagctgggcatgatggcatgtgcctgtagtcgccactacttgggaggctgaagcaggaggattgcttgggcccaggagttcaaggttatcaggcacctgtaattgtgccagtgaatggccactgcactccagcctgggcaacatagcaagaactcatctccaaaaaaaaaaaaaaaagaggggggagggaaagctctcattatctcagttacatttttcatacctgttcctcaggtatgagctaacagctcttggctaagggctcatacctgaggaacaggtatgaagaatggaattcagataagaggtcttatcatcttgttgctgggaaggagaggagagggaagggatattggaagcaccatgttatgttcatggttggcctaaatgatgctaggggtgcacatagactgaagggaggagtattatatttgtacattcaacatagtcccattcactcccacaactcccatggggccctgcttctactgcctggcagtcacttctcagtcatgtcactgataggagtgctgaaggccaaaatcacattataaagaccagagattaaatatttttttccataagtcactttaatgcatctatcttgttttgtctccccacgcctccttttttttcccactacagctgtgctgatcctgtatttcctgtatttcctgcactggaatgaagatacctccacatctatataccatgccttcagcagcctctgttattttactcccatcctgggagcagccattgctgactcgtggttgggaaaattcaagtaaggaagatgggaggtcacatccctacaagtttcacaggttgtgcagaaggctatcacttctagcctcttgcttctgagtaagaacatacctatgtcatgcgtgaaaaataagaatctctgtacatctgtgtagtgtgggaaatttaaaaaaaaagaatctctgtggtaacaaggaaaggctattcttttcattatcaatttttccaatgtgtttacatcctcttcagttgcggtatcttttgttccttaaaactaattttaaccttccattccatagtttaatattaaatcttgctctgatcttgttggagatagacagcactatccaccagcaaatttctaattttagccaggtgcggtggctcacgcctgtaatcccagcactttgggaggccgaggcgggcagattgcctgaggtgaggagtttgagactagcctggctaacatggtgaaaccccgtctctactaaaaatacaaaaattggccaggcatggtggcgggcacctgtaatcccagctacttgggaggctgaggcaggagagttgcttgaatatgggaggcagaggttgcagtgagccaagatcatgccactgcactccagcctgggcaacagaaaaagactctgtctcaaaaaaaaaaaaaaattgaaattttgatgcttttatgtagttatttgatactttctccatctcttctccagattgagttatcccacctcctttaggatcttcttatgagtgtctcttttcagctcttttaccatctatttctcttctctaatgtcttttgtagtttccttcttatgaatctaatattttcatgagttagactattggttcattcagttcagtatcttttaagtccctgaacacagcaccaagagatataacatggtataatgttataattgtcccctataacattaaactgataagcttagaaatggatcgtggttatcccctgcccaattattttctatggacctgtcatccatagatttgtctaaatgagcatttctcaaagggcattctgttcaaaactataaaatataataagttatgtgggaaaataaagctcttgtggtcaaacaagtttggaaactgttaggctgagcaaagctaaaaatgttcccttactgcatgacttcttatagccttaaatacgctaatatgaactataaaatctccatagaaggttgtagtatgtagtgtttcccaaaccagtttgactatggaatattttttctggatattttgtggacccagtgttccaaggaattctctttagtaaacaatggtttatagcttactttggccgatatatgttcattattctataagtgtttaatcagcacctaatatatatctatagacataacacagtactgaacagtttcttgacttgggagaggaatggtgggtgagtagctgagatctacatttgctacatatgtagtagtagtcaccaagtttatctagataggagattggcactacttgcagaataaaaagtgcaagccataatctatttattcagttgtagaataaagattcatatacatgacataccacttttatttattttaaaaataacttcctttaagattgaagaagtacagttacaggatttggtgagcaattgtttcctggttaattcagagaaaatttaacaacctctacttgtgctctcaaatcaatccttcttgatgtatttattattgtttttaatttatttttattgggatataacttacataaagtacacaaattcaaaagccttaactgtacaccttgatcagtttttatgtatgtatcaccatcacctagatcactctccctagggtctctgtaccctcactattcccctctcttgccttcaaattctcccagagaaccagagtcttttccttcaactagaagcaggagcaaatctttaatagctttaaatgaacaaaactcatcttgactctcttttcctatcatttttctccttttacattaaccccatattataaaaataatcctctgtatgtgttgcctttctcactcttcattatcagttcttatggtagagtaatataatataatgcaatataatccaattcaatttaatttgatttgacccaatttaattcaataaatgtttattgagcaccttctgtttgtccaaggaaccatggaggatgaagaggtgaattacacatactacctaattcatattgttcatattcaaatagctttaatacagatcatattgtagtacaataagatatactgtaaatcatcttttttccttctgaaattactccctaagatcactggtaagaatttcttcattagcaaattccagtggtcttttctaaattcttactcattttgaacttgttgttaacatttcagtctgtttatcatttctgtgaaactccctggccttctctacagtatatttttctcactctcgtcctcttatatcttttcttacttatctggcttctcttttgcctcttgtttacttcactctttcctgagtgtaagcattttcccaggttataacttttaccctcttctctttctctagattcttccttagcaaattctgtggtgtggatattagctatatgcagatggctcctcaaattccagtgaattacatattggcattcacctccacaaatctgttctttcttctgtcttctctacattcccaccttcaatcagttatcaaattctaccaattctgcttgccacaatctctctcacatttatcccttttcagcacaacatccactgcattagttgccatcacccagttttggtcttcattgtctcaatgtctttaaattgagatattaaaatggacatctaaaatgtttttactgcttcccatctctttttcctacaattgagcatatatgctactgccaaattaattttcctaaaagaaatcctgatcacattactactctgctcagcaatttctggtgactattaaatcactgtctactaatctcactccaactgacttttctgtgcttactgtcatacttatctcctttcgagaatggccactagaggaaaatgtaatactaatatttctgtaatcatatccaatgacatctctttttcatgtctgtttgcattgtttctgcttcatggaaaccccttcttccccaccctttcatgtccaaaccccgtaaggctcactcaaataccacctatgctatggagtattctctgccccctcaccttttactatagctggaagtaatatagtgttttctgagttctttgttttctcacccttatatgacatttactaaactctatcttattatagttatttaattatttatatatgaatctgatatcttctttcaaacacttagaggacaaagtcatttatatatatttttccccacccaccccagtcatttatatattatatgaatgtatataatatgtataatatataagtatatatataatatacatattttttgtcgttgaggcaaagtctcgctctgtcacccaggctggagtgcagtgatgcaatctcggctcactgcaacctctgcctcccaggtccaagcgattctcctgcctcagcctcctgagtatctgggattatatgcatgtaccaccatgcccggctaatttttgtatttttagtagagatgagatttcaccatgttggccaggctggtctcgaactcgacctcaagtggtccacccacctctgtctcccaaactgctgggattacaagtgtgagccactgtgcccggctgtgatttatatttttatccaagagcacgtagaatagtgcctagcagataggcccacagtaaatcttcgaattcataaatttattcaccctcagaccctcaaatgtagccacatgactgcagatagatgtagacaggcatgaaggttacttttattttattgtgggtattttggttgctttttaaataagaaaacttgggggtgatttgtatctctttcacaaagggagtagtttgagaaaatgtgggtaacttgttctcctgtagtcatgtttgtgtgtgtgtgcgtgtgcatgtgtgtgtaacatatacaaacagatgataacagcaacaaaagggaataagtatttaaaactacccttccttaagttggaaaatcagaaaaaagacaagactcttcctttactgtcttttctaatttgaacctgtagcctattttcttcatttgctagaggaaaatggatagatttttgtttcaaaccgttaagttcttccccacctctcatatgtttctctgcctgagtatgtgtttgtgtgtgtgtgtgtgtgtgtggtgtgtttacttttattcacgtgttactttgagggtgaaaagccttctctaacattagaaagattgttcaaaccctgaaggggcaatttcctgaagttagtaaacaacttctattaaaaatctttcctctgtttgctatcccagaataatagatatgttaagaggaaatgggcatccagagtccctgactcttgtttaaggaactccctatgccaggaaagaagtgaggcttccttcagagctacatacaggaaagactaatcaataggtacgcagtgggaaaacaaaaattattaaacatgcatattggtttctcaaggatgctatttgtagtgtcaagttggttttaagaaaggaaaacatttttagtcatagttcctagattttatatcctattacccaggctcatcagttttgatttttgacctgggcaatcacttagaaccactctcttaaacgtgtttattatttttttattttaatttaattttaatttttattttttattatactttaagttctagggtacacgtgcacaacgtgcaggtttgttacataggtatacatgtgccatgttggtttgttgcacccatgaactcgccatttacattaggtatttctcctaatgctatccctccaccagccctccaccccatgacaggcccccatgtgtgacgttccccgcctggtgtccaagtgttctcattgttcaattcccacctatgagtgagaacatgtggtgtttggttttctgtccttgtgatagtttcctcagaatgatggtttccagcttcatccatgtccctgcaaaggacatgaactcatccttttttatggttgcatagtattccatggtgtatatgtgccacattttcttaatccagtctatcattgatggacatttggcttggttgcaagtttttgctattgtgaatagtgctgcaataaacatatgtatgcatgtgtctttatagtagcatgatttataatcctttgggtatatacccagtaatgggatggctgggtcaaatggcatttctagttctagatacctgtcttccacaatggttgaaatggttgaacaagtttacagtcccaccaaccagtgtaaaagtgttcctatttctccacatcctctccagcatctgctgtctcctgcctttttaatgattgccattctaactggtgtgagatggtatctcattgtggttttgatttgcatttctttgatggccagtgatgatgagcattttttcatgtgtctgttggctgcataaatgtcttcttttgaaaagtgtctgttcatatcctttgcccactttttgatggtgttgtttttttcttgtaaatttgtttaagttctttgtagattctagatattagccctttgtcagatgggtagattgcaaaaattttctcccattctgtaggttgcctgttcactctgatggtagttgcttttgctgtgcagaagctctttaatttaattagatcccatttgtcaattttggctttggttgccattgcttttggtgttttagacatgaagtccttgcccatgcctatgtcctgaatggtaatgtctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatggttgtagatgtgtggtgttatttctgaggcctctgttctgttccattggtctatatatgtgttttggtaccagtaccatgctgttttggttactgtcgccttgtagtatagtttgaagtcaggtagcctgatgcctccagctttgttcttttggcttaggattgtcttggcaatgtgggctatttttgcgtccatatgaactttaaagtagttttttgcaattctctgaagaaagtcattggtagcttgatggggatggcattgaatctataaattaccttgggcagtatggccattttcacgatattgactcttcctatccatgagcatggaatgttcttccatttgtttgtatcctcttttatttccttgagcaatggtttgtagttctccttgaagaggtccttcacatcccttgtaagttggattcctaggtatttttttctctttgtagcaattgtggatggaagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacattttgacttcctcttttcctaattgaataccctttatttccttctcctgcctaattgccctggccagaacttccaacactatgttgaatagaagtggtgagagagggcatccctgtcttgtaccagttttcaaagggaatgcttcaagttcttgcccattcagtatgatattggctgtgggtttgtcatagatagctcttattattttgagatacgttccatcaatacctagtttattgagagtttttagcatgaagggctgttgatttttgtcgaaggccttttctgcatctattgagataatcatgtggtttttgttgttgattgtgtttatatgccggattacgtttattgattggcatatgttgaaccagccttgcatcccagggatgaagccgacttgatcatggtggataacctttctgatgtgctgctggattcggtttgccagtattttattgaggattttcacattggtgttcaccagggatactggtctaaaattctctttctttgttgtctctgccaggctttcatatcaggatgatgctggcctcatcaaatgagttaggcaggattctccctttttctattgattggaatagtttcagaaggaatggtaccagcccctctttctacctctggtagaattcagctgtgaatccgtctggtcctggcctttttttggttggtaggctattaattattgcctcagtttcagaacctgttactgatctattcagagattcaacttctttctggtttagtcttgggagggtgtatgtgtccaggaatttatccatttcttctagattttctagtttatttgcatagaggtgtttatagtattctctgatggtagtttgtattactgtggaatcggtggtgatatcccctttatcattttttattgtatctatttgattcttctctcttttcttctttattagtcttgctagtggtctatcaattttgttgatctttcaaaaaaccagctcctggattcgttgattttttgaagggttttttgtgtctctatctccttcagttctgctctgatcttagttatttcttgccttctgctagcttttgaatttgtttgctcttgcttctctagttcttttaatggtgatgttaaggtgtcgattttagatcttttctgctttctctcgtgggcatttagtgctataagtttccctctacacactgctttaaatgtgtcccagagattctggtatgttgtgtctttgttctcattggtttcaaaggacatctttatttctgccttcattttgttatttacccagtagtcattcaggagcaggttgttcagtttccatgtagttgtgcattttgagtgagtttcttaatcctgagttctaatttgattgcactgtgttctgagagacagtttgttgtgatttctgtttttttatatttgctgaggagtgctttacttccaactatgtggtcaattttggaataagtttgatgtggtactgagaagaatgtatattctattgatttggggtggagagttctgtagatgtttattaggtccacttggtgcaaagctcgattcatgtcctgtatatccttgttaaccttctatctcattgttctgtctaatactgacagtggggtgttaaagtcttccattattattgtgtgggagtctaagtctctttgtaggtctctaaggacttgctttatgaatctgggtgctcctgtactgggtgcatatatatttaggatagctaggtcttcttgttgaattgatccctttaccattatgtaatggccttccttgtctcttttgatctttgttggtttaaagtctgttttgtcagagactaggattgcaacccctgctttttttttgctttccatttacttggtagctttggtagatcttcctctatccctttattttgagcctatgtgtgtctctgcacatgagatggttctcgtgaatacagcacactgatgggtcttgactctttatccaatttgccactctatgtcttttaattggggcattcagcccatttacatttaaggttaatattgttatgtgttaatttgatccaatcattatgatgttagctggttattttgcccgttagttgatgcagtttctttctagcattgatggtctttacaattcagcatgtttttgcagtggctggtaccagctgttcctttccatgtttagcgcttccttcaggagctcttttagggcaggcctggtggtgacaaaatctcttagcatttgcttgcctgtaaaggattttatttctccttcacttatgaagcttagtttggctggatatgaaattctgggttgaaaattcttttctttaagaatgttgaatattggcccccactctcttctggcttgtagggtttctggcgagagatccactgttagtctgatgggcttcccctttgtgggtaacccgacctttctctctggctgcccttaacattttttccttcatttcaactttggtgaatctgacaattatgtgtcttggggttgcccttctcgaggagtatctttgtggtgttctctgaatttgaatgttggcctgccttgctaggttggggaagttctcctggataatatcttgaagagtgttttccaacttggttccattctccctgtcaatttcaggtacaccaatcaaatgtagatttggtctttttacatagtcctatatttctttgaggctttgttcatttctttttactcttttttctctaaacttctcttcttgcttatttcatttatttgatcttccatcactgatacccttttttccacttgattgaatcagctattgaagcttgtgcatgcatcacatagttctcgtgccatggttttcagctccatcaggtcatttaaagtcttctctgcagtgtttattctagttagccattcatctaatcttttttcaaggtttttagcttccttgtaatgggttcaaacattctcctttagcttgaagaagtttgttattaccaaccttctgaagcctacttctgtcagctcatcaaagtcattctccgtccagctttgttccattgctggcaaggagctgcgatcctttggaggagaagaggcactctggtttttagaattttgagcttttctgctctggtttctccccatctttgtggtttttatctacctttgttctttgatgctggtgacctacagatggggttttggtgtggatgtcctttctgttgatgttgatgctatttcttcctttttattagttttccttctaacagtcaggtccctcagctgcgggtctgttggagtttgctagaagtccactccagaccctgtttgcctgggtatcaccagtggaggctgcagaacagcaaatattgcagaacagcaaatattgctgcctgatccttcctctggaaacttcgtcccagagggacacccgcctgtaatgaagtgtcagttggtccccactgagaggtgtctcccggttaggctacacaggcttcagggacccacttgaggaggcagtctgtccgttctcagagctcaaaaaccctactgggagaacgagtgctctcttcagagctgtcagacagggacgtttaagtctgcagaagtttctgctgccttttgttccgctatgccctgaccccagaggtgggtggggtctacagaggcagcaggccttgcagagctgcagtgggctctgcccagttcaagcttccccagctgctttgtttacctactcaagcctcagcaatggcagatgcccctccccctactaggctgctgcctcgtgggtcgatctcagactgctgcgctagcagtgagcaaagctccatgggcatgggacccaccaagccaggcgcaggatataatctcctggtgttccgtttgctaagacctttggaaaagcacagtatttgggtgggagtgttgcgattttccaggtacagtctgtcacggcttcccttggctaggaaagggaaatcccccaaccgcttgtgcttcctgggtgaggcaatgctccaccctgcttcagctcgccctctgtgggctgcacccactgtccaaccagtcccaatgaaatgagccaggtacctcagttggaaatgcagaaatcaccatcttctgcatcaactacgctgggagctacagaccggagtggttcgtattcagccatcttggagttattatgcttttgaatgtcctctccacacttctcttttctctttctctgagtgggtctgtatagtatgtcctttctctctcctcttttttgtctgatcagaactgaccttcttttcttcatgcaagctctcttcctctgccatcactacacactctcagcctctgtatatacctcttcttagttcctaagtgcctattaaaaatggctctggctttttatattcatatggtgaaataaaatgtattacttctttctcttccattttctttttccacattaacttgttcatgataaaaccaaaggaatgctggattatgagttaaatatagaagctctacacctaaccctaatactaattaaaatgtcactttggggccagatgtagcggctcatgcctgtaatcccagcactttgggaggctgaggcaggaggattgcttgaggccaggagtttgagaccagcctggtcaacatagcaagaccccatctctacaataaaaaaaaagtcactgttcatttattgatttttatttttatttatttatttattttttatttctttgagatggagtcttgctctgtctcccagtctggagtacagtgttgtgagatctcagctcactgcaacctccacctcctgggttaaagtgatcctcccatctcagcctcccaagtagctgggattacaggcatgcaccaccatgcctggcaaatttttgtatttttagtggaggtggggtttcactgtgttggccaggctggtcttgaactcctgacctcaagtgatccgtccacctcagcttcctgaagttctgggattacaggggtgaaccactgcaactggcccaaaagtcactgtttagaaatgtcatttgacctgtctggatttcagtttcttgatttgtaaaattgaaggattagtgaagtcaacctaaagcatttctgtgtgctatggttgggattacaatgaccctaatatctcgtttcaaatgcagaattttcaggtctcttgacttcttgctcctcctattagtttcctgccattagtttcctctcttatatccctcatagctaaactatttcctatgaggtttttgtttgtttgttgtttttgtttgttttttggttgtttttttaatctataagttgcctattttcctcctaaaccacttacacttctttcattcatttagtccaagcttgtccaacctgcagcctgcaggccacatgcagcccaggacagctttgaatgtggcccagtacaaatttataaactttcttaaaacattattagatttttttttttagctcaccaattattgttagtgttggtgtattttatgtgtggcccaagacaatatatcttccaatgtggcccagggaagccaaaagattggacacccctgatttagtccatcaattggataccgatcttactacccagactatatcactccagctcaaactcctttttttttcctctatgatgatctaacatagatcatctgtttggggttcatgatagctagcatttttttttctgttcctttttattccctttctatttattctttttattacaacaaagagaacctttctctagaagatgttacaagatcttttgggaaagttgttccctcccctgatgttaattagtcctagattagtcacctaactttttttttttttttttttttgagacggagtcttgctctgtcgccagtatggagtgcagtggcaccatctctcggctcactgcaacctctgactccctggttcaagcgattctcctgcctcagcctccccgctagctgggattataggtgcatgtcaccacgcccagctaatttttgtatttttggtagacacagggtttcaccatgttggtcaggatggtctcgatctcctgacctcgtgatccacccaccttggccccccaaagtgctgggattacaagcgtgagccaccgtgccctagtcacctaacttcttgtccgctacccgccatacactttaagttcccttccctagaaagctaacccaaggattaggcacttagaatgagaaatccacatcctgagagttctgacatctctggcctctctttgctatctttattccattctattctctttattccacattagcataaaacaccttaaaaattgcaggtgtaaactgtaatttccaaggttcattataatgctaacattctacttatatgtgggaatgctggtgtggtagtacacataaggaatatatgttgtagtgcgccatatttcaatgtgtgaatctctctatatgttcttactggagttccttattcttctactttctatttgctgttcaagttctttgagaaaacaatacaacaggatgttccttccaactgcatgatttttgtcactggacagtctattctaagtccctggctcctttcttacccttgttaacttgtccctgaggaaactgtggtgaggattacaattaatccaagagtccaagttacccaggctgaacctgagagctttttacctcccagtgcttcttgagttttgaggaagttgtttgggttagccattcctgtttacttggagttcttccttgacccttcttgctctctacagcagaagatattccttgagaaaaacacctaaggtccaaatatcctcttctactggttctcccaatttaaagcactgtcacttttgctacaaatccaccttgttcttgtcatgtctgtacaaagtagggtttctctgtgtgtgtgtggagtgagcgggtagaggcaaaggggaaggtgggtataggaagggaacttgaagggaatgtctattacctctaacactaaagagtgaagaattccactcctttttcctagtctgttcacttcattcaccattattgtctctatttggatttctcagataattctttcctcctccctcctcctcctcctccatttatccccacactgagaacagtatgaaccctaagtctgtattattcaaatctctcagttctggttttagactgactgatttagctctctcaacaggacaatcatctatctctccttggtgtatgtgcttggccatgtgatcaagtccttgggtgccttaccaatactgggaggacaagtggtacacacgtgagtaaaatcatggaatcaactaaactacttttctcagacatttgttacaaattattttctgttttcttaccagagatgtctctttattttcaatctacagtttactacaaaactggttaagaaaaacagtcttatgaccagttgaactctttcctactttatctgagctcatctgtttttgggacttgtagaatgcctagttagtatcctcttcatatgcttgaaaataatcaaaaccttcataccctacatattccctcacctttttattcatccatgcatctatactttaccagggttaaaaaaaactctataatgtttccttataattaattgtagaagtcatactcaaagctttgaatatttacatttatgtgtagttccatatatttcagttgctattgatgtttatgggatcagaggcatttgataaattctgatgtctgtctattcagtcagtagagaggattacagctgttcacaaagcagtttatatgtattcatattataatgtgcctgtgtgcctgtgtacatgtatttatcctatgagttagaaattttgtttgtttgtttgtttgtttttagacagagtcttgctctgttgcccaggctggagtgcagtggtgtgattttggctcactgaaacctttgcctcctgggttcaagtgattctcccacctcagcctcccgagtcgctgggattacaggcggctgccaccacgcccggctaatttgtgtatttttcgtagagatggggttttaccatgttggccaggctggtcttgaactcctgacctcaggtgatccacctgcctcagcttcccaaagtgctgggattatagacgtagcctctgcacctggccttgatatttaataaatattactttcttattggtgtcccgtcaaaaatctttgacactgttgctattaattatgatgaatttgaacatttttttttaaattttggtaagaatatgtgagatcaggtccttaaaggtctttccattgaagtactcctttgaccaaaacaagattgggaaccagtgtgttagctttggagttccttcagtatctgtttctatcggatgctcataaggggtaaatggaactaccagggatgaaatcttcccacataatgcatactttcttgcagaggccgaaggatcataaatagggtaattgaccatgaatacctcctaggaataaaggcaaatggaaagtacccatggggtagaaatgtgaaggggatctttgcccttgtacacattttttcccctctgcagctctgtagtccatctctacaggtgcatttagtatcaacatggttggcattctcacctctccatttcagagtcctatcattgatcggcctgagtctaatagctttggggacaggaggcatcaaaccctgtgtggcagcttttggtggagaccagtttgaagaaaaacatgtaagaatcctgttattttgtattttcaagaatatagagccagcattaatgggggtatctggcaggtagccatttgccaagattgaagtaatgtactggtcagatcttatctgagcagttgtattcaatgctggatactggccattaatagtgaggaaaactgaaacagtttcaaaggaaagagaccagggtggtagatgaactaaaaggtatgtcttatgaggaaagattgaaggaaatagggatagttagcctggacaagaattgaggagaatactatagctgcttatagatgctggaaggatgtcagtgattaaacctgagaccaatgagtgaaagcctccaagaagccagtgttttgcttgatgggtggaaaaacttcaaacaattggaagtagtaagtttactctaacttgaggtatttagaaagaaatgtggtaagcactttggcaatgggaggtgataagtagtatagagatgattttagcatcttgttttgagattccatgaaatgggaaagtgacaaattgcaaggaaacgtaatgaatgtctatagatgaatttccctgactgatcattccctctcttcctaaatactttccattaccagtggtgaaaaataaatgggcatttatgagaaagcagtgacaaataggcaaggaaatagtctatttctagatctgtcaacatttctggcttcctcagttttgcttccagttttcagttttgtctgtcttcatgtatccattctctcttctataactgtttatcttttttccagtttctctttttctcccccactccttctctctttctctctctcccccccacctcccgccactctctctctctctctttcctcttccctcttccaccctgacataatgcctattatctccttctgcctctgctatcctgtcctgtcttccagtgtttttcttacctttcagaccatttgggttattttatactctttatctgtcaaagagtccatagatcataattgcttgctgactttggagaaagaaccaacttttggcaagtgggatcctgtgtatgatgaactatacaaattagataagtggaataaggtttaaattgaaaccaggagaggaaacaaaacacactataaatagaaaatggggaaggactcgttgttctaatatggcagggagagatctggggtgtcagaatgaagcatgtcggtgtataatgaacgaaacatcagcaactttatttgaaagttgtttcatttggtaactgctccacaaagatatttcaattagtaagacaaatctgcctccaggtttccactagccacttctaagccagatgatttctttttagactctctggcaaatctccgttaagcactaggtgaactatcctccttcattaacagttgactccactgtcctatgttctggtactattcctaccacacactcctaccacaaaatctattatttaactaaatcaggcattcacttagttaatacagtcaataaacatttatcgagtccctaatatatgtcggatgctgtgctaggtattggtgattacagaaatgagtaagataaaatttctgctctaaagaaactcacaacatactgaaaaaacagacacttacgggaggcagaggcaggagaatggcttgagcccgggaggcggagtttgcagtaagctgagactgcgccactgcattccagcctgggcggcagagtgagactccatctcaaaaaaaaaaaaaaaaaaccacaaacacacacatgaaataaaaaacccagacatttaatgcaaagacattaatattagaatagctatatacaggatacggtagtggcactgaagacaggaagattatttttaacctatgaaaagggaggaaaagaatgctaaagctgctctggagtttgaaaggtgagtaaatgattggggtcagccagcaatgtttttaaatatctattaataatatgaaattcaggtattgtggaggcaatatctgaatctttctctttgtgtgtaccttcagctctgaatctgaacgtggagtggggctggagctaggggacacattgcactgatgatttatcctgtttgtttcaggcagaggaacggactagatacttctcagtcttctacctgtccatcaatgcagggagcttgatttctacatttatcacacccatgctgagaggttaggatttttttgaggggccctgtataaggctttgctctggtcagccaaaaagctgttcaaggctttctcctgtctatcatctccttttataagagcttgataatctgtgaaaatttattttagtcttgatttgtctggcccaaaagaagaactatggattaggtgatgggaggaaagagggtggttatgtctattctacaagctcaggtttattcaacaacctgagcttgtagaataaaacatcaaatattcaagactcagagttactttcctcctcccatcccattttctttaggagatgtgcaatgttttggagaagactgctatgcattggcttttggagttccaggactgctcatggtaattgcacttggtaagtgcagtgaagcaaaggaaactaataatcattgatacctgacacatgtaaagcatcatgtaggcactttacacaagctgtttcattcaatcctcacaccaggcctattgggtaactgttattgtaagggtttcccctcaattttggaggtaaattctgaatgaagtcagaaactttaagaaaaaagtgcctaaggttgcataaccagtaagatgctttctggggagccttaaaaagtccaaactctgggccagtcagggacttgggcttttttttagtatctcgggtcattctaatgtatagtcaaggtggagatccactgctctacactacaatatatagggaagcaaggaagataatcctctttcaaattagtttacttcatattatacttatttatctggtaattggaaaagattttaaattctccaagccttttaaaacagcttctaggtttagctatttctgccctgctctgtagtgcccccaaagggtctgcccttgagtaaagagaataagaggagttggataaataggtgaaaattaatgcaacttaaatcaagtggcattctctttatccctgagaacccagtcctggaagagaagagggatgtggtgttccttattttacatagcctaagggaaaacttgggcatgattatttctaatcattgacctggaaacctattctccactctgagcctcagggtgacacccccttggaagatatccagtgcaaacccataaagagctcaacagaggaaaaacagcctacagactcaatgctcagtgtattttctaccagggagttgatgggagggcactgatagtagtactcagaattcccaatgccaaggaaatttattataggtgagctgtgataatatattctttacttccttctgcattcaaagccaaatattttcccaaatatttgcatggtaataatatttacataacagagtaattatgaagataaaacagagatgctataaatgaaatgtttcataaattatgaaatgttaaacaagtgctagctgtcattattagtcagcagcttcagttttctgggtgctaatcaataactcaattctctgatcttttactgtaattaatttcttttttctttttttttcttttttgagatggagtctcgctctgtcgcccaggctggagtgcagtggcatgatctcggctcactgcaagctccacgtcccgggttcacgccattctcctgcctcagcctcccgagtagctgggactacaggcgcccagcaccatgcctggctaattttttgtatttttagtagagacagggtttcaccgtgttagcccagatggtctcgatctcctgaccttgtgatctgcctgcctcagcctcccaaagtgctaggattacaggtgtgagccaccacgcccagccaattaatttattttttcattcactcatttttttaaccaacatttaatgaacctattgtgtgccatattatgtgctaggtattgggatcacattggtgaattagatacctagagcattcatgttcccaaagaacttatatagttcagtagggaaaggaagacaaacaaataaaaggaatttacaatatggtatgatcagtatttcccagatcaatatagtgtgatctaggaaagtacagagagagctatgggaatgcgtagaagcaatgtttaattaagaccttgagggaccgggcatagtggctcacacctgtaatcccagcactttgggaggccgaggcaggaggattgcgtgagctcaggagtttgagaccatcctggacaacacagcatgactccatctatacaaacatttaaaaattagccgagtatgatggcgcacacctatgatcccaactatttgggaggctgagatgggaggatcgcttgagcccagaaggtcaaggctgcgatgagccatgattgagccactgcacttcagcctgggcaacagagcaagcccctgtctcaaaaataaataaatgaataaaataataaataaataaataatactttggggattgtaaaaagtttgcctaaaggaatgacatttaaggtgagacctaagggccaaacagcaattaatcaataaagaaattataagtgatgcagaaagaggacacagtagctgtaagacaagaggctgagaaatagcatgacatgtttaaaggttttaaaggcattcagattacctaaagcataaaaaagaatgataaagaggagaaactgccagaaaccagataatgaagggccttttaaaccaataagaaattagaactttattgtgagggagagtggggaactctaaaaacattttaacagaggaataattgctagattttaatttttcaatgatgtttctataatgtagagaaaggattgtgttggagtgaggcaaagataatatttattttgattaccgaattttttgatacttgcttaaatttagtgcttgagatgagtgcttcactcagtttaccctaatctggccctggttgaattaacaaaccttagaatggttagatatgttaagtgagggagaagataagccaaggtttaatgtagtgttctgaaccttgaacaactgggtaggtagtggggttattaactgagctagtgaggaaaagccagtttggggcaatgttgataaatttagttttgaacatgttgcattttatatgttcttggaatatttaattggagttaccaaacagttatttggaaatacaggattagagcttagaagaaatgtttgcactatagatatagatctggagtcattagtatatgggtagcaataaaccatgaaatgaagatagataactaaaagctagaagagtaaggttaaaaaaaaaagtggggtggggggataggttcaaacttcaagaaacgccaggatttaaaagacaggcaaagaggaaaagcccacaaatgagactaagaaggaatggccaaagtggtaatagcgttatcttggatatgaagaagatttcaagaaaagattcatttagagtgataaatgttcctgagtgggagattaagataagggtgacagatgtctattaaatacaacaacaaggaggtcactgatacgattagatcagttatggtaaatggtggaggctgaagactgattggaggagactgagaagtaaatgttacaggattccttcagtgctgctttgtcagccagaaatctctgtggccactaccgcctctgtctgggccttgctctggcccactgggctcgctcagcctgcgactggactgggcatgtagcgagcagcttctgtgttgggtgcggcatctagacaaggggaacacggtggcgcccaaaaactcggagatgctagcaattgcagagtcctaagaggtgttatagctcctgctcagggagtcccaaggtctgagcccccagaaatgttacagctgttcactcctgtagttcaacgagcaggagcatgttacaactctctcctgtagtctagcgagcgggagcgtgttacggctcttttattcccgctgcccatagcttggcgagctgcccaggggtgtcacagccctttcattcccatcacccacagctcagcaagttccgggttcttgtcccatgatgaagaggaatggggtgtgtggacaccagagagtgagtaaagcagagaagaattttattgagtggcagaaggaaagctctgagctcctagaggggacccgaagtaggtagccgtctgtgaggcttagtgtgggttttttatgggttttgaatgggggagtacatgctgattggtccatgggtgggtttggaaaaagtaccactagattggttaaaaggcatcatccaaaaggaaccaatggagagagaggataagacggagatagaagttctcactcaggtcatggactctatcaggaaccggcaagtcggttttcaggctttaaactgtctttggcttgaaggtcgggtttcactgggacccgtccgtgtctgcctaggaatttatctgtctcttgtcactatcagtaagaaagtgaaatagtatttatagttggaaggtgacatggattcaagagaggatattgagcatgtgtgaatattattaggaataatccagtggagaaagaggttgaagatacaagataaagacagtataatcagtatgaaaacacatatgagcaaattagctgcggataggaggaggaatatcaccttcacctacctggagggaggacaggatgagtgtggatacaagaattaatagatctggtggcagggagttgaaggagtttccatttgaaggtttccattttctttgtgaagtaagaggcaacatcatctactagaaggagtagatagtagagaaattcaaggtttatactcatcttctttagttaagtgtctttgacatgtaagtatgactttagttgattacataagtcttcctattatcactccactgtcactattgcaaccagcattcctgtggtgtccagcctctttctaggatcattcttagtttcaggagcagtttattccctacccaaaattttcctttgtccaggtatctctttttttgttttttattttttactttttttggagacatagtctcactgtgtcagcaggctggagtgtggtggcgcaatctcagctcactgcaacctccgcctccgaggttcaagtgattctcctgccttagcgcctaagtagctgggactacaggtgcgcacccaccacgcccagctaatttttgtatttttagcagagatggggtttcaccatgttggccaggttggtcagctcaatctctcgaccttgtaatccatccgccttagccttccaaactgctaagtttacgggtgtgagccaccgcgcccagccgtctaggtacttttttatctgcccacttgactctcaggattagcattcctccactgaactattttttctatcaaccatgagaagggtattatagataaaggatgctatttggagaagctttggggaaattgagaggatgaatgagaaaaagtggtagagtgaatctgaatgagacgaatggagatattaaaaagtgatgggagagaaaagtaaagtgatttgtgcattctgatgtgtaaggatactggaaaatgctacttgtcactgagaaaatcatctttagcagaggatctactagaggggcatcacgctgaagctgggaaatccgttaaggaggaaagtgcatctgggagggaaccaagatggagtatttctactgattttaattgaatgaaattgaaaaaaccactattttataactacaaaggtaataccagctcattgttaatttggaaaataaaaggaaaattaaagaaatgaaattcccttacaattagctgtggatatgtggttaaaggacagagatatgggctgaaagaaacagaatgagctcaagaacagaaatagtatagaacagaagtgtttgtataaatgatgaatagtgtttacagcatagggtatctcaaaaagatagatgaaatataaagtgggaaacggcaggttgaggtgaactcctttgaggacagggaccttgtttttttcacctgtgttaccagtagtgtctagtacagtatgtggtgtaagaattagtgagtgagatgcattataaggattaaatacatagatttttgagtcagtcaagcctcaggtcaaaagtccagttctggtatcttctagcagtgtaaccttgtacaaggtgcttaatttccttaatattccttcatgtataaaatagagatagtggtacatattttgtcaagctaaatcaattaatgtatgtaaaatgcttaacaagttacatgtgataaaccttcaaatagatggtagggataacaataaccattaggataacaatgaatttgggaaggtctttcatgccaggagtttgggtcaggtaagtattaatagatcctggaaagaaacatttggcatcagattaaagaaggaagagactagggaatgagaaactagttggtggccattttaataatccaaagtacaagttgtgaagtcctgaacaagagtggtagcagtagtaaagtgaaagagggggcaaataggcaatacgttaaagaaagaggaccaataaaacttggtaacatttcagatatggagatggagaaagaagagtaagaagtcaaagatgacttccacttctgtgattacatgaaagtctcaatagatatctctcttaacaacataccattttgtcttctcttggctcctgcaattttgataactccaaaagtcaggaaatgtaagtcagctccctctttatgagatttgccagccactcccacagttcagcattctgtccttagcgctgatatactgaatgtgctatttaggtttgtgcaaaagttattgtggtttttgccattgaaagtaatggcaaaactgcaataacctttgcaccaacctaataaatgagaagctaagaaccttgtttgtgtatcaactgcagttgtgtttgcaatgggaagcaaaatatacaataaaccaccccctgaaggaaacatagtggctcaagttttcaaatgtatctgggtaagtccataaattgttttcttgcctttttcaatcaaaagaaagagatgctatgctgagaatatgggccttcaaacgtgggcatacatttttctcaatgacctctattctattttcatgttttttaacaagctaagattaaccagtcttcttcttatgcctctacttaaccattaagttaaaaaaagtaatcatctttttaagttggcaaaaatcttctgaaatgtaattatatatagacagataacattttttcttttttgttgttattttttgttttgaatggcaagttctttcttaaagtgatagataaaattatatcagaaatattctgaaattcaatgcctgattaggtcaaagagttggaataagtcactagaagtatggtgtttgaaggaaggtataataagttggaaaaggcagaggatgtttttctctttgtctctcccatgatgtctactctctgccctagtttgctatttccaatcgtttcaagaaccgttctggagacattccaaagcgacagcactggctagactgggcggctgagaaatatccagtaagttggaaatgcagaaacatcttatggcttgatagagtctttcctaatgttcaaaatgattctatcctactgcattcaacctcctctctactgttttttggacacttctactttaagcaagaaagccatgtacagaacttctagcatttctgcccattcttcctccttttcgcagaagcagctcattatggatgtaaaggcactgaccagggtactattcctttatatcccattgcccatgttctgggctcttttggatcagcaggtaagaatagttcttttggacattaccgctccttacagccacttccctctcacaggaaagggatttctcataacaggatctgtttgccctagggttcacgatggactttgcaagccatcaggatgaataggaatttggtgagtagaagagattttccagagaagtctattattttcttcatcatccatattggggaaaaattaatttctttgtgattttgcctgaaaactaacaagatcttcagagaagtgcttttagcctgaaggtaccgtgtaggcaaagataaagaaagctagtttagaaataaaaaccagaatcttctctttagaaatcaggaacataaggatgagaaagtttcaatgtatacaaggaagtattgagaggctagcaaatgatgtgatgcgtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgagaaggttatacgtattattttctctttttccaaactccattctttagcccactcaaataaggtaccatctctactctcaattgttcttttcctagattagtgtattatttttctatcttctcagtttttgaaaagacagagtagaatgataccagggtcttattagtcagtctatttggagcctgcaaaatataattttaccttttcccttcctctggctgtctcttatttaccatggtggtcttcttgttgaccctctggagaacaactttggaaacactatgtgtcagggagagtcttcaccctaaccatgatgtcttgcccttcatattattacaacctagaactgcagttgctgagatcaataaaaatgcactgactctattctctttcaagttaaggaaagcataatacatagaaaataatttctcccttaggcccatctgcctggcaaacatagccagaagctttcccaagtctgttcccatcccccaaataatcttaacagcaaaatagtggccctgaaccaaagacctgatgaattttctctcatatgtttctcacttgctaactagcaaaattattgatctaggccaacatttttttttcttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgattaacaaccataatttgatgcttttctccttgtacgctgataagggccaagcttcgacatgaaaacattcccattaagccccacccttctccttcacatcccctgttaagtacttaacttgcaacgggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgagtgcagtgctcacactcatgataggagaatatttgtagctaatcctttttatcatggtgttacaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactgcctattgaccctgaaaaatgtgaattagatataattaatgagagtcaaagccattactgtggacttaactgtgtaatggtggtggaggggcaggtctaggtttcatgccaaaccaaaaatatgtgaaatttagctcctaaaccaactttcttctttgttcttgaatgttgtctcttcaaagaaactcaaggcctttgatgactactaatccctttaaatctcctgttgtccctacaaaacaaatggggaacctagtaggactggggactgaattattcccaattactgcctgaaattttttctaaatagaaggactagtcttttttagagtttggcaaaagaaagtttcaagccttctttcattcttgatttaatagcaatttcattttgatgaccactttaccagatgaaaatggccctttgtcatttgttcattgagcaaatgttgggaagtttaggaccaagtgtcatgaaaatataaatcaagcaaaaaaaaaaaaaaacatttccctcaaacagtttattacttagtaaaggggctagagtatatatatatatatatatatatatataatacaactactacacaggtaaaataagtgtcctaagaagggaagatcaagtgccaaggagatgtagaaaagaaaaagtccctcccctgccaaagccaacagatttctgcagaggaatgtgaggtaaagcatgtacagcacttggcatatggtatttgttcaataaacctgattgtattgccattatttttggtgttatgacatagcgaatagaaaaaccatcataagcaaagatggaggtgggtaaatgtggtgtatcacagagaagagcagttcaatgtgactcaagaacaagaagaaagaagcatgtatgaaggggagttctaggaaatcccttgaaaagtaattggtcatggaaacatggatttaaaaaaggaaagtaattgggatcaaatcaggaaaagtctttgatgcagtttgaatatttgtacccactcaaatctcatgttgaaatgtaatccccaatgttggatgttggaggtggggtctggtgggaggtagtcggatcatggggatgaattcctcataaatggtttagtgctatcccgttggtgctgtccttatgatagtgagttctagtgggatctgaccatttaaaagcatgtagtatctccctacccttcacttgctcctgctttcaccatgtgacatgtctgtttctccagagggtacaagccataaaccttggtggcttctacatggtgttaagcctgcaggcatacagagtgcaagaatgaagaatgcttggcacccttcacctagatttcagaggctgtatgagaaagtgtgggtgttcatgcagaaaccggctgcaggggtggagcccccagagagtacctctactagggcagtgtggaggtaaaatgtggggttggagctcccacacagagtccccacaaggacactgcctagtgcagctgtgagaagggggccaccatcctccagaccccagaatgatagacccactggcagcttgcaccctgggcctggaaaaccacgggcactcaacaacctgtgagagcagccacaggggctgaactctgcaaagccacaagggtggagctatccaagtccttgggagcccaccccttgtattggtgtgccctgaatgtgggacatggagtcaaaggagattattctggaactttaagatttaataactgccctgctgtgtttcagacttgcctggggcctgtagcccatttgttttggccagtttctcccttttggaatgggaatgtttacccagtatctatacccccattttatttggggagtcaataagttgttttgattttataggctcatgggtggaagggacttgccttatttcaaatgagactttggacttggaacttttgattgagtttgtgctggaatgagttaaaatttggggaactattgggaagatataattgtattttgcaatgtgagaaggacatgagatttttggggggctagagatggaatgatatggtttgaatatttgtccctgccaaaatctcatgttgaaatgtaattcccagtgataaaggtggggcctggtgggacatgactggatcatgggagtgaattctcgtgaagggtttagcaccattctgtggtgctatcttcatgatagtgaatgagttctcacaagatctggtcatttaaaagtgtgtggcacctcccatctcctcgcttgcttctgctttcaccatgtgacatgcctattccacctttggcttctcccatgattgaaagctcctcgatgcttcaccagaagctggaagatgccagcactgtgcttcctgtaaagctacagaaccataagccaattaaacttcttttctttataaattacccagtctcaggtatttctttacagcaatgcaagaacagtctaatgcagtctttaataataggctacagagtttggatttcatcctttagagtctaaagtttagatataattgtttctcctttccaccacagatcacttaggaaaatggctgttggtatgatcctagcatgcctggcatttgcagttgcggcagctgtagagataaaaataaatgtgagttcagtaattcttaagctctatgagggcaggatcatatctttcttatttgctcttttgacttgttcagtcatgattccctgggacctagcacagtacctgttttataagaggtgcatcataagtatttgtgataaataagtagatacaggggtaaaacagcaatgcaaaatgaggcccacctcccacctgagtgactcagaatgtattttcagggaattctcaaacactaatatccaagagagccctctccttagggaacacaggcttatgtgatgcctttctacatactcaagtaaaaaccttttggcagattgaatagccactattacggatgaggccacagctgagtcaaaaagcatcgagtttgtaagctggcattggtacttgctacaatgagctgatgtttccctctccaagctgcctttagagttttctaagccaaatatttttcagagggagaaaactatgtctacttggctagtggactaggctgtcagaaacaactgagatatgtgttgccattgtatctgaaggattatttgttggtgattctgacatgtgttctttgctctaaggaaatggccccagcccagccaggtccccaggaggttttcctacaagtcttgaatctggcagatgatgaggtgaaggtgacagtggtgggaaatgaaaacaattctctgttgatagagtccatcaaatcctttcaggtgaggtgtgtacctgaatgaattagaaactctgtatgctatattgatcttgatttttccttaacattaattgtatcataagcatcttcccatgtctttagataatctttgagcacatgattttaatgggcatataatattccattctatagatataccatagtttatttagacatttccacataggtattccgtttttattattatacataatcctacaatgaacattcttattcataaatatttatgcatggctctgattatttcttagggtaaattccaagaaataaaatggctaggttaaagaaaggaattactaggttgaaagtgtctgatgaggtcacctaccctgagatgctacatcgtgatgtccaatatgcagtagaaggtgtacgtgaccttcattttatattcttcattttacagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaatttgaggaattgcctgtgttttcagttgtcatctcaaagtaatatgactgtctcatcaacatcttaccaaggatctgcctgatgatcaaattttctgagtataggtcttatttcatcagctgttactgatttttactttcctctgttgtaggtaaaggatacagaaagcagaacaaccaatgggatgacaaccgtgaggtttgaatgtcaatgagattccaggccactctgttttcttgaatcttggatctcttctaatctttggggctgcattctacttgttctgaacaggaattccctctcgtagaatgccaggggcactggtgtcaaaaggcattttctaggacagtgagaggcagataggcttcttttctcatgtgggattcgaagatgactctatctgtgtatgccccctgtactctggggcataaatcctttctgctgaattttatctatttatcttgctctcaggaaaataactgagtacttttctctctgtgatcgccagagagaaatttggaagtgagaaaataatcctcccttcatttttgatagttgaatatatatcttttaaagtatagtttttattataagcctgtagaggcatcatggtatagcacacatttggagtcaaaagacttagttttgaatccagataaggctgaagggtcttgtcaaatggtgagggacagttacagagatggagtacccaagaggacatgtgttctctgtggctggtattagatatgaaatggacagatacacaggtctatggccaccaaggtcaagtggttgctgttgagaatagcattttagtggagaacttttagtgaaaagtctggatttcactgaaggttgggacagtcataataacttgcttttgaatatgcttcaaaaaaagtaaacagctcaaaataagacaatgtgaggtcagagagccatgggcccccagaaggggcattttctaggtcagtgtagaatgatctaaagtctaggaatcaacattcaggactctaaagggaaatgtccttcttattcctggggccagagaccaaatcaaaagctatcaaaacagaaatgtaccaaaacccatcctgagaggacaatctaggtgccaggttcagaaaaatagaaagatggtcttggaagggtccaaagtttctgcagactccaaaacaattataataacctactctgggctgggagtctgagttttgcataggtcacattggacttcatttataagaggataagatatcagttttatgtaaatactatcatatctttatatatgcataattatcttatttttcttagtaaagtctcagttgatagattccaccattataagggaaataaattagatgcacctaagctggattagtgaggaaactcagatttccatgaatgatcatgatagtgtccgtctagctagaggtctggtgaggatgtggcagataaaagttcaagaaaaagaaagttagggacagctaagactatggattactttttacgtgtgggttcattcgtctagttaacaatatacattaggtaccttttatgtgccagccactatcctaggcacctgggcactggggatatagttatacccaaaacataaaaggcccctaacctcttttatcaggtgttcctgtttgtttgatatgtaaataatatctctaccctcaggtttgttaacactttgcataaagatgtcaacatctccctgagtacagatacctctctcaatgttggtgaagactatggtgtgtctgcttatagaactgtgcaaagaggagagtaagtgcattgcccctgtggacattttacttttgtcaataattgttttttaagtgctatctttgtatataggtggggaacttaggtgcatgtggtctaattttgagtatagacgcactactgatcttttccaactcttgcttccttccctcagtctcactttttttctgcacagatatgttgagatcacgattgccgtgaagaccacactatatagttaacacagcccatctctgtatagttaacacagtccgtctctgtgagtttctcaaagtttattattggtttccatttctactaaagaaggtactttggtaccttacactggcacttcattacttagagcttatcttctcaggttcactgttatagcctgttctactaagtcataagatttgcatgaggaaaattcacatggtacttaagttaacaaaagaatatgatttgtaacttctttatttaggttgaatattttagaaaatacctgacaagcaataaagagctcaaatcagggacagaagcctggcatgaaaataacctactccaagaaacatttctcttcaaagataattagtggcttcactgctttcctcaccatcagtagagagatgagatcactttcacctggagatgggaatgcttttccaagccttgatatttattctaacctaaattcatcctgttccagataccctgcagtgcactgtagaacagaagataagaacttttctctgaatttgggtcttctagactttggtgcagcatatctgtttgttattactaatgtaagtagctcacagccacctctttaccctctctccatatacatatatctcctgagatcctctaggcaggggcagaaaacaaaagagaagactctgtggcaaagcagacacgtatatttatttctagcataagatgacaggttctacagtgactttaattatttttatttttattttttttgagacagagtttcgctctcatcgcgcaggctggagtgctgtggcaccatctcgactcactgcaacctctgcctcccgggttaaagtgattctcctgcctcaacctccccgagtatctgggattacaggcacccaccaccaccatgcccagctaatttttgtatttttagtagagatggggttttgccgtgttggccaggctggtctcaaactcctgacctcagatgatccaccagcctcagcctcccaaagtgttgagattacaagcgtgagtcaccgcacctggctctacagtgactttagaaagcccactgtctctgtaggggttgttaagagataacatcaacaacaagcaaagggtcttggggaaggagaaacataatttatcttgagccatcactgtgagatgccacagcttgctccagtctttttatgtctccaatcaaacacaagttatttatgaaaaagtactaatgtcttcttggccagcttcatatgcagatcttctcactctctggaaatttgatctgctagcatgtcacagtctgaaatactgaaactgataataatgtcaatccctacacaaagtttggggatcagttaactgtgatctgtcaaaaacaattgtcctagcagtcagggcagagtaactgattttaattttgatgtcaatcttgactttaattttgttatttcattattattcatactgtattaaagactaaaagatagtgaataaaaaaaagagagaacatttctagaggtttgatgagaacccaatctacaaagttctatttattttactaattaattaatttaattaacttgatccctttggtgtgccattttttttctattattatactttaagttttagggtacatgtgcacattgtgcaggttagttacatatgtatacatgtgccatgctggtgcgctgcacccactaactcgtcatctagcattaggtatatctcccagtgctatccctcccccctccgcgcaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttacagtcctttgggtataaacccagtaatgggatggctgggtcaaatagtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactgatgtgagatggtatctcattgtggttttgatttgcatttctctgatggccagtgatgatgagcattttttcacgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttttaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggccagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaacatgctgttttgattactgtagcccttgtagtatagtttgaagtcaggtagtgtgatgcctccagctttgttcttttggcttaggattgacttggcaatgcgggctcttttttggttccatatgaactgtaaagtagttttttccaattctttgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggattgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagatttggggctgagacaatggggttttctagatatacaatcatgtcgtctgcaaatagggacaatttgacttcctcttttcctaattgaataccctttatttccttctcctgcctgattgccctggccagaacttccaacactatgttgaataggagtggagagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagcgttcgttgttgaattttgtcaaaggccttttctgcatctattgagataatcatgtggtttttgtctttgtttctgttttatatgctggattacatttattgattttcgtatattgaaccagccttgcgtcccagggatgaagcccacttgatcatggtggataagctttttgatgtgctgctggattcgttttgccagtattttattgaggatttttgcatccatgttcatcgaggatattggtctaaaattctcttttttggttgtgtctctgcccggctttggtatcagaatgatgctggcctcataaaatgagttagggaggattccctctttttctattgattggaatagtttcagaaggaatgatatcagttcctccttgtatctctggtagaattcggctgtgaatccatctggtcctggactctttttggttggtaagctattgattattgccacaatttcacatcctgttattggtctattcagagattcaacttcttcctggtttagtcttgggagggtgtatgtgtccaggaatttatccatttcttctagactttctagtttatttgtgtagaggtgtttgtagtattctctgatggtagtttgtatttctgtgggattggtggtgatatctcctttatcattttttattgcgtctatttgattcttctctctttttttctttattagtcttgctagcagtctatcaattttgttgatcctttcaaaaaaccagctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttgaatctttcctgctttctcttgtgggcatttagtgctataaatttccttctacacactgctttgaatgtgtcccagagattctggtatgttgtgtctttgttctcgttggtttcaaagaacatctttatttctgccttcatttcgtgatgtacccagtagtcattcaggagcaggtttttcagtttccatgcagttgagcagttttgagtgagattcttaatcctgagttctagttggattgaactgtggtctgagagatagtttgttataatttctattcttttacatttgccgaggagagctttacttccaactatgtggtcaattttggaataggtgtggtgtggtgctgaaaaaaatgtacattctgttgatttggggtggagagttctgtagatgtctattaggtctgcttggtgcagagctgagttcaattcctgggtgtccttgttgactttctgtctctttgatctgtctaatgttgacagtggggtgttaaagtctcccattattaatgtgtgggagtctcagtctctttgtgggtcactgaggacttgctttatgactctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcatttttttttttccatttgcttggtagatcttcctccacccttttattttgagcctatgtgtgttctctgcacgtgagatgggtttcctgaatacagcacactgatgggtacttgactctttatccaatttgccagtctgtgtcttttaattggagcatttagtccatttacatttaaagttaatattgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctggccatgtgaggtgtcagtctgcccctgctggggggtgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggccgccttgagctgtggtgggctccacccagttggagcttctcggctgctttgtttacctaagcaagcctgggcaatggcgggcgcccctcccccagcctcgctgccaccttgcatttgatctcagactgctgtgctagcaatcagcgagactccgtgggcgtaggaccctcccagccaggtgtgggatataatctcgtggtgcgccgttttttaagcccgtcggaaaagcgcagtattccggtgggagtgacccgattttccaggtgccgtctgtcacccctttctttgactaggaaagggaactccctgacccctcgcacttcccgagtgaggcaatgcctcgccctgctttggctcgcacacggtgtgctgcacccactgacctgcgcccactgtctggcactccctagtgagatgagcccggtacctcagatggaaacgcagaaatcacccgtcttctgcattgctcacgctgggaactgtagaccggagctgttcctattcggccatcttggctccagccacctccatgtctcttttaaccctcctggccaaaagcagcaacactttaacccttgttgcaaaagaatctgttcttctaatcttgttcattttcttcaatttccactacttcttttctaccaggctgataaccatagcaggcctgggcatagcctgagaagtataatctctgctcaaagaataaacacacccttaccaagggaattatctgaaaatttattttgtttgtgtaattcagatgccattttatgtttaaaatgttgtccaggatcaaaatgcctgatagggcaaaacggtggaaatccaaactgcaatatcaaaatattctcttatttaaagtctctgtcaataatgatatctgattgaatctaggcgagtgagcataatattacgaaaagaagttttgaaaagctggaattgtgtagaaatgctcaatttcctgaaaatggctgaagaatgaaaatacaaaaaggatggatataagatcgtagaatgctgtagttagaaatatttacttgagactactgacaagtccatttccattttctctttccctaagaacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggtaagtttttgcaaatagaaggtagaaattgaggcattgcttgaaggacaatgaattttaattctagcactgacttaaataggtatgttatctcttttggccttgggtaccttatttatgaccctgaacatatatgacctgaacatcttaactccccaggtcatgacagtacagcatgggagtctatgattttggggttctaggaaagagattaaagattaaaatgaagagctgcagagtcagacttcccgtgttcaaattttggctgcatgacctattgtgtaaccttgagcaagtaaattactatctctgtaatgctgtcgcccaggctggagtgcagtggcgcgatctcagctcactgcattccagcctgagcgacagagcgagactccatctgcctccccggctcaagcgattctcctgcctcagcctcttgagtagctgggattataggcgcacaccaccattcctggctaatttttgtatttttagtagagacagggtttcaccatgttggccaggctgatctctaactcctgaccttggatgatctgcccaccttggcctcccaaagtgctaggattacaggcttgagctactgcgcccagtctgtaatactattttttaaatgtataagaatacgaatagaacttatctcttaggattgtaatgaagattatatgacataatgagtttaaatatattcagttaggagcttcatcttattcttactgtttacattattaacaccctctgaatcaatgtgatagctgaacttaataagagaagttctaacttggaagcttttgtgggagaagtttcctggatgcatggggcatgagggcagtgaagggagtttgtttactttcaaacttgtgtcatccccaggctccctctagcatgaaatctgtgctccaggcagcttggctattgacaattgcagttgggaatatcatcgtgcttgttgtggcacagttcagtggcctggtacaggtatggatctgagggaagcaggattcatttctactcaagtttttcctccagctttctcttctccctttcccccatctctctgcttcccacattccccattcagtgctgtgacatgaaatgggttagatatacagactttaccaggaaaatagacatatgtaagtggcaataatgactacaatatacctatgtgaggagaggccagtgaacccagtctttgtccagcaaaagtctggttaaactggtgatcccaggtcagtctgctccccactcctcatcctgtaaagatctctttagtttcaggtttctccatattcttctcatatttatttccccctgcagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagttcgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaat

SEQ ID NO: 12860 - DNA, 148609 bp, Human
gtgcaccaccacgcctggccagttttttggtattttttgtagagatgggatttcgccatgttgcctaggctggtctcgaactcctgagctcaagcaatccacctgcctcggcctcctaaagtgctgggatttcaggcatgagccactgcgcccggcctaaagtaatttcttacttgagattttatttcaggctactgtgtccatgcactgggcagtacagcctggtgggtaagacagcacagtattttttttttttttttgtctgctgggtttgaattttgttttaatacacgcaatttattctgtgcttcactttcttcatctgtaatatggagataatggcatctacctattaaagttgtgaagattcaattagatgagttgtatgaataaatgttagctgttagtttagtttcgtttttttgagacggagtcttgctctgtcgcccaggctggagtgcggtggcgcagtctcagctcactgcaacctccgcctcccgggttcaagttattctcctgcctcagcctcccaagtagctgggattacaggcgcccgccaccatgcccagctaacttttgtatttttagtagatccggggtttcaccaagttggccaggctggtatcgaacacctgagttcaggtgatccactcaccttggcctcccaaagtgctgggattacaggcgtgagcccccgcgcccagccagctgttagttaatcaagaaattcgactgcctactacttaacctgcacagttctaggtgctggggaaacagtgatgaacaagacaagatccttatcttcaagtagcttttacattttagtggagtaaaatgacagtaaacattgaaaataaatttcagaaagtgctgtggaaaaactttacaacagacgcaggaatagatttcatttgactagttctcccagtttccagaaaagtcaagggtagaatgttaaaaggcaactcagaggaggtgaatctgttagggcctacggtaatgcaatcctggtttgtggaattctgcaggctagtgtgggtaggttacaattttttgggggagttgttttttactttgtttgaaaactcacttcttcccgctgagcttttgattaggagctgaagttgaatcagtttgaaattgtattctggaccggatgcggtggttcatgcctgtaatcccagcgctttgggaggccgaggtgggtggattgcttcagcccaggagtttgagatcagcctggacaaaatggcagaaacctcatctctacaaaaaatacaaaatttagccgggcatgatgttgtgagtctgtagtctcagctactcaggaggctgaggtgtgaggatcgcttgagcccgggaggcagaggttgcagtgagccgagatgccactgcactccagcctgggcgacagagccagactctgtctcaaaaaaaaaaaaaaaaaaaaaaaaaagaaaagaaaagaaaagaaattgtattctgaatacaacttctaaaacactatatttacttgcattatattaaactggttttatcctgaccacaattgcaggtggaagataccactattgttctatttttctggtaagtagagtgagccatgtcttgcccagggttacagagcttggaaaagacgcctcctaaaaatctgtaggaccacctttggttttcttccagatttttttttgtcatctcttttcctccacccatttcccatctgtctagccattcttgctccgctgggctttttcgcgagcctctccccagctgcagccccgcccatctcctggggcgtgaccacctgtccaggccccgcccccgtccaaccggcggagacccgccccctttcccggacaccgggctcagcgcccgagcgtgcgcgcgcgtcctcgctcgtcgcccggctcggcgtcgggagcgcgctctgtgtggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccggtaagaaccccatccccgtcctccgtctcctcggcgggtgaggaagagctggaggaggggccggcctcggccccggccctggccaggcggctgtcaccctctgaggaggcagcgccctgggagggctggggactgcgtgcggggcccggggaggggcgtccccggcggctgtcgccgccagggggaggcgctgggtgtgggagtgggaatgggagctcggcggccgagctcggcccggaccctagatgcgggggaggcggggtcccgggctcgggctgccttcccagacctggcggggatgggcccgtgcggctctgggtgtgggacgtaccctcggagcgcccggagttattcccacgaactcccgggaggtgggtgtgcgcccttcgccccctgccgggtctgtggcggtccatcgttgccggatactggaggtcaggggccatgggagccccggggcgaacggtgcgggcctgggccttgtggaaaggaggagtgaccgcccgatcgtgcagcagggcatccccctgacctggtagtacttaggtgggtaggatgattgggggcggttggcgtaactgagggaaccctggtcagactgctccgcaaatgattacagtgttatttctccggtagtaattttgcttgatgtatggcatttccggacccataagatgatactgtaggttgtattttggactggaaaacttatgtcaaaattatggggtagattttttggccacattaatagactcccctggaatttgataatctcacttgtgagttttggacatggactgctattacatattgatgttcaaatgtcctttccagacccaggcctaaattcttactgttgtagtatcttgattctgacatctatttttccacaacccaaacaaacaaaacaaaacaaaacaaaaccccaaaaccatatacttttctagttaaggttcaactttctcatatgtgaatggtaatgccataagaggcctgggttgaattacaggagattattattatttttttcaatgtgaaatgtttgtgatttgtccatggagaggtggtggggaccttcccctttcagattcagggctgttcagtaggacaggagacattgatggcatgcagaaagtcttccctttatagggcctatgacttgggtaggctagaagagcttacagaatgacactttttttttttttttttttttttttttttaagacagaatctctctctcccgcccaggccggagtgcagtagtgcgatctctgctcactgcaacctccgcctgccaggttctagcaatcctcccacctcagcctcccaagtagctgggattacaagtgtgcgccaccacggctggctaatttttgtatttttagtagagacggggatttcaccatgttggccaggctggcctggaactcttgacctcaagtgatccgcttgcgttggccttcgaaagtgttgggattataggcgtgagccactgccgccagccagaatgacactgttttgagtaaacccagtatagtatgtgatattaaattaaatttggaggattctagaattttagattggctgcctatgaatacctcttttggctccaattactccctcattttcaggtgactcagagaacttcaagtgaccagcacagtggtacagccccgcttgtcgttaatgaccagccataaaaaaccctgagtttctcagctcataggccaggttcttcagtggttgtctagtttaaggctggtcattagaaatattatggactacctaaattcctcgaactcatgcaggacctggtgaattaaaatctctgaggatagagcctggggatctgtccttacaaagctccgtgaatgattctggtcagcaaggcatgtgaacttttgctttaggttgggtattccaaagaagtcccattaattatgacttctcagggtgcttttgtttatagatctttaagaatttaagaggtggagaaggggaagcatgagaaacttaaagagatgcaaattgagcatctcttaaaatataatggatttatgtaggggaaacagatttgttgccaaaagttaatttgcaaacaagttattaggaacacacttgataaaattagatgctgattaattggagatatactgtatccagagatatattgaaggatccagaggaaataaacagagaaggagagggagtaagtcggcttctggctcataaaggggtccactgaagatgcttcccaccattatggttgctcctaaaccatctgactcagatttctagtggagggtaggatgggtgtgttagcaatcatttgagacccgggttgtgaaccaggaagggttactatgtattgtgaaaagttcttgagatttgccgcaggccatgaggagtggtaaagtcagtttaaaaatctgctgtagttctagttaacacgttcacaccttcttcagtaaagtggaatgctgttaccaaaggaagtattcgtgttttagaggggggtgtggtgaaggttcttacaagtttggaagaggtggaagaaaatgttgttacaattgtgtagagtagtgaagggctttggtaaatatcctgtcaaatcatagagtagtatttttagagttgcacccagctgtccattagaagagccagaggccttgtctgttttgttccctggtgtccccagtatccagcgcagttatccgcatattctgtgccctcagatattttttaattaagtgaatactattgatatgggaaaaagaacagttatggtggtttatagcagtgttagttattaaaagctacctgatattttgcaatggattaaagagccaatttttgatcaaatagggctctgggtaggaaagaaaatgaaaatgaagagccagctttcagtgcttattgtttggaatttttgagattcctttaagaaattgttttctaaagactgtcatgaacattatcgagtcccctagtttttgagtcttaatgaatcttaagtgtttcagatgttagttacttttttaagagcacagtaagtgcaaaggtagtatagaatagtgggaagttctggattgacagacatatattctgattccatctgtgtcatttattgctgttgggaatgtcacttaacttctctgggcgtcagttttctcatatatacaattaagggcctatagtctttgacctcaagtagtttctctagcctgattctgcaaatttttaatcatttctaattatgttatttggtattcatctcatataggtagatgaacttttattatttaaaagaaacaagattctgtgttgggttctgcttttagcttatggattttagacattgtccaaaagtgcttccgatgttgaatgtatgttgcaagtgttatgtagaaagaacatgcttatgctgttgtaattggcttagtgttgaaatcaaattgggttttacattgggaacttcataatttagtgtgaagtcatgagacttgagaatggtttggggggagtttgtgcaatttatatagctagctgtttcttaccacctaattctgtaattttctatgatgaatatatagataaatttataatcagtgtaacattgatttaagttataagatgatatcagattcatactggattgaactagaactcccagtaactttagaggctaccaaattattaacatgtcattgctatttttaatcttaattttgtgatatcaatactgatatgctttcatctttgcttttgtatctagaaacaatataccttttaagttcatatttgtatcagatattaaaaatgaaaattgtagcatgaaagtgggtagatagtaaatcttgggttcaagcctgggttgttattcttcattacccatgttgtttctggcaagctacataacccccctgagctccagttccctcattagtgaaaggaagaagagcaacttttctacttttctaacagactgtggatcaaacaatagtgtatatgaaaagcattctaaaaatgtaaggggctggtattagaatcgtattgtattagaatcctattttatgtctttgaagaattggcttgtggagcagtggtaaacctagtctgtattgtcaagtgcagaatttaccaatatcactgatatggcaacagagaaggtttctgcttctgtactctggctggagaaacctttcagcacatgtatcctgtctgccagtcggaatagtcacaatgttgcagggacttcagaggaacctgggatgtctcacatttatgccaaggtctctacttggaatagacttggctagatttcacccattttcttatgttggagcagtggtagaaggtggtaggagcaaggagttcagcacattctgtgtaaagttctaaggctgtgtttttaagtagcaggtggcagtgtcatagggtaatgaaatcaatgtacttatttaaaaaagcattttcagaaagagaatatatcagtacattgcataaagtaaaagtaaatatagacacagaggtattgtcttgatgctgatagctgcagatattcagaatgattctgttacaacagatggtagcaagcttttctgatttcacttatctggggtctaaatctaatttctttagtagttaatactgttttgttttgtttttttttttggacacagaatcttgctctgtttgcccaggctagagtgcagtggcacgatctcggctcactgtaacctctgcctcccgggttcaagatttgggaaacttttgtttctttttaaaagatatttttatgtatgtatacttggttgccgtgtaaaatgtattttttctttttaaaaattataattttcattttttgtagagacagggttttgctacgttgcccaggctggtcttgaactcctgggctcaaaggtagtcctcctgctttggcctcccaaagtgctgggattgtagacatgagccactgtgcctggcctaaaaggttgtttttttcttttgggttgtgataaaactttgtcgtcgttgtttggggacatagtacttgggcaatgtggatagaatgactgtctataaaatagtaaggcatgaaactaacgaaaacaaaaagaaaattgtgaaggtgggttaccttaaagctattctgttagtggtgaaatacctcatagctatgttctgaactgttgatttaatgaacaaagcacatgaacttatgctgtaataatattcttaagtactcttttcccttaacatggagtatggagtactttaaccacagaggtattgtcttgatgctgataactacggatattcagaatgattctgttatgacagatgatagcaagcttttctgatttcacttacctggggtcgaaatctaatttctttattagttaatacttttttttttttttttttttttttgagacagagtctcgctctgttgcccaggctggagtgcagtggcgcgatctcggctcactgtaacctccgcctcctgggttcaagtgattctccctgcctcagcctccccaagtcgttaatacttttataacttagttgcagaagagaaatataaatttatttagttttcagaattattcatagatttataatctggcaaaatataaggaaattataagtatattgataaatcatgacataactggcaagaattggtataaagacaagatggttataacttgaaatagggttgttatttattctatgcctatcatttttccatgagataaaccaaatatttaattgtttagactgattccacaaatgacatgggaaggcagagtgtttataaagagttttggaagtgatataggacactataatttggagttttaacttaatcttattttaaatttcaaaatgaaattatttctggttatgaaagctacggaacttttttttttttttttttttttagatggcgtctcgctctgtcactcaggctggaatgcagtggtgtgatctcagctcactgcaacctcagcctcctggttctagcaattctgctgccttagcctcctgagtagttgggattacaggtacctgccaccacgcctggctaatttttgtatttttagtagagacagggtttcaccatgttggccaggctggttttgaactcctgacctcaggtgatccgcctgccttcgcctcccaaagtggtgggattacaggcgtgagccactgcacctggcccagaacagttttagtgttttttaaaaaaaaaagtagagatgacctgtaatcccatctggatgtaatgtttggtatttttgttttttttcttatacatatctattgaaataattttaaaaagaacaactttccctgtaaaattgatattcccttaatgagcatttagtgtttataatatggatgcatcatagtttatagcagttctgtgttattaatggatattgtcaatttttctcttaaagcagtactgtgatgaactcgtttggacattgaattgcattgaattgttctattattttattatttccttaggataaattcttttttttttttttttttgagacagagtctcactttgtcgcccaggctggagtgcggtggtgcgatctaggctcactgcagcctctgcctcccgggttcaagcgattctcctgcctcagcctcctgagtagctgggcgtacaggcgcatgccaccacgcccggctaattttttgtatttttagtagagacagggtttcaccatgttgaccaggatggcctcgatctcctgacctcatgatccacctgcctccgcctcccaaagtgctgggattacaggcctgagccactgcacctggcccaggataaattcttaaaagtgggtttattacctgggcgtggtggctcatgcatgtaatcccagcactttgggaggccaaggcgggtggatcacctgaggtcagcagttcaagaccaggctggccaacatggtaaaaccccgtctctactaaaaatacaaaaatcagtcgggtgtggtggcgggcctctgtaattccagctacttggaaggctgaggcacagagaatcacttgaacccaggaggcagaggttgcagtgagccgagattaagctgctgcactctagcctgggccacagagtgagactcagtctcaaaagaaaaaaaaaagtgggattattaggtcaaacggtacgtgtgttttaaatttagatatactcaagatgccctttagataggatgtctatttcaaattcccatcaacagtgtattagtattcaattccatatattcttgctagtgatttgtcatctttagcttgttgggagtttaaagtagtttgaaacagttttctgtttctttttcagcatcaggacttacttccatagcttaactcttcggagggagctgataaaaatgaaagatcagtgacaagggagtggtgtagaccagtggtcttcaaactttttggttgcttaccccatcactaaaaaattttgagcattaagcaggtgcggtacatggttctgtggtcccatctacttagttggctgaggcaggagaatgtttgaggccaggagttcaaggctaaagttcactgtgattgtgcttatgaatatagccgctgtactctagcctggacaacatagcgagaccatctctttagaaaaaaaaaaaagatgagatgggaagaatgaagtcagaaaaaaaaaattgataggacttcgtgttgttgctttgagaaaagagaaaaagaaaaaaattgagcatcaattcttaatccttagatatttgatttacaaataatatatgtatagtaactgattattgtggactttataaaatacgaacaaaaaatcaacaaggatgataattaaaaataaagttcagatattttccttttttaccctggggtgtcttggttactcctggaggtatgcgtgtgcgtgtgtgtatgtatgtatgtgtgtgtgtgtatatatttaatatatatgtgtatacattgtatatgtgtatacataatatataatatatatgtgtatatataacatatatatatgtgtatgtataatatgtatatattttttagacaagagtctttttctgttaccgaggctggtgtgcagtggtgcgatcttggctcactgcaacctctgcctcctgggttgaagtgattcttgcgcctcagccacttgagtagttgggattacaggtgtgtgccaccatgcctggctaatttttgtattttttactagagacgggattttgccatgttggccaggctgatctggaactcctggcttcaagtgaattgcctgccttggcctcccaaagtgctggtattacaggtgtgagccaccgtgcatatgttatacttgctttggatactactgctttagactcttaaggtttaatattgagcatttatagatgcttgtttttgggcatttcactagttttgctggtccagtttagttggatcatgaatacctttaaaatgtcccatgctaggctgggcgcggtggctcaggcctgtaatcctagcactttgggaggccaaggcagacggatcatgaggtcaggagatcgagaccatcctggctaacaccgtgaaacccgcctctactaaaaatacaaaaaattagcccagcgtggtggcacgcgcctgtagttccagctacttgggaggctgaggaaggataatctcttgaacccaggaggcggaggttgcagtgagctgagattgtgccactgcactgcagcctgggtgacagagcgagactccatctcaaaaaaaaaaaaatgtcccatgctcttgagagtcgtatctgcaataagggtaaaaataaatttaaaacatcagttcaatactttttgcattgttgaggtggctgaatttgaaaaggacaaatagtaggataagaagcaatgtaagtactctatttcttctagatatgaagaattaatattttgtagaacatattttaaaaaattatgttttttggaaagccgtttggctgtaatatgtatctccctgttttttaagagttaggtcctagagactgagtgaaggtatgaataattgctacttgctctcctttgctttcaaagtaccacaattaacctgtcactaactctgtttggattagcctgagcctataacaaactttccatgatgattcttagattaaaagataatttttttcttgagttagaataagttgcttttgatctgtggctgcctgccccccaacccctataaattatgacatcaggaaacaaggctttttgtattagaaaaaaatggggaaattaatttcagttatttcatgtgggtcattggcagagaaagataatactaaaatcttagagactgtgaaaagagattatattaagcaacttgagtgattacttttttgccagttaaaagaaatgagataatttatattgaagatgattgctatatacagtgctttgcacaaaaggccacatatctctttttaccttaggtaacatgatgtataagctactttcacatatatcttcttaggtcatcacaaggatttgagatcatcatttaatcaggactgttgtgacttgcttgagaccacatgcctagtgtttgacatcatatttcaagaggtagactgaaagttctgcagaaatagggactggtggctgttctctcccttactccctagcagttaatacattgcctggtacagagtaagctgtcaatatttgtggactatttaaactcctgcatatttatttacacatgtaaataagttatagcattgtaaaaccaacaggtatattttccgtagtgagattgttccttcatcttatgtgcacagaaaatattttcgtggaagaggtcttgaattttagatcaacctttcacatatccctttactttctcttaagatactttcatggtgacaaaaaaaatactcttaatgtcattcctttcactgtgtgtgtaactcctgtggcaagactgtatatttgtatgtatgtatttgtttatttagtaggctgctatttataaaggaaacatactcattagttggtctttgcgtacataatggttcccaaaacatggactccatggtttgctgtgagtgaatgaaaaagagcaggtatgattcccctcacctttgtcattctctccagtttcttgtacatatggttgacttactcagcagtaagtgtaactttacaatgaagaaaattagtcttccaaagaactagtatgctacttcccgcttgttctgcagtatttaaaatcctgtttggtaaatgaactaagacacttatatatagaagagaccctggatggccatgaatggaaatattagtagtgattaatttctgtcttggtgggataatgtggcttttttgcttcttattcttttagagtttcccatttttctacaacgagcatgtattacttttatacgtaggaaaaactgctattttattttattttttattttttaagacggagtctcactctgtcacccaggctggagtgcagtggcgtgatctcagctcactgcaacctccacctcttgggttcaagccattctcgtgtctcagcctcccaagtagctgagactacaggcagaagccaccacagccagctgattttttgtattttttagagatgggatttcgccatgttggccaggctggtcttgaactcctgaccgcaggtgacccgcccatcttgaccttccaaagtgctgggattacaggtgtgagccaccacgctcagccaaaaactgctattttaaagtctttatttttcactggatgtcttctgaaggtttatgtcgcactcaccattgagaaagtgggtggttaactggctccagttcctaagaggagtggcagcggtaggaagtagtatgggaggagtggggcaggtaagctgatttgaactttatcattgtgaactccactatgactaaagacattctgggatttgatcacaattaaacccaagaggactgagccatctagtttttttcttcttaataagctgattgagaattataaaagacaccttaagaaaaatcagtttctatgcactctgtaaacacagaactcagcccgaactcccaagttctgtatccgtgtgtgtgtgtgtgtgtgtgtgtgtgtgtgtgttgtggtatgttttaaatatcaaatggagttgtggcaactcagatgggatatggtttatattaatacatctaatatgaattggaagatgcttaggcaaacgatttttattatgacagtataggcttattggagttttggtgttaatatacagctgggagttgagccgttctaagtttatatagccatctggtgatattttaggaagagctgtgtcacatatcctctagagtttaagtgattagagcttgttggcttttgctgttagtttactgcacacttgtagtgttttaaatgcttctgtgaatggataacataattcaaaaaggttagatttctgggttaagacatttgttattatcggcccttactttattcttttaaagagtaagattaggctggatgcagtggctcgtgcctataataccagcactttgggaggccaaggtgggcaggtgaggtcaggagtttgagaccagcctggccaacatggcaaaaccccatctctactaaaaatacaaaaattaacggggcgcggtggtgggcatctgtaatcccagctactcaggaggctgaggcaggagaatcacttgaacctgggaggtggaggttgcagtgagctgagatcgtgccactgcactccagcctggttgacagagggagactccatctcaaaaaaaaaagttgaagagcagttgaaataataaatgtaggtactgttaggtgggtgcaaaattaattgtggttttggattgtgaattttaaatcattgtaactaggcccaaacagatcttcatttatcaaaataggaactgttacaatcaacacatttttaccgatgagaaataagtttgtttatacctgtagtataaaaatccatgctttgagattcgatgaactcttggaaagcattttctgcatactgctggttgtggaagcattttccctgcaaaaaattttctagatgtttggaaaagtggtagtcggttggcgagtggttagttgaatatggtggatgaggcaaaacttcgtagcccaattcaacttttgaaatgttggttgtgcaacgtgttgtcgggtggttgtggagaagaattggaccctttctgtggaccagtgctggctgcaggcattgcagttttcagtgcatctcatcgatttgctgagcatacttctcagatgtattggttttactgggattcagaaagctgtagtggatcagaccaggagcagaccgccaaacagtgaccatgaccactttttggtgcaagttcggctttgggaagtgctttggagtgtcttctcggtccagccacttagctggtcatcactgttgttgtataaaatccactttttgtcgcacatcacaatccaaccaagaaatggttcgtcgtcgttacgtagaataagagaagacaacatttcaaatcgacaatttttaaaattttcggtcagctcatgaggcacccacttatcaagctttttcaccttttggctgggcgtggtagcccacgcctgtattcccagcactttgggaggcggaggtgggcagatcacttgaggccaggagttcaagaccagcctggccaacgtggtgaaaccccatgtctactaaaaatacaaaaattagttgggcatggtggcgggcatgtgtaatcccagcaactagggaggctgaggcacgagaatcgcttgaacacaggaagtagaggttgcagtgagcccagatcacaccactgcactccagcctaggtgatagagtgagactccatctcaaaaacaaacaaacaaaaaaaactttttcacctttccagttggcttcaattgcctgccaaacaagggtagaatggtcgacattgagttcttcggcaatttctcgtgtagttgtaagaggatcagcttcgatgattgctctcagttggtcattgccaacttctggccggccactacactcctcatcttcaaggctctcgtctcctttgcaacacttcttgaaccaccactgcacagtttctgggccagatgtgtagttgatgttgtgagttgtctccactgcttcacgacccattttgaactcaagaaaatcacttgaatttgctttttgtctaacataatttccatagtctaaaaaaaaagcaaaaaatacgttattagcaagaaaaggcaagaaatgtgcattaaaatgatgtataacataaccatttatttaagagtgtattccagtattaaatggcaaatttcaacagtgcaaaaactgcaattacatttgcaccaaactaataatataatttttttttagttaaaaattttatagtacagaataacaggcttgtctcacacacacacacacacacacacacacacacacacacacacacacacacatacacacacacaaatcccatatagaatctacaaagcctgtctgtctctgaattccacaaccttggcttatttttttaaagtaaaatttaaatatttaaaaaatttagaaaaatatggagaataagttaacaaacaccatgtactaattcagtagattttttttctttttctttttcttttttttcttttttttttgagttggagtctcgctctgtcgccaggctggagtgcagtggtggaattggctcactgtaacctctgcctcctgggttcaagcgattctctacctcagcttcccgagtagctgggactacaggtgcacgccaccatgcccagctaatttttgtatttttagtagagacagggtttcaccatgttggccaggatggtcttgatctcttgaccttgtgattggcctgccttggcctcccaaagtgctgggattacaggcgtaagccaccatgtccagcccattcagtagatttaatagatgctgacatcttgtcagatttgcttcaaaggtgtatttaagtatgtttttatttatttatttatttatttatttttgagacgggctctcactctgttgcccatactgatgtgcagtggcgcaatctctgctcactgcaccctccatctcccaggttcaagtgattcttgtgcctcggccttttgagtagctgggattacaggagctcgtcaccatgcccggctaattttcttatttttagtagagacagggtttcactatgttggccaggctggttttgaactggcctcaagtgatctgcccatcttggccccccaaagggctgggattacaggggtgagccactgtgcctggcctgtatttgcttttaaaaattaaaatatgcatacggttggagtcccttttgtcatcctcttagatcgtattttcgtatgcagaagttatttatctttttagctcatgcacttatattcttcctacaaatatctatatatattttatgtagtattgggtttcaaatttatgtgatattttagtacatactttctataatttgaaaaatgacatgttgatatatgtgtattattattattattttttgaaacacaatcttgctctgtcacccaggctgtagtacagaggcacaatcttggctcactgcaacttccgtctcccaggttcaagtgattctcgagcctcagcctctcgagtagctgggattacaagtgtgagccactgcacttgccttacttcattaattttaatagctgtatagtattcagtcatatgaatgaatagtacacaattttagtcctttattgatagttgttttcaacaaatatacaaaggtaaactttttcctcaaattgggtcaagctatatatattgttctaaattagctctttttctcccaataataatagtgtgcaggtttgttacatgggtatattgcatgaggtttggggtacaattgatcacatcacccaggtggtaagcatagcacccactagatagttataagttttttgagacagggtaggtctctgtccctcaggctggagtgcaatgttgcgatcactggtcacggcagttttgaccgctcgggctcagtccatcctcccagcttagcctcctgggtagccgagactacagtgttgggccaccattccctgctaatttttgtattttttgtagagactgggttttgtcctgttacccaggctgcctcgaactcctggactcaagcagtccacccacctcagcctcccaaagtgctggtattataggcgtgagccaccgtacccagctcctagtaggtagttttgaaccttcacgccttcccatcctctcctctctgttagttccctgaatcccatgtttacttccatgtttacccaatgtttagtttagaatgatgatctccagctgcatcatgttgctgcaaaggacatgattttattcttttttatggctgcagcgaacctttgggtaaagaaaatttacaaaaatttctcacatctttttttttttttttaatgaaagtaagtagtagtaatccatagttcagatctactttataagtgagtcactgataaagacagtagttacacattttataacattaccttgatgggacaaatttttcttgttttgtttttgttttacttgagttaatttggatgagactttcttgaattacttacatttatagcatttacctccagtggggttgagatgaggagccttcaatccaacaaagttgtatacatgcattcatggagatgacacttaggctatttaatcaggaaacactcatacttgtccacatgtagatagtcctattctttggaaattttgctatgttgcccctgctggtcttgaactcctgagctccagtgatcctcccaccttggcctcccagagtgctgggattatagacgtgagccattgtgcccagccagaaatatgattttaattccatagtatatagtatatgttattgtgagtagaatatgtttattctgtaagtagcaaattgactccttcaacagttttaatagttttctagttgttttgtctttagtttcccaggcaaataatgctgttgtcttcaatcacagtattgattagttcatcccattcttcatattgatcattgtttttggatattaaataatagtactgtaataattaagaaagatggaaagcctcaccaatttgcatgtcattcttgtgcagggaccacgctaatcttctctgtattgttccaattttagtatatgtgctgctgaagcgagcactccatttctgtaaagcttaaaaaatggacaaaactaacagatgggaatggaaatcagaataatggttatctttggtggtgaggacaggggagattgtaggtatgctgctaatgttctgtgtcttgatctggatcttgatttcatggttgtgttcagtttatgagaatcatcgagtagtagacttaggaaaggtgcacttctttgtatgtatattatacctcagttaaaaacttttgcctcgcaaaattttaaagaacgtaatctgctgagttcgtcgtcttttagcttttgatgtaacttttccactacttctcttcatatgtgaatacacttaatgataagccatttaacctttttattatgatataaaacaaacatacagaagagtgcacaaatcaaatgtatagcttaatgaaattttaaaattattaaattggaggttttttggggtacattatacctgtgtctttgttaggagggaaggagttgatggagggctaaaaattctggagaggacaaagttttaaggaatctcagaacaccaaaacctcatcttggctctgccttcacattattgtttctttgggtaagtcatttaacttatttagacttcacttttttttgtataagtggtataatacttaacgtttcttttgcaaactgaattaggtaggtgaaattcacgtaaaataataggaatatagagtactgttgctaaataggtctttatttaggccattgaatttaggccacttaccttacagagcagaattgtgggatacaaagactacacagctggtgattattgatatcattcatttatattaggttagtattgaggcttagttaactatgccaggcactaccctgtgatttattataatacatgtattaactcatttaatagtctaggattattcccagaggtaggtaaaattatcccaattttactgatgagacaattgaggcaaaattaagttaaataatttgcctaggtgggttgagttcttgagcctgtgctttaaaaaaaattttttttgagaaagggtctcactctgtcacccagggtggagtgagtggcgtgatcttggctcactgcagcctctgccttcaaggctcaagtcatactcctgcctcatccccctaagtagctgggactacaggtgtgtgccaccacacctggctaatttttttgtgtattttatagagatggggttttgccactggactcaagtggtttgccttggcctcccaaaatgctgggattacaggtgtgagccactgcgtccggcctaagcctgtgctctttttttgttatactgcctagttatgtgaaaatacgtaaagacttttaggcaaatgttaagattttataataatctgttagagagtttttgaagtaaaaattttggtattttgaaccaaaattaggagaagagtctcatttgttttgaccatgatgattctggaaaagattgatgttaatatttattacttgggctttattcccttaattttctcctaaaatgactaggatgtaagcactaggtagttttctttaagaatatatatatatattttaatattaaaggattttgtgactaatttacaaatattgtttaatttttaggcgaaatgttaatggaagggagttttcaaacttggaggcagatgagaccaaagtttagtgttcttgcttcggtggtttaagcagcatctatttggtcttggtattagagcaataattaagactctatcatatgtatggttgaaaattatttttattaaggtatgtttgagtatggttctgtgaggttgggaaacacatgtagttttgcaagcaccatgatcaagatacagagtagttcctcaaaaaatttcctcatgaccctttctatagtcagcccatttcctcacctctagtctctggcaaccactgatctgttttttctctgttgtattgtctttttttcagaatttccatgtaaacaaaatcatgcagtatttagcctttttgttttaatttttgtttgtttgatagaaatgggaggtcttgttatattgcctatgctggccgcaagctcctggtctcaagggatcctcctgcttgactcagtatgtgacttcttgagactgacatcttttatttaacctaatgtattttgagattcatccatgtttttatgtatcagtaattactttctgttgtttaggagcattccattgtatggatgtacaacaacttgtgtgttcattccccagttcatttgggttgtttccagtttttggtaattacaaataaaagtgccataaaagcattgatgcatgcatacatacacatgtgcccatgtattttttttatggtttaaaaaaatatggtgcctagaacttttataactttattagagaacctgaaaaagctggtgattttcacagaacattataaattgcttggtaaactaccctaaaaaagcccactctggaatgagaagaatctgtttgtataaataatcttataatataaactgtaagtcattagaatttttttaaattaaagaagtacacacacatacttgttaaatgggtaaatttatatataaaactccttagtgcataatttcatattttatgtttttagtagcttttaaattgtcaatcattgacttttttgttcctctaagtagtagaatggttatataattggttatgaaagtttttttttttttttttttgagacggagtctcgctctgtcgcccaggctggagtgcagtggcgcgatctcctgtctcagcctcctgagtacctgggactacaggcgcccaccaccacgcctggctaatttttttgtatttttagtagagatggggtttcacgatattggccaggctggtcttgaactcctgaccttgtgatccgcctgtcttggcctcccaaagtgctgggattacaggcgtgagtcaccgtgcctggctggttatgaaagtttataagtaaaaaataactgggaaaaattttagcactacagaattcctttttcttctcctctcctcccctctcctcccccaagatggctggaggtattaatattgataagcagagtttcatgtgaataagacataaaacttaggttgattacctatgttaataaattatcttctttgttcctatgtagtgagctttctttttgcagcaatctgaggccaagagaaatagatgagacctttttaccttagaaaagagattgcaggctggatgtggtggctcacgcctggaatcctagcactttgggaggccgaggagggcagatcacttgaggtcaggagttcgaggccaccgcctaggcaacatggtgaaatcttgtctctactaaaaacacaaaaattatctgggcgtaatggcatgtgccttgtaatcccagctacttggagggtgaggcatgagaatcacttgaacccaggaggcggaggctgtagtgagccaagattgtgccagtccactccagcttgggtgacagaatgagactccatctcaaaaaaataaaataaaaataaaaaagaaaagagtttgcaggccatttttgcaagttaattttttgaggttccagttccaaccctgagtcagactacagaggccataggtggtttgacgtttcagagaatagcagtgtttttgattttctttttttctttttctttctttttttttttttttttttgagacagggtcttactgtcatccaggctggagtgcagtggtgcagtcatggctcactgcagcctcaacctcctgggctcaggtgatcctcccaacttagcctcccgggtgctgggactgtaggaacatgccaacatgcctggctaatttttgtggttttttttgcatgtacgtagagatggggttgcgtcatgttgcccatcttgaattcctgggctcgagagatccgcctgcctcagcctcccaatgtgctgggatcacaggtgtgagccaccttgcccagccatttcttttgtgtagtatggaatcttagtttaagccctcagtttaaatgtattatataattgaggtgctaggtgtacagaggtactagaactacagagcttttctcattaatgtatgttccttctgatgttgaatatttagaaaactgaatattgtgtttggagccaagggatattacacttgaaatatggtcatttggtgaacaggtatctcatttgtaggctatcattatttttggtgaacaggtatctcatatgtaggctatcattaattttggcagtttcacattaaaatacctgcctggaaatacctgcccagttttgccagtaatgggaattgcaggttaaccgttggtcttctatatgtggctctatgatgtggacaagacttatagctctttactttaactgagacaacaatgttggtgatccaagtctagaattccaggatagggttgccaaaattaacaccgtgggagtatggaggtagcaactgtgggattagtaatacaaatacaattttaattagctttatcagttgcacacttaatcttcattgctaccttgtgaagtaggcacggcaggctgtatattgttacttctactttacaagtaagtaaattgtgtttcatagctgtcaggacttacctgaggttgcactgctagtgagtagctgaaatagtacttgagtccagacatcaggttggatgctgtttccacttttgcagttcactgtcgtgaataagagctcaggcttgggtttgaattgtggttctaccacttacctgtctgtgatcttggggaagttctttaacttctctgagtctcaggtttaaaatggggctaacaataatacctcttagggctcttgtgagatttcagcaagtgcttataatattagataaccaatagtaagcactcagtatttgctaattgtggttgtttctactgttattaaagtgataacaacactacagttacacatcctctttcccctaaggatctgtgttaagagttgaaagacaataaatgtaagaagcaaaaatattcaaagatgatagaataagtagcaaggggagttgattttagcaggaagatggacaatgttcagaggggtatgtgtgtgtgttgtgtgtgtgtgtcttggttttaaacatggtagcagttagacaatgaagttacaagtgtgttagacagttggagctttaggacagggttgagtaggaggaccagtgttggaggaaaactttttaatcaccatcacagatggcatatggaaatttacatttctaccaagatttaaacataccaatttgctatcctctgttatggttcttagagctattgttacatcagaatggagtaagaagcttatcatacatttttcatttttagtggttatacagagaacaatacagaaagtcagcatatatcctactacagtttatccttggtatacttgggggatgggttccaggacccccacatacaccaacatctgggcatacttaagtcccccagatgcccctgtggaacctgcctatatgaaaagctagcccttggcctgctgtatatataggtttcacatcccgagaatactttttccatccacatttggttaaaagaaatccgcacatgagtggacctgtgcagttcaaacccctgttgttcgaaggacaactgtgtaaataaaagggtggtccctctccttaaaatttcatagttgatacttgtatcatagttgatatatagtagttgatactatgaaaatttcatagttgataaagtttcatagttgagcccttttaccatgtgtgtaagtcttaagggctagggaattcagaagtataagttacagggttgtatcttttggtgcttgagtcctttcctttggataaggtacttccttgatgtaaggtaatgttctttcaagcattttaaattaaatgaagttgtttgaatttacttgttggggaatatcttgcctttaatataatagctgctatgtggaattatgtattttatgtattcggtgtttttgaacttgcatcttttattactgtatttttacagctttccccatttttgatattaaaacaattttatggggttttggtgcatattttaaatttgtgcactaaacacttgcaaaagcatattttaaattatggcaagtttcctaaacctgttaaccttttatatattagctgttacatattaacttttttcaaagtcattatatatccttctactgacaaatgtcaaacaagttctgagcatctgaaagtctagattcatccagagtttgctcaggatggcattttttttgtttttcttttgaggtggggttctcattgtgttttctacgctggcctttaactccttggatcaagcagtcctcctgtgtcagcctgccaggtaaccgggactaggtgtgtaccactgtgccaggcttgttttcaaagttcataggaaaaactttggtgtcttctaaagagaccagtactgtacacaaatatatttgtctcacatttatccatccatccgtctgtctgtctgtctgtctgtctgtctgtctgtctgtctgtctatctatctatctatctatctatctatctatctatctatctatctgtctatctatctatctatgacggagtcttgctttgttgcccaggctggagtgcagtggtgcgatcttggctcactgcaatctcctcccgggttcaagcaattctcctgcctcagcctccctagtagctgggattacaggcgtgtgccaccatacctggctaattttttttttttgtatttttaatagagacggagtttcaccatgttggccaggctggtctccaactcctgacctcaagtgttccatctccctcggcctcccgaagtgctgggattatagggatgaaccaccgtgcctggcctgtctcactttttataccccgaaagcattattactatccattactttattcagagctaggagctttttcattcctgtactgtggaactacttgagttgccctatatctactccccctttccccattctgaacattgtttcaccttataaaaattaaaaatttggctggtgtggtggctcatgcctgtatcccagcactttgggagacagaggcagatggatcacttgaggccaggagttcgagaccagcctggccaacatggtgaaaccccgtctctactaaaaacacaaaaattagccgggcatggtggcgtgcatctgtaatcccagctactcgggaggccgaggcaggagaattgcttaaaccaggagacggaggttgcagtgagctgagattgcgccactgcactccagcccaggtgacagagtgagactcggtctcaaacaaacaaaatccaaaaacatcctaaaaattacaaaatttggccaggcgtgatgggtcacacctgtaatcccagcactttgggaggccaaggcgggtggatcacgaggtcaggagatcgagaccatcctggctaacagaatgaaaccccgtccctactaaaaaaatacaaaaaattagccgggcgtcgtcgtgggcgcctgtagtcccagctacttgggaggctgaggcaggagaatggtgtgaacccgggaggcagagcttgcagtgagccgagatagcaccactgcactccagctgggtgacagagcaagactctgtcttaaaaaaaaaaattacaaacttttttattgatgggttcctctaaaacccattactaaagctacttactaaagagtagatgttttcccccttcaccgatagttgatggaccgtcagagaatccttgagtatctcaagcttttacttaacttcagagttcttacctgagacagaaaagttgagttttctttcctcaagggcataaaaaattttaaatgtacccatttgcataaaatctactcaaagaaaattatcaagtgattttacaggatatttttggatgcttgcacataagagaatcttttaacaaaactgcttaacctcctttgtattattcattccctctcttactaaaacaagtgaatggcttgcttggatgtgtatctgtatctttttttttgatacacactttgaaggagtcttctgaaatgcagtgttttggccaccattccagctctacaggaatatggtttcatgataaagccaacaaagagcacactggcagcagtccagcagctgactcaccaaggagtaatgatagacactttgaaaggagtgacctgtctcaggatctcacatttcaaagcttcgtgctatgattacattggtagaaggcagccaagaaatctagatgagatcttgcttgtacctcctaagagtaatggtatataggtaggaaggacttccacagtcggatgcaagtaagattttttttcctaacaaccttgtaaaacctgggggtgggaaacaagttgaggattcagaatgggagtaaccgtggtggaagctttccttctacggacctggatgagaacagccttatagtgactgagggtaactcaagaagctcaatgccatattagttttctagagctaagggaatatacatagtttagtagtaagcacaagtatcgtgttcatgtcagacactgtagctactgcttcctactagaacagaccagaagaaaccaaagcaagaccagaatcatttcagttttgaggaacagaccctttccttactagcattgcacactttaggagtaaaaatagaatgaaagtggatttgcttcagtactctgaaatagttaactgttgattgttttggtggattagagtgattgcagctctgtttctaaattgaatttcatggctatacgttgttctaggtggcaaattaatcttttatcagtaccacaaattgattgttggccctttgcggaaatagcaggaatatgtctttttcattttgttgaagggtagctcagagataaaacatttacataatctgaaaatatttttcagagataagactaagtgactgtgtataccacagtgatagattgatccactttgattattgtagaactttctatttctcagtaaaaagtgctaaacatggtaaaattatgaaggattgcttttagctatttgctgtattctttaaagcatatttaggaataaaaagttaatttccaaagtgctgtcatttatttaatacatgttttctccagaatgtgcttcccaaaagttaagagtgcttttatttatttaagaaatatgttaatttttcttttcttttcttttctttttttttttttttgagacaaattctcactctgttgcccaggctggagtgcagtggcacagtctactgcagcctcgaccttccaggctcccacgaccttcccaggcccaagccatcctcccaatttagcctccaccatgctcagctgagtttttatttcttgtagagactgagtattgccgtattgcccagactagtctcaaactcctgggcttactgtgcctggcccacaagaaatatgttactttttttgagatttttgtataatttgagaacacagattatttgccctactcccccaacccccagtgatacagacctggtttcattgcactgagagaaaaaaattagtttcttaatttacgttgcgtttctgcctttttgagattgagtgctttgacttttctcttgtttttgtatttgctgtatatgtgttgttcctacttaatttcttatatggtttaaacttgcatctgtaaattatttattagctagctttatgacttgggcaagttaccttatctctctgctccttagtttccctctttataaaatgaggataataatattacctactttgtagagttgagtaagattaatgactaataaatggtgaagcacttaaaagagggctctatacatgttggctgttaaaattataagcgaggacctggacttctcccctccattaattgtaactcttcatttttataattttttcataaatagtatgtctctcagcatataacagaactttgtattaaggaataataaatatcaccatgtatgtaattctttattataaacataaatttgcttcttgttaaaaacagagtatcattttcttgcctcagatcgagcttgaaagaaattagtagaaagtgggcccttttggccgggtgcggtggctcacgcctgtaatcccagcactttgggaggccgaggcgggcggatcatgagatgaggagaccgagaccatcctggctaacacggtgaaaccccgtctctactaaaaaatacaaaaaaattagccgggcatggtggtgggtgcctgtagtccccactactcgctactcgggaggctgaggcaggagaatggcgtgaacccaggaggcggagcttgcagtgagccgagattgtgccactgcactccagcctgggtgacagaacgagactccatctcaaaaaaaaaaaagaaagtgggcccttttctgtgttttataggtacccacacaccactgaatgtaggtcatcgtttaaaatctgagtgtacatccaaatccagtgcagttatgtagaacaaaacagtttgtatggaactagaagtgttactggaaaggtaaatactgtagttggtagtaaactgatcagttaaagtgatggatcagcaaagatttgggggttgctggtttttatttaacactcagttgtttcagagtgattactcctgaaacaaagttatttcgaacatagatgtgttaagaaatttcatattcctttccacttaaacctcttgagaaaggaagcatttcttcagggagagttagctatgtgagtgctacatgaattttagtcattactgtggcgactatatgataaccaaaagtaggagtctcacactttagtttcaaatttgtgctgttattgagtaaatttttaaaatgagattgccctctttcttgctaaactgtcatatatataagcccattaaattgacttttatgcctcttttccttttttttttttttaacctgttaagactttttttttctttctcatatttacccctgcctaagcaaggcctcaactctccacggaaatctttagtaaaaggcaaaaagatttattcattatgaagagaaaccagagcatgtgtgacaggactttctgtaattataagttagtggttcagtgccaggggttagattttcttaacttttatgtttagtaggattattgataattcctaagttgtatccttaaatcatattttttgaacattagggatctgcgtccaacacttaattatactagtaaaaggaatagaacatgcactggatttcttgtttttgagattctttcattcctgccctaccccaggcaggaggtctgtctgcagtggaagagaatgaaaccagaatgaggccaaacaagtaaagaggagcatgagatagagatggatcccatggcactgtgcctttgaggccctggtcctgaagtttttttccttgtttctacgcagcatctcattatcctgtgagccatcaaattctgatttttgggctgggtgtggtggctcgcacctgtaatcacagcactttgggaggctgaggcaagacgattgcttgagcccaggagttggagaccagcctgggcaacgtagggagacttgtctctacaaaaaataaaaaaattagccaggtgtggtagcacacgcctgtggtcccagctacttgggatgctgacatgggagggtcccttgagtctggaaggtcaaggttgcagtgagccatgatcacgatactgcagtccagcctgggtgacagagtgagactgtgtctcaaaaaatttttttttaattttgtgtaaattagcttgatttgggtttttttttttttacttacaactgagaattttgaccagtatatttaatgttagtctgaccatttctccagtgggctttctacgtatttaaaaaatagtttggactttaatctcagggtaaacaatatatataggtacactcagtttatatatgagataatattcaggatcagtggagtgaaaatagtaaagtatcttccatttttcaatggcttagagggaaaagtgttcataatgggtatagaattaatcagtattcctttcccattatttatgcctatacagtgtagaagtttcccttaaagagcttatcaccataataagtacaatagcaaagatataaagtcagtacttttcactgattaggcataaatatcctctttattgttttcttacaaagtagctatgataaacatataaaagggtcagaaagagaggggagaaaaactcggtgaaaagtcagacaagaggaaatgaagaggtgaggtatgtatagtaagcattagtgaacttgtagtaattgctttaggttccatggattgcccacttgtggattaaatgttagacttctgcaaaatgagttgatggtagagatgaagaaaagtcttaatttgttttctttatgctaaggttaaagttgatgtggctaattaggtattaagatcagttttcctgtctttttattatttatttatgtttatgaatgaatgaatgaagaaatgaatgacaaagtctcgctttgtcacccaggctggagtgcagtggcatgatcatagcacactgctgcctcaaactcctgggctcaaaggatcctcctgcctcccaagtagctgggattacaggtgtgcgctaccatgcctggctaattttaaaatttttagtagagatgggttctcgctatgttgcccaggcttatctagaactcaagcgatcctcctgtgtcagcctcccaaagtgctaggaggattgcaggcatgggccaccaaacctggccttgtcttgctttttaataagctgttgtcattatgttgcctttcaaagtccagttcttctttaccaccccatttgcctggaggtaatgcattaggtgagaatgaaaggtgagtacctaaaagattcagaattggaaggccttaataggatcaatgtgtaggagctgcagagaatatgaaggacttttaaatattccagtcccaaaataaacttgaccattggccaagattgtggtaagctaagtatttgagatgtctgtgctacatcatccaactcttggcctgaactgttttagctggcttgcctatgtaaattgaaacttcctttaatacttaactgtgagttaaacatagttctggagctccatcgaaagggtcttagtcagccaggcacagtggcttacacctgtaatcccagcattctgggaagccgaggcgagagaatcacttgtgaggcctggagtttgagaccagcctgggcaacattgcaagaccccctctacaaaataataataataattattatccagctgtggtggtgctcacctatagtcccagctactcaggaagctgaggtaggagagttgcttgagcccaggacatcaagacagcagtgagccatgattgcaccactgcactctagcctgggtaacagcgagactcccgtctcaaaacaaaaacagaaacaaagggtcttagttatacagatcttcttaatcattcctaaagcgtacattccaagtttatatttacagtaaagtgatctatatcccaaaacatgtttccactggttactaatttggggcaagtcattaacttctcagagccttctgtaactaagatttagggaaaatactggtcttaaccagagcacatatgtatacctttgactctttttgctgccacatggttaaaaaatcagccttagagaggtataatttgcacaaattttgccttttttctaggatgtaatataaatgaaatcatacaggatatactattttgtgcctgtcctctttcattttagtataatgctttgagaatcattcatattgttaaaagcagtagttgttccatttaattgctaagtagtagtccattgtatggatattccacaattcctttatttactagttaatggatattggggttttttttttttccaggttttgggtttatttatttatttatttgagacggagtctcgctctgtcgcccaggctggagtgcggtggcgagatctcggctaactgcaacctccgcctcctgggttaaagctattctcctgcctcagcctgctgaggagctgggactacaggcgcatgccaccgcactcggctaattttttgtatttttagtagagacggagtttcaccttgttagccgggttggtctgatctcttgagctcgtgatccgcccacctcaacctcccaaagtgctgggattacaggcatgagccaccacgcccggcccagtttttggctattacgaataaatctcctctgaatatttgcaacatagatctttgtgtggacatatattttcatttctcttggttaaaaatccaggagtagaaattgcaggattgtagggtaagtgtgtttatagtttttaaagtaacggcctattttgcattcccactggcaatgcatgagaattccagggctccaaatccttgttgatgcttggtattgtcattcttactaacttaagtcattctagtgggtctgtagcaatacatcatcatggttttagtttgtaatttccagatgactaatgatgattatcttttcatgtgcttatttgccatttatatgtctttggtgaagtgtctgttcaaatcttttgctcattaaaataggttgttttttgtttattgtgagttcataatgtattctgaatatgagtccttcataacaggttttgtaaattacatgttttgcaaatatgttcttgtaatttgtggcttgccttttcattcttaacagtgtctttcagagagcaaaaacttaatctttatgtagtcagttattttttttttctttttgagttaatgatctttttaaaagcctatctaaggaattgtctctaaacctaaggtcactaatattttcttaaattttattctggaagtttatagctttgtttgacatttgggtctgtgaaacacttcaaattaatactgagagaagtaagtgtagggttgcctttttgtatatactgtgaatatctgagttttcctctgagcagtgcttcagttgcagctcacaaaatgacatattgtgtactactattcagtttgaatattttctaatttctcttttaatgtcttttttggcctatgaattataaaagtttgatgtttaacttcctgtagatattttactgttactaatttaattccattgtggtcagagaacatactctataggatttcagtctttttcaggatttcagaatttgagatttgttttgtggtaaggcatatggtctattgtggtgaatgttttgtgtctttgaaaagacaaatatttggttctaccagttctgtctcatatattttgaagttctgtttttaggtacatacatatttaggattgttatgtcttctcagtaaattcattcttttataatgacttgtcccactttattttgataatatttgccatcccccaggctactttaacatgaatataactcttgtagctttattaccacagtatttgcataattttttcccatccttttacttttagtctgtgtatatatttgcaatgcatttcttgtgattagcacatagttaggtctcgcttttttatttaggctgacggtctccttcattcattcatttgttcattcattgagatggagtctcgctctgccacccaggctggagtgcagtgatgccatcttggctcactgcaacctcagcctcccgggttcaagtgattctcctgcctcagcctcctgaggagctgggattacaggcgcctgccaccatgcccggctaatttttgtatattttatgttttgtatatttacccctgtgttggcaaagctggtctcaaactcctgactttaggtgatccacccgccttggcctcctaaagtgctgggattacaggtgtgagccactgcgcccggctgacagtctccttttaattgttgttattaaatgatgggtttactctgagtttgagtatccatatggttaggtttcagtctaccattttgccatttgttttctattcatcccgtctattcttttctgtcattttttgaatgaaagattttgtaatatttcatcttatcccctcttttagtggagatatacttatttgttctatttttctctgtggctgctctatagtagatacctttaacttacgacattctgccttcaaattatataccacttaatgtataagaatcctatggcgttatgtctccattttcctatcttctgttctttttgctattgtcatacattttacttttggatatgttagaaaatccataattcaacgttaggcttgtttttatttaaagctttgttcatctgggcctgtagaggagcctttgccctcgggctagttgagctgtgtttataaaggtttcagctgaatggcctgagtttagtaaggtctctttaatcagtcagaaggagaatgcctgtgtaaactctggtagttgtgtttatagttcccaagtagttgcttgttacccagtggttgttctttgcctaccctcgtgaaatctcacctaatacatgtgcagctaatttagtaaagatgtagtagtgcctcacaaattacagctgcttcagccttcggagacacatttaagtttctgattgggtttccaccctccctagattctcagtttctccctttctggctggggtctggaaactgcctcaaaatacaaagctttgacaatcataaggcacaggtaatttgcttgtcttctctcagggatcacagttcggtgctgtctattgttcagcatccaagaatagctgtttcatgtatcttgtccagttttttagtagttttggtggaagggctagtctcaagttactccatcatggtaagactaatttaactttttataaatacaaggtttgcatgataaaggctattatagcctacttcataaattaatacattgcattctgcgggcagtgttttgcaccatttgtcctggcttagctgatattcatgttctaattgttcattacaggattttgtgtaaataaataaatgtttagcctttgtaatgggattgttaatagtaccctggatctgctactttaccaattgctccctaatgcctacagttgattgccaacactatctcactgccccctgtaactgcagtagtttgagctttaagatacaatgtcactaattatggattattctgttcttgttctacaatatcccaatatcttcagcaaaggattctgtattggctcccaccagctggtatttactagaatgtggaaataattcaaacaggaggactgtgcttttgaaaacctgctttaacattagaagaggaaaagtgattgtaaatggctatttttcatgtaagggagggattaaattttcatatctattgtttaaagaaatctgtagccaaaggtgtctgtttttagttgggtcattgtttaggactatagacttcagttttgtattcttagtaatattaaccccttcacctcccctgataacccaagaaaagatccttcgtataagattttaaaaattgcaccagaggagccaagtggctcatgcctgtagtcccagctactcactacttggcaggctgaggtgggagtattgcttcaccccaggagttcaaggcccaaggccagcctgggcaacacagggagaacgcgtctcttaaaaacaaacaaacaaaaaaattgcactgggatttgcattaaaagttgcaatacatacctagtatgttttctaatcataatgtgcaattttaaaaaaaagtgtaatttttatctgccttctaatttgagcctttattgttcaccagtaggtttatttcactggaacaagtctttgtgccatatttggcatcaccaaaggaatagtgccagtatttattgacaaatgaggacaaatagtttttccacattctattgccatcattgttactaggtaaacaatagaagcttataaaaatattgtgcatttaatacctttttggtttccttttatacttgtcaaaagtcatttatacataaattgacatactgtgtccatgatatgtatggataagtaagatctttttgtagcttgaatatcttatgagtaaatagcatttcctaactattaaatgggatttgaatagctgtcaagggattacttgatacagagaagttgctaatttattttgaaattgtaaaatacattttcccctctgaaatcacgaaatgcctcatattgctaatgcagtgagtttaagtgtttaatttagaaaaaattagtaactgctggttgcctcatattgctaatgcggtgagtttaagtgtttaatttagaaaaaattagtaactgctggtgttatttggcatgagatgaacctggaagggaagtgttgaggggcatcatctgtacttggcactgtttagaactttctttagaggtgtatagtgctttcttacactaatattccagtgtatgcctgaatagcacttttcttcttgtactgaaaaataagtccatggtgttaagcaggcatctctaaagtggccatctgatttaaaatagcttccataagttttaattaattttgcatgttttagtttctctttttgatagcaggtagtagctctctgaagcattccttctgccttgaaacatctttctttttcatatatttgccgttttcctttgtgagacttaggcttataatacaataaatatttaagtgccacctatttactaggcactgttaggttataggctctgtagatgtagtggtgaacaagatctccgttgttactcagtttgtagactatgaaggaaaaggagtaagggttggagaattactcatgtattaaatatatgttgctttttggaggcaaatgaataaaatatttagaatggttaagatagtcttctgctttctttggattcactaggggttttatcataatctgtctcatatcatttcatatgttaaaagggaattttaatgaaatacgttactactggttgtggattctaaaaggtagaaggacaaaatattatttgcctttaagaatacaaagaaaggattgtctgtttgtatggttagttgaattgtcttatttcctatttatttattttttattgctgagatctcactttgttgctcagggtgatttttaactcatggcctcaagtgatctcctgccttggcctcccaaaatgctggaattacaggcctgagccatttcaccccagcctatttcttattctccctacaagggacattttagtgtaaggcaaaaatataaaattatcactcataatgttttttcggaaaatatatgactgcatggttttgtagttttcttagcagtcactgggtcattaagttacctcgttttttgcttcttgttcttccttttttctgggggaaaaagttttctctaggtctcatctctcaattctttagcaaggcatatttttattcatcataccataactatatacatacttaaaagtaaatgacattttgtcttaccatggatttctcacgtatctggtgaagtggtttaaactgtccaattttatgtgcattgaaagcaaaagctagctgagaaaggaaagcttttctcatcaaagaggttgaaattactgtcgtaaaacagtgataaataccagataagatatgtgatccttgaagtttaataaatatttttggactgttaatttatattcacttttgggcatgttttttttgagacatggtctctatagcccaggatggagtgcagtcatgtaatcatggctcattgcagcctcagcctcctgggctcaagcgatcttcccacttcagcctcctcagtagctaagactacaggcatgtgccaccatgcctagctaataaaaaaaaaaaaagttttgtagagatggagtctcactgtattgctcaggctagtcttgaactcctgagctcaagcagtcctcctgcctcaccttcccatagtgttgggattagaggcatgagccactgcacccagcctggttttaatctttaggaaatatttttctaggttaaactcaacacagtataagtatttttacatgtatttcagaatctaaatttattaggatactggctgatgacttacatgcttttattattaagatttaggttcccagcactttgggaggctgaggcgggcagatcatgaggtcaagagatcgagaccatcctggccaacatggtgaaaccctgtctttactaaaaatatgaaaattagctgggcatgttggcacgtgcctgtagtcccagctactcgggaggctgaggcaggagaatcgcttgaacctgggaggcagaggttgcagttagctgagatcgcgccactgcactgcagcctgggcgacagagcaagactctgtctcaaaaaaaaaaacaaaaaacccaaaaaaaattaggcaatttgctttaaaaattagataactcatgaactcgttggttattccttattagctaaaaaaaattattagaccactgtatattatgctaattaaatgactcatttctgctagttaaaccatctgtaataggctacagaacacattttgctggagtatgtaaaactaagcccaccaggaaacttatggctaaaattaaacagaatcctgctaaccttgtgtgtgtattcaattttggtacctgaaagaatttgtggtatttagaatatttgaatgttatgttatatttgtttggatgttcatattttatatttacatgacaaaaaggatatggttgctatttaaactttttggatggtaggaaaataatcttaggcacaggaaatcatgacaagaccagtgttgtagaactattatggataaagctttttttttaactttatgtataagtaattctctagagcagaaattactcaagctttcagtgtataaattgcatgtggactaaagattgatactgaccaaatataaaagattgatactgaccaaatataaaagattttgctgcttctcctaattttcttgtaccttttgatattctttgaagatacctaatggttatttaatttcttcaggttttactaaattttgttcattctaaagacttttaaaaagcttacacatctaatatgtcagagctatgacaaaaatgccaggttttttttagggggtggtgggggtggcgggggtggtcctgtaataatgctacagtatcttgatggacatcctgttaatactttggggaatgtgtttgttttgtattgctgtgaaggaatacccaaggctgggtagtttataaagaaaatagttttatttggctcaaagttctgcaggctgtacaagaagcatggcaccagtatctgcttctagtggggcctcaggaagcttccagtcacgttggaaggtgaagggggaacaggcgtgtcatgtggcgaggggcagcaaaagagagaggagaaggtgctaggctctttttaaacaaccagttctcacgtgaactaatagagcgagaacttgcttattaccgaggggagggcaccaagccatattagggatgtgccctcataaccagatatcttccactaggcgccacctccaacgtttgggatcacatttcaccatgagatttggaggggacaaatatctaaaccacgtcaaggagtttcttttgggagagcttaggatcttattactttttaatggatgattgatttattttctgaaattcctattttactgtgtctttttgaattgtacagttttctggcatttaaatactttcatatttgttgtgcattggttaccaccatccttctctagaactttttcatctttctcaattgaaactctgtacttactaaacactaactccccattcaatcctcttcctagtccttggcaattaccattctattttctatctttgtgaatttaactaccgtacatacctccatataagtgaaataatataatatttgaccttctatgactggcttatttcacttaacataatgtctttaaggtacatccatgtcttttttttttttcttttttttttttgagacagagtgtcactctattgcccaggctggagtgcggtggtgccatctcggcttgctgcaacctcgacctcttgggttgaagcaaattcttgtgcctcagcctcccaagcagctgggactacaagtatgcggcaccacaccagctaatttgtatatcatgtctttttttttttttgagatggagttttgcccttgtcacccaggctgcagtgcagtgtcgccatctgtgctgactgctacctctgcctcctgggttcaagtgattctcctgcctcagcctcccgagtagctgggattacaggcacccgccaccttgcccagctaatttttagtagagacggggttttgccatgttggccaggctggtctcaaactcctgacctcaggtgattctcctgccttgacctcccaaagtgctgggattacaactgtgagccaccacgcccggcctgtatcatgtcttttaaagactgaaaaatactccatcgtgtgtagactctacattttgtttatccatttatctgttgatggacagttgagttgcttctgctttttggctgttgtgaataattctcctatgaatgttggtgtacaaatatctgtttaagtacctgcttttacttcttgtgggtatatacctagaattggaattatttttgtttacccatttatccattgatggacagttgggttgcttctactttttagctattgtgaagaatgctcctatgaacattggtgtacacgtatctgtgtatatctgtatatcaagtctctgcttttactccttttgggtatataccgagaagtggaattactggatcatatggtcattctgtgtgttaattttttgagaaatctctattttctacagtagctgtaccattttacattcctaccagcaatgcacaaggatccacacaacccagccagcacttaaaaaaaatttaaaatagccatcataatgggtgtgaagtagtatctaattgtagttttgactcacatttccctagtgactagtgttttttttttttttttgagactgggtctcactctgtcacccagactggagtgcggtggggtgatcagggctcattgcaggctcaatcggttctcccaccttagcctccagagtggctgagaccacaggtgcacactaccacatccagccaattttttttttttttttttgagacggagtcttgctctattgcccaggctggggtgcagtggcgccatctcggctcactgcaagctccgcctcctgggttcacgccattctcctgcctcagcctcctgagtagctgggactacaggtgcgtgtcaccactcccagctaattttttgtagtttttttttttatttttattttttattttttttttagtggagacggggtttcaccatgttagccaggatggtctcaatctcctggccttgtgatccaccctcctcggcctctcaaagtgctgggattacaggtgtgagccactgtgcccagcttgtattttttttatgtagacatagggttttgccatgtttcccaggctggtcccaaactcctgggcttaagtgatctgccaccttggcctcccaaagtgctgggactgcaggggtgagccattgcacttggccaactagggatgttgagtatcttttcttgtatgtattggccttttgtgcttctttggaacaatgtctgttcaagtctttattagttttctcaggctaccataacaaaatatcacactctgggtggcttaaacaacagaaataagtctggcagggtttgatttttggtgatggctctcttcctagagtgaggtctctggtgtcttgtcttttaagcacactaatcctattggatcaaggatccatctgcatgaccttatttaaccttaattacgtcttacaggtgtaattaaggccctgtcttcaaatacagtcatatcaggggttagggtttcaacatttcaatttcaaggggccaaaaagcccatattcaaagccctttgcctacttgtgaattggattggtttttgttcttgagttgtaaaaatatattctaaacattccttaacagatatgtaatttgcaggtattttctccattctgtgagttgccttttgtactctgttgatagtgccctttggtgcacaaaagattttcatttggataaagttagctttttctttcttagcctgtacttttggtgtcttatccaagaaatcattgccaaatgctatgtcatgaagcttttcccctgttttcttctaagagtcttacagttttagctcttatagttaggtctttgatccatttgagttaatttttaaattaactcatgttaattaaaaacagttaattacatatagtctaaaataaaggtccagcttcattgttttgcttatggatatccagttttctcaataccactcattgaaaagactgtccttttcccattgcatggtcttggtatccttgttgaaaatcatttgaccatatatgtaagtgtttatttctgggctgtctgctttattctgttggcctatatgtctatttttatgccagtttcctcactgttttgtttactgcagctttgtagtaagttttgcagtcagttagtgtgagttcttcaacattgttcttttcaagttcactttggctattcggggttctttgaaattccgtgtgaattttagactgaatttttctatttctgcataaaatgccattgggattttaatagggattgcattaaatctgtagatcactttgggtagtattgacatcttcacaatataaagtcttccaatccatgaacacatgatattttttcatttatttgtgtattctttaatttattttagtagtgatttgtagttttcagtataatagtcttttgcttccttggttaagtttatttctaagtaattcttttttatgctattgtaaatggaatttgttaatttctttttttggcttgttcattgttagtgtatatgtatattttttgtatcttgaaccaagaatagaattgctagatttgacagtttataattaatttggctgtccatactaatattgataatagatataattgtctaagtaataggcttttaaaatgtttggcatgaaataatttgagaagcatttcccctttaaatttattttatttttttggagacagagcaaactctgtcacccaggctagagtgcagtagcacaattactgctcactgtagctggctcctccgaggctcaggggatcctcccaccttatcctccccagtagctgggaccagaggtgtgcatcactatgcctggctagttttactgttttttgtagagatggagtctgactatgttagtcagatcggtctcacactcctgggctcaagcagtcctcctgcctcagcctcccaaagtattgggattacaggtgtgagctgctgctcccagcctgaattttttgacgtcagtgttaatttgtgtgtgctatgttctgtctggatatattggactggtagcttgcaaacagcctaacccttggagataagttgattttaaattaagagtaattgtagtggataattgcagaggctcttaaaagagtaaatttcattttaaaaagaaggaaccaggagtaagaatgtaaaaataatacctacctttttatttgttttctttaaaaaaaaaaaaaacagctttgttgagctgtaattcataggccataaaactcagtcttttaaagtacacaactagggccgggcatggtggctcatgcctgtaatcccagcaatttgggaggctgagatgggtggatcacttgagaccaggagtttgagatcagcctggccaacaagacgaacccgtctctactaaaatcacaaaaaaatagctgggtgtgatggtgggcacctgtggtcccagctgtttgggaggctgaggcatgagaatcacttgaactcaagatgcggaggttgcaatgagctgagatcaagccactgcactccagcctgaaccacagaacaagactcggtctcaaaaaataaaataaaataaaaataaagtatacaatgtaatgattttgggcatgttcagagttgcatggtcataactgctatttaatttcagaatccctaacagagacctcatgccctgtagcagttattccactttcccactcctctttagaccttcgcaactgctagttgattttctctttcaatgcatttacctattttgatattttatttaaatagaaccgtacatgtggccttttgtgctggctgctttcatttagcatgaaagcattttcattttcatctgtgttgtagcacattatcagtacttaattccttttaatggctgaataatactccattgtgtgtatggatataccacattttgttcatccgtcagtgatcatttgggtttttattattttactattgtgaatactggtgcttttaatctttatgtacagatttttgtggggacacacgttttcagttttcttgggtatatacctaggagtgaaatggctgaatcatttggtaactgtatgtttaactttttgaagaactaccacactgtttcccacagtggagctataccatgtcacattcctatcagcaattattaggattttaatttctccacattcttgattacatttgtgattatctgcccttttgattttagtcatgctagtgggtttaaagtggtatctcattgtggctttgatttgtaattccttgatgcctaatgatgctgggcatcttttgtgtacttattggtcatttgtgtatcttctttggaaaaatgtttatttagattctttgcctatttttaatttggaacttaaattattgtcatgggagttctttatgtattctggatagaagttccttatccttgggttgtcctgattgtgccctttaaagcacaaaaatgtttaattttgatgaaatcccatttatttcatttttctttagccactaaatgcttttggttttatatctcagaaaccattgcctaatctaaggttatgaagatttactcctgtgttttcatatagaagtttaatagtttttgcacttacatttaggtctgtgtctattttgagttaatttttgtatatggtgtgaggtagagttcttatttaattctttggtagatggatattcagttgtcccaccaccgtttgttgaaaactgttctttcctcgttgagttgttctagcatctttgttaaataacatagatgttaaataaatgttaaataaattaaccatctatgtaagagtttatttcttgactttaaattctattccattgatctgtgtgtctttatgctagtaccacattttcttgataatttcaaaacttactacaaagatatacttgagaagtgtgagttattcagctttgtccttttttcatggttgttttggttattctgggtcccttgtatttgcacatgaattttaggatcagcttgttgatgtatgcaaaaagctcactgatagaaagattgcattgaatctatagatcattttgtcagtttgttgtcaccttaaaaggttatctttagatcagtgaacaagagatgtttctgtttaggtggtctttaatttttttcaataatattttgtagttttaaaacatttttgttttaaattcttgtttttttattttaatttcgaggtgtttagccggtacttctgttcttagtggtagtggtagaggtttatcaaaaaagagaactcaaatactgatggcctttctaaagcagtgtgcatgcaataaggtgcatgcattgggcacagcaacacttgtgagaaatgatagtaacattccttggatggagactctttaagggaggaaaatgtattatattagtttcttgtttgcatcagcacctcctggaattaattttcagtatacaagtaggtgaagaaatgctccttttaaaatacctttttctttttttaaaatttttaccacaatcatgactacatatccttgtaaaatattaaaatgtaatgctaaaatctctagcctttgtttttttttttttttttttgagacgacgtcttgctttgtcgcccccacagaagtacagtggcatgatctcaggtcactgcaaactccacctcctgggttcaagcgattctcctgcctcagccacccaagtagctgggactacaggcgcaaaccaccacgcctgtctagccatcatttttaatcccgttcttttctcatcgtctgtacgggtaatcactacattttttttttctttttttttttttttttttagacaaagtcttgctcttgtcccccaggctggagtacgatggcatgatctctctggtcactgccgcctccgcctcctgggtagtgattctcctgcttcagcctccctagtagctggggttgcaggcgcctgccaccacgtccagataatgtttgtatttttagtagagacggggtttcatcatattggccatgttggtctcgaactcctgacctcaggtgatccgctggccttggtctcccaaagtggtgggattacaggcatgagccactgtgcctggccacattttttttcttttaggctttccccccagtgcccttatgtatgtatgtaccaccaaatgatatgtagctttctttttttctctttcttctttttaaatatgctgtacatttactctatatatttttccccaattgatggatggttaggctgtttctagttttttgtttttacaacctgttggtgtgaagtttaaaaaaaaattttttttaagtttttttaaaatagagacgaagtctcggcatgttgcctaggctgatcctgaactcctgggctcaagtgatccaccctccttggccacccaaagtgctaggattacaggtgtgagccaccactcctggctcaaagtttttaaaacatgcctcagggaatatgtgcgccgactttgttgaaatatatcaagggaagtagagttacttggctatatggaatacgtagtagtagtcgtagtatattgtcaaggtactcttcaaagtagctttagcagttttaccattatcaaaagtgtgtacaattgctcacttttggctgggcatggtggctcatgcctgtaatcccagcactttgggaggccaaggtaggtggatcacctgaggtcaggagttcaagaccagtctgggcaacatggtgaaacgctgtctctactaaaaaatacaaaaattagctgggcggggtggcgtgtgcctgtaatcccagctactcgggaggctaaggcaggagaatcgcttgagcctgggaggcagaggttgcagtgagctgagattgtgccattacactccagcctgggtgatagagcaagactccatctcaaaaacaaacaaacagaaaacactcatttttccaccagtgccagtacttgaaattaagcaacatcttacttttctgccaatctttttgatggaaaacagtttctttattgttttaattttcattttttctgattatttatgaagtcgacatgttttcatatgtgtgttgaacatttgcatttcttttgtaatttttttttggtctgtttttcaggttttttctctctcatggatttttattttttcttagacagagtcttgctctgtcacccaggctggagtgtagtggcgcaatctcggctcactgcaacctccgcctcccaggttcaagcgattctcctgcctcagcctcccgagtagctgggactacagttgcgtgccaccatgcccggctaacttttttttgtatttttagcagagacagggtttcaccgtgttagtcaggatggtcttgatctcctgacctcttgatccgcccatcttggcctccaaaagtgctggaattacaggcgtgagccaccgcgcccggcctcatagaaggtttttaaaatggaaatgctcaactctttttagattattattctaacacttactgggaaggtctgaattttgactgaactgtttatagcattggacaagtgtttgagaggtgtgaggggtgtgtggagagtacagcaggtaagaagagccctagtaactgtggacagcacatagattgggttccagacacatagtctttgaatttttgtctttcagttgaatcagttcagtgaattcctttcatactatttgatttccagataattttttaaagccttaggagtgtgtttgtataatatttttgcttttgaaagtcaattaaggtaaattgtctacaacaaaattcacttcgtatattttggaaaatatatacagttataaaatcaccacctgattaatatgtagaatatttccattactgcaaaaagaattccaggtaccctttggccattaattctctctactgctcagtgaaccactgatcatatctccatcactataggttagttttgcctcttgtaggatttaatataaatggtcatcccagatcttttatgtagacttccaaacctagcattatattcacattaataatatgaacttggccaggtgcagtggctcatggctgtaatcttagcactttgagaggctgaagtgggaggattgcccaggagttcgagaccagcctaggcaacatggcgaaaccctgtctctacaaaaagttagctgagcgtggtggcacatgtgtgtagtcccagctacctgggaggctgaggcgggaggataacttgagccaggaaggtcaaggctgcagtgagctgtgattgtgccactgcactccagcctgggctacagagtgagagcctgtcttgaaagagaaaaaagaatatgaatttttgactgggtacagtggcttacgcttgtaattccagcactttgggaagctggggcaagaggattgcttgagcccaggagtttgagaccagcatgggcaacatagtgagacctgtctctacaaaaatataaaaataaaaaaattagctggtcatgctgatgcgtgtgaatagtgccagctactcaggaggtagagttgggtggatcacttgatcctgggaggtggaggctgcagtgagccatgatcacaccactgcactccagcctgggcatcagagtgtgagacgctgtctcaaaagaaaaaaaaaaaaaaaaaaacttaaaaatgacctaactttgagagtggttggtttaaaaatcttgaatttctctatagttgagaattgtttctgaattgatttggcaactttatgtcactatttaataagtaaaactttttgtgttaaattctgcagtggaaatactgacacaacaaggttaacagtacttgaatctctgaaatgagatatagtcagtggaaggaagacagtagtttaatctacccctttttccatacttgcctcttaaatgttagtttcatggtactgttaatcattatatacaatgacttttggttgttctgtacatacatatattgctttgaacaaaggaggacaacatccaaagtgataatagtatttagtttctgccaaagctgtttttttgttttattttgttttgtttttgagacagagtctcactctgtcgcccaggctggagtgcaatggcatgatcactgcaacttccgcctcctgggttcaagcgattcttctgcctcagcctcccaagtagctgggactatgggcgcgtgccctcatgcccagctaacttttgtatttttagtagagatggggttccaccatattgaccaggctgttcttgaactcctgacctcgtgatccgcctgccttggccttccaaagtgttgggattacaggcatgagccaccacacctggctgccaaagctatgttttaaaaaaataattttctatttccgtagtcctcctagaaggggagagagaatcctttttttttttttttttaaagcagattaagaccattggagggaaggagtatgtctaacctgatttttagcccttttttgtaagacagcaatgtcacggatttatcaagatttcatgttatttggtaggaactcctgacagccagctctttattcttctttgcacatgtgcattgatttcactgtacaccttctcaaaattctggaatggtttattcttttgaaaaaattcccatctcagagatacactaatgttgatcaggattataaggacaggttataaatctgaatgctattgtaatttgtttcagtctattacattgtagatttttgacttgaaccagtgagttctctaagtgcttctcttttgttctcttaattataaaaattgagatgtaatacacgtataaggtatagtaaccctaaattaaagcctggcagctttttagatatgtatagacccatgtaactacacccatattaatatacagaacatttatagctctctccctactaaggttcccttccatcctttcttaggcactacatactgtgagataatcactgtcttgtcatctgtccccagagtgctttcatttttgtttttggtttcatagttaaagttcttttcaaaatgttcctttttttggtggaaatttaacagggtactaaattggtataactaacttattagtaaagttataatcaaagattgctgggaaggcacggaagtgatcaagactaattatgattcagatgattaatagtatcattcagagatagtcttatgcagcattcctcatggtcagagtactttacctgggactagagtacaacattttttaaaaaaatgtggattttgccataaggaaaataatgaaaaagcaaaaggataatgaactgatgtgatgaatgttcatgtacctacgacctaatttaacaaatatttatccctgtcatagttcagattttaaaaactaactttgctatgttatatgaaaataataatagttatagaaataatataaggaactctcaatgttcttcaccaattgtttacattttgtttcatgtgctttattatttctccctttctccatattttttccctgaatcattttagagtaagttggaagcactgtgcccctttgcctctaaatacttgagagtttatttctttttataaaattttaaaatttttattttttgagatggcgtcttgctctgttgctcaggctggagtgcagtggtgcgatctcagttcactgccacctctgcctcctgggttcaagcgattctcctgcttcagcctccctagtagctgggactacaggtgcgtgccaccaggtctggctaattttttgtatttttagtagagatggggtttcactgtgttagccaggatggtcttgatctcctgacctcatgatccacctgcctcggcctcccaaagtgctgggattacaggtggagagtttatttcttgagaataaggacattatcttttttttttctttttattatccaggcaaaaaaaactgtgaagaatgttattttatataaccacagacaatctttcatgggtttttatagattaattttgaggatgcttttatatccaagttcttggatacacatcacagttggcaaaatatttctcgtgctatctcagatttgtataccatcagaatttttagtatatttttaatcttcttaactaaatgcaaatgtagcttattttactatcggtcaagttattttaaaatttgagaattaaaatgcatcttgctggcttcatttgtatttcactgggtggttgtcaccaggtatgctctcttccattatcttcacataatttttgaactgagaggtactaatcagactttagtcatcaatgatagtcttgttctttgcacataaagatgatagtgtaaacccaacagagcagttctgtgtttttttttttttttttttaggagactgggtctcactgtgttgcccagtctagacttgtactcctggactcaagccatccttctgccccagcctcccaagtagctgggaccacaggtgtgcaccattgtgcctggctaaagtaggcatttttagttttgctttcttaccacctctcaatgagatgatgcacttgtggttgtccagccatacatattcgtctacttatttccctatgatagtacatgtttttagggtagttgatttatggataaaaacatgtttatattatgtataatatctatggaagtgaataaatttgcttatgaaaattaaactctagctgggcacggtggctcacgcctgtaattccagcactttgggaggtagaggtgagtggatcacgaggtcaagagatcgagaccatcctggctaacacggtgaaaccccatctctactaaaaatacaaaaaattagtcgggcattgtggcgggcacctgtagactcagctactccggaggctgacgcaggagaatggtgtgaacctgggaggcggggcttgcagtgagctgagatcgtgccactgcactccagcctgggcggtagagagagactctgtctcaaagagaaaaaaaaaattaagctctggacattaaagatgttagcacgcatctaatcaaatgagcaactgtgtattagattacttgaagaaggtggtatcccatttggctattctagagcccaatttttcttttgtatgtgtaatttctggagttttctcttgccatacttgcattttaatataaaaatctacactaatgtggtctcttttccttagtatctaagtttttaatgtcattatagattgtaatatttggagactttgaaaagattctattttaggggaaaactagggcatgcaggttgatcttgtcccattatggtgagttgtttgtcctaccctgttatattagaatctagaaacatactagctttgaccttggacaagttattgaatccttgggaaccttgaagtcctcactgttaagtgggttaagtggcacctccttcaacaactatgaagattgaataagatagtgcgtaaaaagtacatagcccagtgattggcacatagttcagtaaataatagctttaaagtatgaaaataatggtatttattcagagtttggtttcgcttaacaaagtaatttatccatttagactacttttattaagcatatatttttctattatagtatttaagcagagctttgtgtgtaatatattttaactataggtgtcttgtgaattaagaaatggatacttctgtaatgaagacgttttaagagcttttaagttgtacattagtttgttctttgataaacccatgagattgttttgtcaggggagataattctatttcttttgagaggtaaatacagcttgtactatagtatttgatcaatttacaataggacattagtggtagagctaatatgtatgtgattactaaatggcatgtacagttcgaagtgttcctgtttattagctcacttaattctcacagtaacaccataagataccattgggagtggaagcaggagaaagaaaaagtgacttgctcaagattacagaactactagatgcctgaattgggttttgagacaaggtcaggctgactttaaagctgtgtaagaatgtgttaaaaactaacatttaaaaaagtgctagtgtatgttttcagttcttaccttacacactagtattccttttgaaagccttgtttaaaacagcagaaactgaaatgatacggcagagtaaaacgagacgtcatatttctccactaggtcaaagaggtaaagaatagaagtaacactgccacaaattgtagagaatagaataaaagaaggaaagcaggagatctattcctcagttatgacttttacaaaataatttccatatctgatgcggtttactgtctgattgaatgatctcttctctccatgcccacttttttttttttttttttgagacggagtcatgctgtgtctcactctgtcgcccaggctggagtgcagtggtgcaatctcggctcactgcaggctctgcctcccaggttcacgccattctcctgcctcagcctcccgagtagctgggactataggcgcccgccaccacgcctggctaatttttagtatttttagtagagacggggtttcaccgtattagccagggtggtctggatctcctgacctcatgatccgccctctttggcctcccaaagtgctgggtttacaggcgtgagtcactgtgcccggcctccatgcccacttttaggggaaaagtttagaagatggagacaaaaccaactatccttctgctatctcttagattttcatctctttctattctgtagcctacaatcgtaatgtagaccaagattaggctgaagaataaaatattccttaatgtatctaatatttttatagtattgaactgtaaccccataatgaatttttttggggaaagtcagattatttggttatgcttgggaacttttaggtagttgcagactcattaataaactgatcacatggaccagattgtcttatccggtcagctttttgcttccttgttcttatatttgctctattgtgctggtgcccataacaacataaacttacagctcagtaatgcagggcaagtagacttcttcctgccctggagctttttcctgtactagatgccagttctgaggatggtgagcctgagagtttaatggaaaacctgatttcttgattctctgtggttagattagatttgtttcaatgctgaaataaagaaactctaagagagtaggtagaaagcagtgcttggctggaggatatttaataagtgttcaactttagaatgaatgggtttcttgctttgttaacttcttgaaaatgccagtgtctttaatgataccatttaatagaggtaatctgtagtggaacattatttagtgacaccacattttcaattcaatagccatttatttgcttttgtaaattctctgtattttctcatattcccaaagacttttttcagttttctaagtgaattaatttctttgagtagaatataaaatagtaatattaaaaaatatggcccctcatgctatccacttgagttttaagatggttaggttttttcgtattactgactggctaaaaggagaatttgatcctggagaatttgatttgagttttagatataaaggcttatattttaccccccttttcttaaattttttgtcaagcaccccccttctacagctgacaaaactaagatacttcttaatattggattaagcttttgttattatatattagttttctgtgttatctttctagtcatatctagtaatgttaagcttcattttgtcttgtacttacttggatttgcagctttaagatgcttatcattagggctgaatcttatttctctggaggatactgactctttaaatggctgtaaaaatcattgagcgcctactcgataccaagacattctcttctaagaagagacttctttctttaccatatactgtctacctttggtcacagcagttttgaggcttgggagctatttgttctattcctttttttgtgcttgttcacttttttctttcaaaaaactttgcagattttttttttttttgagtcagggtcttgctctgttgcccaggatgaagtgcaagcagcacaatcatagcttactgcaggcttgagctcctggggttaagtgatcctcctgcctcagcctcccgagtagcggggactataggctacaggtgccgccgcacccaaactttatttgttttataaaacactagtttttagaatataaaacttggtgaatagtatcactatgtataattcttgagtctcaagtgtaaacacatcaaaatgcgtttcgtagggagtatatattcagggcaacttgaatctatgctcctgagaaaaataaatttagaaaaccgacaaaaacccaaaatgcatttcataaattgtacaagaagatttgaagtaattaaaaaatgatggagcaaactttcacaagcctgtttttttagttgttggttcctaatttggcatcagtctgtactgagttgatgcttcagtaggtttgagacaggaataatacagggtggtcacaggagaacagaaaattccaggcagcaattttacatgactagcataaaggaaactattgaaatagctgcataaactaggggctgacaagaccttaaaaaaccagagtgtgggccaagctggctaagactgacccagcatggcactggatttgacctaggtttcacctaggatctcattatatgctcattaacatactaaatcacatacccaccagcaccatgcagttccaggaacacccatatttggtgtagaaatgggtggcactacagttctgagaaatcgtaactgttttcctggaatcttcctgaatattccatgctttgcgtaaagaaacccataaagatggaagtaccaacccgcttggtacaaccttctcttgagtatacccacacccccctttcttgagtttataattttcgctttgtcataaatctccgtactttcactgtttctgactcattcctgaatttctccttgtgatagtgtcaagagcctggacaccagctgagggagaggtctcactgctctttggggacttcccccagcccgctggtattcagacctttccaaaatctgagtgtctgttgtggaatcatatagagagaaatttttcttggtcattagagtaaagtatatgcaaattcttttcttcttttccatagctcactgctatttggggacttccctcagcccactggtattcagacctttccgaaatctgagtctctgatgtggaaccatatagagataaatttttcttggtcattagagtaaaggtatatgcaaattcttttcttcttttccatagaatgtttgctcaggaccagctgcataatttacagggcctcttcaagaggtgatttagaaaactatacattttctttacttttattttattattttttttttgagacagagtctcactctgatgcccaggctagagtgcagtgtcgtgatctcagctcactacaacctccacctcccgggttcaaccgattctcctgcctcagcctcctgagtagctgggactacaggcacccgccaccacgcccggctaatttttgtatttttagtagaggcggggtttcaccatattggccaggctggtctcgaactcctgacctcaaatgatatacccgcctcggcctcccaaagtgctgggattacagaagtgagtcactgtgcctaactgaaaactatacgttttctaattgtgctgcataattgtatattttgtgatttgtatttgatgaaaatatgtccacgctggaatttaaaataaactgttttacaatggtatttttgtgtcctaacttaaggtctggttaaggagtgtcatggttcaaactatttttattataggtttaaataaaataaaaacaaaacaccgtggggccaaaagatgggaaagggactttgttggagctgatagttttattattttcaaacattgaaatcttgtagagatagacttttcaaattaatcctgagttgttaattttaaactttgtgattatctcactcttgagataatcctataaaccttttcagacataatcattgaggttagctaaaactacttttagcaaaagccatatgcttgttttcccagtgggtgaaattgagcactgacttttagagtcactaatgttttagtgaaactgcttaaatttcaaggtagaccttagtgactttctatatgtatgaaggtattacttgactgttttataaaataagaaccgtaattggcgtagactttcagatgagattgggaacattcagggtggtatggccgtaggcagtatggactttcagatagcagctataactgttagtaataagagtaggactgtcaggccactctgcccaggctaagccatcatatctcctgtgacctgcccgtatacatccagatggcctgaagcaactgaagaaccatgaaagatgacattcaaccattgtaatctgttcctgccccaccctaactgatcaattgaccttatgacaatacaccctccccgcccttgcgatcatgtactttgtgatatttccctgcccttaagaaggtactttgcgcctgtaatcccagcacttcgggaggccgaggtgggcagatcacgaggtcaggagatcgagaccatcctggctaacacagtgaaaccccgtctctgctaaaaatacaaaaaaattagccgggcgtggtggcgggcgactgtagtcccagctactccggaggctgaggaaggagaatggcgtgaacccgggaggcggaacttgcagtgagccgagattgtgccactgcacgccagcctgggggacagagcgagactccgtttcaaaagaaaaaaaaatactttgtaatattctccctgcgcttgagaatgtactttgtgagatccaccccctgcccacaaaaatttgttcctaattccactgcctatcccaaacctgtaagaactaatgataatcctaccaccctttgctgactcttttcttggactcagcccgcctgcacccaggtgaaacaaacagccttgttgctcacacaaagcctgtttggtggactctcttcacacggatgcgtgtgacaatgactgtacttttaacagatgagaagtttgatgggagttgaaactagaacttttttttttcctcctgaataggaaaaatcggaacattctttaaggtccagcttttctcaccctgccccacctttttaaaaaaattgttgcttattgccaatagactagcaagtggttgaacagtttccttggcaagaggtgccaggtgactgactaatgccatcgtaaagcacatgcccttgatcacatcatatggacttgatctccttggaggctaattatatttagggacattttagtactttcaaggaacctcagactttgctgaggttgaaaacactggtgacctccctttggttataagagagaccaggagttcatatgcattccttcagaaaaatatttgaaaaatataacactgaccttgggagattagtgcatatgatcttgattttatgatcttttctagagacactgcaccactgcagccactgcctcaatcatgatacagaacttttacatcacatgagaaagttcctttatgcaccgcttctagttagtctttctctgccctaatccaaactactattctctttcctatcactaaaaattagtttcgtccttgaacttcatgtaaatggaatcatacaatattcttttctaacttgttgctttgagtcaacatcatgcttttgagacttatccaggttgtatcagtaagtagtttgttcatttttattgctgagtatggcaatccattatagaaatataccacaatttgtttatctgatcacttactggatatttggggttgtttccagtttggggctgttatgagtaaggttgctgtgaacatttgtgtccagacctttttgtgataatgtgctttcatttctcttgggtaatacccaggagtagaattgttggatcataggataaatgtatgcttaacctcataagcagttgccaaactgtcctccaaagtggtaatgccattttacactttacgagccgtgtatgaattccagttactcgatgtcctcaccaacatttgctcttgccagtttctttaattttagttagttcagtggatgtaaaagggtatctcattgtggttttcattttttgtctccctgatgactgatttgagaatacttctcctacatgactttccttttcattttcttaatggtgtcttttgataagtagagatttttaaaataaaattttaattgtgggaaaatatgtatgacatttattaccatcttaaccattttaaaatgtacaattcagtggcatctctacaaaaaaataaaataattaaccagacatggtggtgagtgcctgtaatcctggctacttgggaggccatggtaggaagatcccttgagtcccaggagtctgaagttgcagtgagctacgattgtgccactgcaccccagtgtaggcaacagagtgagatgccatctcttaaaaagaaaaaacaaaaacaaaaacggtattttctatcttgaatgcctttagtttttggatatgttgacccttctgtgacaccttggtccacatgatgtatcaggcaaaattcacctccgatatttcacgtaggttcttttctattttccctaagtgtcagccagtctgagaaataaagggaaagactacaaaagagagaaattttaaagctgaatgtctaggggagatgtcacatgtcggcagcttccgtgatgacccctaagccacaaaaccagcaagtttttattagcgattttcaaaaggagagggagtgtacgaatagggtgtgggtcacagagatcacatgcttcatttgcttcacaaggtaataaaatatcacaaggcaaatggaggcagggcgagatcacaggaccacaggaccggggcaaaattaaaattgctaatgaagtttcgggcacgcattgtcattgataacatcttatcaggagacagggtttgagagcagacaactggtctgaccaaaatttattaggcgggaatttcctcttcctaataagcctgggagcactacgggagactagggcttatttcatccctccgctacgaccgtaaaagatagccgtccccaaagcggccatttcagaggcttcccctcagggacgcattctctttctcagggatgttccttgctgagaaaaagaattcagcgatatttctcccatttgcttttgaaagaaaaatatggctctgttccatccggctcaccggcagtcagagtttaaggttatctctcttgttccctgaacattgctgttatcctgttcttttttcaaggtgcccagatttcatattgttcaaacacacatgctctacaaacaacttgtgcaattaatgcaatcatcacagggtcctgaggtgacatacatcctcctcagcttacgaagatgacaggattaaaagattaaagtaaagacaggcataggaaatcacaagggtattggttggggaagtaataagtgtctgtgaaatcttcataatttatgttcagagattgcagtaaagacaggtgtaagaaattataaaagtattaatttggggaactaataaatgtccatgaaatcttcacaatttatgttctgtcatggcttcagctggtccctccgttcggggtccctgactttccgcaacaatgatgtgtgtatttttctttttttcttttttttttgagacagagtctcactctgtcacccaggctggagtgcagtggcgccatctcggctcactgcaagctctgcctcccaggttcatgccattctcctgcctcagcctcctgagtagctgggactacaggcacctgccaccacgcccggctaatttttttgtatttttagtagagatagggtttcaccatgttagccaggatggtctcgatctgacctcgtgatccgcccgtctcggcctcccaaagtgctgggattacaggcgtgagccaccgcgcctggccttgatgtgtgtatttttcttgtctacgtttgccactcttttagtatataagtttataagttcatagaaattttagctgaagtttttggagaaggtgtgttgggtaaggtgagcttgtcagggaaggaaggaattggtatgttatgactattccagatctactttgaatctgtatcctatgacttaaaggattattttgctatgtctcatatagcaaaatgaggctcttatagtcttagaacatgatagacttttagtttaggcattttgcttccccttccccacccccaaaccccacccccaatgccagctccttcatgtggacaacttttttttttctttctttctttcttgagacaaggtctggctcgattgcccaggctggagtgtagtagcacgatcttggctcattgcaaactctgcctcctgggcttacgccattctcccacctcagctgcccgagtagctgggactacaggtatgcaccaccatgactggctaatttttttttgtagagatgggattttgccatgttgcctaggctgttctcgaacttgtgagctcaggtgatcctcccgccttggcatcccaaagtggtgggattacaggtgtgagccactgcatccggcctccgtgtggacaacttaaggcaagagctagcggggtcttaaagcccagaagagtgagaacagtgtttcgtggttccttttgagacattaatatcttttagattggtgcaaaagtaattgtggtttttgccattaaaaatgatggcaaaaactgtaattacttttgcaccaatctaatacttatctccactgcttttatctaccccaagaacttgtcattgtcctaggggagaattaacttttacttctatctgacttacgtgttagttttgtgatgttttattctagattaagtatcctcacataaagtcatgtttttgataataggggaaaaagtcagacttttacttttgtcttttcttcctacccccacaagaagacaggaagtagatagagatcaaattgagttggaggaggatagtatttgtggacttccaaacaaattcttttatcctcaggacatatgtagcttggtatgcagaggcagcatgacttttggaaattaggtgctgttctttttcttatttctgttacattttaaagttttgcaagctactttgctcggttatctttaatgttgtatgttagccagttgattagtgactttttattgtgataaaactttatttgcagtagatctttacaaactgagatcacagaacatgtaaactcattagaactgttattttcaattggtgtatttctgatttaagcttttcttttagaaatgtttacttttatatttgctaaatagatatttcagtcattgattcaatgaataaactgtataaataggttcattgctgaaattgctgctgtgtgtgatttataataatagcagatttctccataatcaaagtaaatacaatatccacattttatttctggaaatgaattgtttaaatattattttttagacagggtctcctctgtcacccaggctggagtgcagagggatgatcaccactcactgcatcctcagcctcctggactcgagtgattctctagcctcagccttctaagtagctggggccacaggcacgtgccatgaggcctggcgaatttttcatagaggtgggattttgccgtgttgcccaggctggtctcgaactcctaggctccagcagttctcctgcctcgccctcttaaagtggtggaattacagttgtgagccactgcacccagcctggaaatgtaaataattataatgacatgtagtaagcattataaataagaataactatattgaaatggcacagtgaactctgcagggaagcttttgcagtaaaaatgttttcaagctggccaggtgcggtggcttacatctgtaatctcaacactttgagaggccaaggtgggaggatagcttgaagctagtttgacaccagcctgggtaaagcgagatccctgtctctataaaaaattaaaaaaaaaaaatgtagccaggcatggtggtatatgtctgtggtcccagctacttgggaggctgagacagtaggattgcttgagtctgggatcctgaggctgcagtaagctgtgatcgtgccactgcattccagcctgggcaacagagtgagactccagtctttaaaatgaaaaagaaaaaaaaaaaaaaaatttcgagccaagaattgaaggacacatgggccttgtccagatggataaagtgggatgagggaatcaggcaaagataatagcagttaaaaaaaatttatggatgaaaaaattttaaaagcagtcccaacttgtttaatttggaaatgtaatgtcagagggtttattttttggagagaaattttaggaaaacttctattgaaggactacgacagggagtgttaaaagatttgaccagagtagttatgttataaattcaattgtaaaacttgtgtgtgtgtgtatatatttgtgtgtgtgtgtgtgtgtgtgtgtgtaaggtaatcaaggtataattaaatataagcaaatgtttgagagtcaatttgatggaaaaagtggcagtgatactgataacatgcaatggaaagatgagaattaggcatttcaaagaaagcagtgaaaattggtgtcagattttgtcattggaaatagagtcaaatggtttctagactggaatacctagaacaactgtgattcccaaaggagtattaaggagctgtggtggggagaagagagaggagagggaggcagatgatggattctgtttaggatagaggtaaaggtgctagattgacaacctagaggagatctggtaatctgtggtcatgtgctagcaatagcagtcagggttgagggttatttggggagctctctgctagtagctgagggctcgagagaaaggcttatcatttctgtgggaaggactgatcctgttgcatgtgcaccaggtcaggcctgttcatgaatggtttcagactgttaatggattagaaaaatgtcttatgaagaaaaatgagggaacaaggaatccggaggaaatgatttttgtagcagtttctctatatgaagaatttgtattagtattagggcaatatcattcaaacctctcattaatgtactacctgcatattttttttgcagtatctgtataccaaatgggagtgcatcttaaagacaatggcatgttatggttgaattggaaaagttttttttttttctagtggtatgtaaattaatagtgtgtcttgaatttgatggcatctcagactgaataaaaggtaaaattttaaaaatgctcagtagcgcaaatatagttcttaaaaagatacttgtttatgttctgtttaatctcagatatcaccaatgataatatataccacggcatggaaatactggtaatagagtactcccattgaaaaaataactatatgctttagaatatagggtttaggttagattgtaaggaaactgttgaagatgtaaatcattagaaaagaaaaagtgtaagttctttccaaggttcttatgtttccagcattttaacatatatacatgttctgactgaacagtagtagtgcagaatctgttatccaatcacaggtttgattttaccagagagcttggataaacatattatttctttctcctctttccgacatagctcctttgacaaatgatttttatgttggaaaatgcaagaaaaataagtagctcagattgactttggaaatgtaatattattcttaattcacaggcttgttggcaacttgagaattccaattatttgtctgtgtggattgttttttttaaatgctgaattgtatagtacttaagtttttgatgtataaacaatatacttaatatactccataatgtatgaggataggtttctattaggctgtatgtttgagaaagttttcctcttatgacaaaagttaatttagccagtatgctaaattaaaaaaaaaaaacaaaaaaccctgcctcccagttttctgagttaagtaaaatgatggtgtaagaattttttaaattcaaggtttggtctgtctgaatttttctgagtcattgatttaaatgcagttacttaaaagcatacggggagaaattccttttactacttgttagctctgatttaacttggtacttttgccttccttaagtaaagcatgttgatgaattctactttttggctttagctgaaaaagttcattttcttcctgtatgtatttggatggcagtcacatgtattcctctagtttacatgagataaatattactaattttaaaaaggtgggtcttttctgggggtatgttgaattgaagatggtgttcaggtcaagacagtttctggtcttttggccatttaataatctgagaattgctttgaaagggtaggtatttgagctcatcatttaaacagagcctgcattgtggtgtgtggttattggaggttgttggtgttttcattggcgtgttttcaaaaatatgagtagccccctacctaaatgccagaatacaaattttaactaggccagtagaagaggggattattttcatttcacatagcctctagtatttgaattttgtctgtctttgaatgtacctcttggctagctagagttggacagttttcaattgtgatgacagcagttaaaaattcaaatctgttccttttcattgttgagttgtatgcttaaagaatgcatctgcattttcattcagctttctggtccttgtcgatttttgatgtctgttattctgcataaaactgtgtggcaggcgccagaacttttaagaatctttttgtttacagatggggagacaataacattaacattcattaacattcaaaataaaacattcttatactgataagcagtatgcaggttagctaggtttgggatactgatagatatttttttagtgtagtttacttccaaatgtcttctagaatttatgtttaatatctcaaatacctacacagaataggaatggcatgcttatttatacatgggcgtactcttgagttctaatggcaagccagccttcaaattaagttgtcttcctggaaaagaaacctcttaggcaactgtgaagggagagggataatataaaaaggatggagtttagaaatttgtctttttgtggtaagatctagaaacaaagcatattagaataagcagtgtaaattttgcacctttcaaaaagatactgatgtttttatcatgaaataataaaaacatattattgtctaaaaaaaaaaagccaaaaaacccagccaggtgctatgactcatgcctgtaattccaacactttgggaggctgaggcaggaggattgcttgagcctaggagttcaagaccaatgagaccacatctctacaaaaaaccacaacagtaaaaatgagccgggcatggtggcatgtgtctgtagtcccaactactcaggaggctggagtgagaggatcgcttgagcctgaaaggttgatgctgcagtgagccacaatcatgccactgcactctagcctgggcgacagcgaggccctgtcttaaaacacacacacacacacacacacacacacacacacacacacacacacccccccccccccccccgaggccctgtcttaaaacacacacacatgcgtgcgcgtgcacgcgcgccaggcgtggtggctcatgcctgtaatcccagcactttgggaggccaaggcgggcagatcacctgaggtcaggagttcgagaccagcctggccaacatggtgaaacaccccatctgtactaaaagtacaaaaattagcctggtgtggtggcggtggcaggcacatgtagtcccagctattcaggaggctgaagcaggagaatcgctggaacccaggaggcagaggttgcagtgagccgagatcatgccactgcactcaagcctgggtgataaagtaagactctgtcccccgcgcccccccccaaaaaaaaaaaacaacacacgtacacataaacccacaaaaaacacacacattccacatttctggcctttgctgcctgtctcattgattagttttctgttgagtacgtgagaataggagctcttaatttaagccttattaaaaaaaaactttttgagaacctgtttttaaaactactcctcttcgtggagattgattattttgggtctttttgtccaagaaaatgaaattaagattttattctttgattggtatgagggaggaaggagagtcgtcagtctagtgttaaagataaaattatgtatgtttaagaggggcagaagtcatcacaagattataattaggaaaatttaagtttccatacttccaaggaagtatgaatttctagaatatcttttatttccatttgatttaggcattgctattgaagacactgatttggggcaaggtgtcggggagaacaggaggaattgtagttaacttctttcctcttcaccagaggttaactgagagcaagaagcaggacatgaatgagtgtgcaagaatttgccttctgttaatttcccaaaggtagaccttggaaatagtcaaaagaacaaaagtcaggaaacctttttccgaggctggagctagtctttctgatctttccaaagcagttataaatattgaagtacctctggcacttagataaaatgattctgcgtggctttaaactcagttaatttctaatgcttgaatgtctggattttctatgatttctgaacaactcagatttaagtatgtcttttgttttctgtgaaattataagggttttttccttaggagatagggaacatttctgttttttatttttttatttatttttttattttttgagatggaatttcactctgtcgcccaggctggagtgcagtggcgtgatctcagctcactgcaacctccgcctcctgggttcaagcaattctgctgcctcagcctcctgagtagctgggattacagatgcacaccaccatgcccagataatttttgtatttttagtagagacggggtttcaccatgttagtcaggccggtctcaaactcctcaccgcgtgatctgcccatctcagcctcccagagtactgggattataggcatgggccaccaccacgactggctgggaacatttctttcagatggtaaacctaaatgctgccttataaaattagattttaaactcttaatttctatagtaaaataatgcctaccttgtgatatttcatagaggacatagattcagaaaataactttacagattacttacagaacttccttaccatcttgttaatgatatatcagtatatctgagttaaaagtataaagtgggccgggcgcagtggcttacgcctgtaatcctagcacgttgggaggccgaggcaggtggatcacgaggtcaagagatggagaccatcctggcccacgtggtgaaaccccgtctctactgaaaatacaaaaattagctgggcgtggtggcatgagcttgtaatctcagctacttgggaggctgaggcaggagaattgcttgaacccaggaggcagaggttgcagtgagccaagatcgcgccattgcactccagcctggccatagagtgagactcagtctcaaaaaaaaagtataaagtgaatgtgttctgcatgtagaagggaatataaggagcaaatcagaacatatacttttatattcattcttaaaaatttaatttttaccgtttttagcagattgtatgtgatctttggttttaatctcttctgctgctaaagatattatatatggctgatattcccctaccccctatctcttgtataagggttgagtttaaaaggaaaatgcttgtaaaataagttatttagaagggtaacaatgaaatttgttaaggttggtttacttacagttaatcttttctgagaacatggtcagggctgcctcctcttccctgttgagatgtataaagcaataaggtgcatgtgaaatgcaaccagcctgttgtctaaaaatgttagtgtgtaattactttgcttttcatttctcacatttttgggtttacatctggaaacgccactaaatgaagacgagtgatttttaagcattaatcactaacctactgtttcagattctgtctattgcagaacttcttttgaagaatgtatttagaacctttcccacattaaaaaggtcaatttatgtaaatgaagaataaacaacatactctgtacctcgtatgtagttacatacttacacatgattgatcttttggtcattatctattgaaacagagttttcacttgttaatagtggaaattatcttaagtgttgctggttcaagtgatttattacaagtaaaggttttttttttttttttttgagacagtctctcactctatcaagtggagtgtcgtgtagtggctcgatcatggctcactgcaacctctgcctcctgggctgaagtaatccgcccacctcagcctcctagtagctgggactacaagcatgtgccaccacgcccagctaatttttgtgggtttttttgtagatgatggtttcatcatgttgccgaggctggtctcgaactcctaggctgaagccatctacccgccttgagtaaaggttttttgatacaagaaatgattataacttggagttcagcttggattctgacaacttactagatttttttccccctcgggagaggatggttgtttcttgcttaggaaatgataatattttagcagcttatctgtgccccacagctggcagagtaatgcagtatgctgatcatgaagttgcatctggaaccctgaaaacttccagaccttaatgtttccaaagagatagaaaagacacatagcttctggtgtgtgtgtgtgtttttttttttaaaatcatgttagttggaggtctcattgaaccaggacaatgacagaattttatatttatatttgttttatctttttcaatgcatggtcatcaatagggaaaaagtcacactaggagcgttgagccctgtgaggatatcacacctgaccctggaatggcagttgtgtaagggtaggaactttgttttgttcattgctgtatttctagttcctagaatagtgcccatcactcagaaaaacacgatgaatgaacatccaccacttaccacagtagctgaatgtagccatgcttttaactctctgctcgtctgttttcatttatagttgacttcaacaacagaggttttagaaaatttgagcagggagtaagactaacctatagtagttttacacagtgggttttggttaatgctcatgattaatttctcttcccaccatagaatggtcttacccaacatgctacagaattctagtttctgatatgtgaaaagttaatagacataagaaaggaaacactaacaagctgaaaaaaatcacctaaaattgtggcggttgtaaatctacttcttaaaattttgcacctcttgaatttttaaaatactgcctctacactcaaatttttctctggatctgtttcttaatattaaatgcatgtgtaaaaaaatctattttaacagcgaaagtgaaaagattgttttaaaattattcagtgttgccttcttaaggttttgactcttaattatcgttcatttgaaagacaagactatgtagaaagtattctgttgttcttttgaagttaaagtgtatctcagccaaaaaagtgctgctttagtccccagtacccctcaacattttaggaggcctggccagagcctcttagttttccctcatgaatttggttcagacttactagtttttgtagctggggttcttttattatataaacggtacaaattggtgtgcctctttgcccttgttgaagctgatgtgctaggtggcacatcgatgatcacataaacagttctgtgtaggtgctaaatatgtccattcctttttggccttcttagggcctctgtgcccttcgttttagtcattacctcattattttacagaaagggacttagagtatattgtgttaggtccccctctccagtgaaagctgcatgatgatatccaatactgtagtatttaataatttagtatatttttactccttcagggttatcttttacaatggacaaaatcctgtccatatgggacaatatgtgtaccaatatgtgatggtgaaagttttaccctcttatttcagataacttccagaaaggtgtatttatttatacccctcttggagatggaacctaacaaccctgcccacccctcttccctgtttgtctgttcgttagtgcttaatgtgtttaagcatcccttgttatttttaggtaattgcttagatttaatgcaaccacattacattctgctacctctactaatacgtgaatgttcaaggttacccaaacataactactcttattccttaaggtatatacatgactggtatcatgggaaggtaccttatggtaccagagagcttctttcagactcacctctacttggccctttttttttctttcaaatgagtctttttttttttttttttttttttttgtctcttaaatttaaaagagacgaggtctcactgtcatccaggctgagagtacagcattgtaatcatagctcgctgcaacctcggactcctgggctcaagcaaccctcctgcctcagcctcccgagtacctgggactacaaatgtgtgccaccatggctggctaattaaaaaattttattttattttatttttattttttgtagagatgggggtatttctttgttgtataggctggtctcaagcagtcctcccacttcggcctcccagagtgctaagattataggcatgagccaccacgccctgtctacatggcccttatctgacaaatagtcctaagaggcatgagcagtttttaatttgctcgcaatgtttcacaatgacacactgtttctaaccaagcagatgtttgactgtggttactgggaagaatagtctttgccagcattaagcccacctactcgaaccttttctgttgaatctctcgtttggtccatctcttggaagttaatcagcacctgtggaaactttacacaaacacttctgtattactgaagatacctcatctttttgacagaataaattatcacgtgatttttagaacatgtcagatagcttttacagcagatatagtgattttcctgaattaaatctagcaccatcaattcattcttgcccttcgacttgacctgtctcttgaaccatttctcccccaatttacctgttggacgtacatctacttgggaggtcactgttaaagccagcatatcatagctcgataacttcattgggatctacccttcatttcttaatgataatatcctttttctagttaccataagccttaaaatttttcagttatttttaacaacttgctctgcttcctttttttccattattttgttggttgttgttgttcttgtgacaatctagggtcttactttgttggccaggctggagtgcagtggcaccattgtggctcactgcagccttgacctcccgggcccaagccatcctcccatctcagccttctgagtagctaggaccacaggtgtgtactgctatgcccagctttttaaatttttatagagatgaggtcttcccatgttgcctggactggtcttgagctcctggctccagtgatcctcctgcctcagcctcccaaagtgttgggattagaggtatgagtcattgcacccggccagacataatttttaaaaagcaatataatgtccttgctctaataaaaaggaaaaataaaaaggaaaataatttgtaatagtatatatttcatgcaaatactcaggtagaattatactcttgcaggaaaaggttctacagatttacaaatccctcaactttcctgctgtactatgttgtatttaatacttagttaagcaacttaatagcaagactggtcttcatactaaatacttaatagcaagactggtcttcatactaaatacagttcgtctctgaagttgcaaattatgagtagctattttcattgtcatatagtgtgtgtgaataatatggcctgagttataaaacataaaagttattggggagacaaaaatattatgtttaaaatggttaagacacttcattgttgcatatttagctttcctttatggttcttagttaataatgtaccatattttactgactttttttttcttttcttttttgagatggaatctcacactgtcgccaaggctggagcgcagtggcgcaatctcagctcactgcaacctccacctcccgggtttgagtgattcttgtgcctcagcctcctgagtagctgggactacaggtgtgccccaccacacccagctaatttttgtatttttagtagagctggggtttcgctgtgttggccaggctggtcttgaactcttgacctcaggtgatccacccaccttggcctcccaaagtgctgggattacaggcatgagccaccgcgcctggccttgacttcttaatttcagagttttgatattctgagcaatcttgttcatttatgtgactccatgtcatttaaacagctcaaatggatgagtcgtgtttgcacaactttagagaaattgtcacaaaggaacaggtcggttagatgttttgtctctgtaaagttcagattgttgcctactggtgacaagaattctttgtttttgttttgtttttttgagacagagtctcactttattgcccaggctggagtgcagtggcgtgatctcggctcactgaaacctccacgtctcgtgttcaagtaattgtcctgcctcagcctcctgaatagctgggatcacaggcgcatgccaccacacccagctaatttttgtatttttagtagagacggggttttgccatgttcaccaggctggtctctaactcctgacctcaagtgatccgcctgccttggcctcccaaagtgctgggattacaggtgtgagctaccgtgcctggctgaattctttgtttttctaccatattctccttaccctttttcttaaacaaaaggtcagatcccttgatagaagccaattatgtgtacaaaacaccttaaaataagtccaagcctggagtgtctgtgatctttttagttttgtaaagtacctgttcctgtattggcaacgatttacccaagaagccaccagaaatgatgcttgcttgactgagaaaaacttaaataagcctctctgtggggtttgaaaagctctgttctctacagttctgcaatttctgaaggcatgctaaggcttgactgggtctgttctgtgcagttataaacattctaaaatctgtggttgactaaatactccatgttgcaccaatttaaaaatctcattgtcatagcattatgactggtagagaaaggtcttgtggggagatctaagtggcttaacttgattcttaggatatttgtcattataaaataactgttttttcttttgcagacttccttgtgaaacctcctagtagaaaaagttcttgggacaaacttcatttggtaagtttgtttctcccctcctgccacccccgcccccctccaatactctctctgtgctgtttcgaggcaaggaaaaattaatttacaggttgatttttggggatctgtttgtcaatgtccatgattatttagatgagtttttctatgttcactttaatgtccttacatgtgattatttttttttttcactaggactcataccaggtcactttttctatatataattgcactgtaatagtgtactggaaaacttgtatttaagttgagattttgagttgcagcactaatcatttgtctaaaataaatagatttatcaatctccagttgtatttatttatttatttatttatttatttatttatttatttattgatatattttttgagacagtcttgctgtgtttcccaggctggagtacagttaggtgattatagctcactgcagccttgaacccctgggctacagcaatcctcctgcctccgcctcccagttgctgggactacaggtgtgtgccatcaggcctggctagtttggaaactttttttgtagagacaggatctcgttctgttgcccaggctgatatagttcttttaaattcaaacttgcttcttgttttgagttttcttaaattggtatatatctatatgaaaaataagacctcttattactagagttagttcagcagttcccccttaccttcttttgctttccaaggttcagttatccaaggtccaaaagtactaaaatatcaagagagcaagaaagagagacactacacattcatatgactttcattatagtgtattgttgcttgttctattttgttattagttgttgttaatctgtcactgtttctaatttataaagtaaacttaatcataggtacatacgtagaggaaaaactatatatatatatatgtatgtagttttcagtactacctgtagtttcagggatccacagggggtcttggaacatattccccgaggataaggcaggggattactgtagtgcaaatatgaattttaatgagaaaaacaagttctgaaaaatttgcgagttctttctccagtgtggctactaaaccttgtcctttttcaaaaaatgtccttttcatagacctttgtgtgtctcttactaggtaaatctttattagtgcctcttgtttctgccacctgtttagggaactgtagtacagttttattagaagacaagttattgccttggttttaagttcctaaatccagatcatttccttgttcaggaactgttgccttgctattgcctctagaacaaggatcaaactccttagcataacatttcaggttctttacaggtaggcttcaaacagcttgtcacctgttttctctgtgtaccaagttcatctcttgtagccacaccgacctacctcctgtctctcaaatactctccaaggtgcttttttgtcttactctgccgccatgccattcctgctcccctcttgtctcagtggctcaaaatttggctggttcagttattaaaagcttgagtcttccagaaagtcttccttaagtgcccagctcagaatctctttctctgctttttgcattaccatggaattaaatttctgtatctcttaacatactcttgtcttattagttatatttgttggtcacccccacaggattgggaatgcccttgaaggcaagaactatattgatatttgaattgtcagttcacagaaacactcctagactcctgggataccaatgccttctcagtataaattcttcttgactagggtttttgttttggtaagaataggggaggagaatagattggttttagtagagattggtcagcatagtcttgttgatttaggttactgttttttccccacttttctgtatagtggaggatcatagggtatatataatctgtgcccttgtagtccaagttgctccgtgtattacttgaggtattctttgcaagtataagttttagtttttgataaggaattgagtaatttctctttaacaggtgcctgaaagatgagattccatgttcagtaggaagattaaatgttggtttgcttctgtaaagatttctgagaagtcatatcatggggtggtactgatgatggagctgagagaagcatgcaggttccagctgtcaaattctcatatattaaggaaagaaaggttatttcaccttcaggcttggaataggaatcttaatcttcatttagccaggggggtgggggagtgttgcagattagatctgtagtgaaggaaatgtaatcctttttattttatttacgtatttatttttgagacagagtcttgttctgtcacccaggctggagtgtggtggcgcgacctcggctcactgcagcctccacctgctgggttcaagcaattctcctgcctcagcttcctgagtagctgggattacaggcatgctccaccactcctggctaatttttgtgtttttagtagagacggggtttcactatgttggccaggctggtctcgaactcctgatttccagtgatccatctgtctcagactcccaaagtgctgggattacagatgtgtgccactgtgctggccagaaacgtagtaacatattacttggctctgtagcatttaatatttgtattgccataataatgtaaatttgtaaaagtgttaatttttttttttttttttttgacacaaggtctcactcttgcccatgttggaatgcagtggtgtgatcatgggtcactgcagcctcgatctcctgggctcaagtgatcctcccacctcagcctcctgagtaggtgggactatgggcatgtaccaccttgctaggctaatttgtttttatttttatttttgtggagactagggtctcattatgttgctcagggtggtcttgaactcctgggcccaagtgatcctcctgcctcagcctctcatagtgttggtcttacaggtgtgagccactgcccctggccacgttcttatctgaagaagcatgatctaggtttgaagagaaagatgtaaatgtatttaattttgatgccaggaaacatactgtttaattaatatgtgccccagattaaaggagactaaagagatataaaaatagcttcaatatatgatcccagactagatcctttaccaaaggggggaatattgctgtgaaggataaaggatatgattggattcattgacaaaattggaatagatatggtagattattatatcagtgttaaattttctgaaattgaaactagaactgtggttatatgagagattatctttcttaggaaatacatactgaagtagtaagaattaaagagatatttgtatgcaagcctcttttaaatggttcaaaaaaaatgcacgtgcatatgcgcgaacaaaaaaggagacagtgttggaaactgtcctatccaaattctctgtaatgaaacatttaatgaagtacagtctttatataaccatgtgttgtcatatgtatgtacatgtacatactaatttaaaaagtgcttattacatgccagtaactattctaagcatgttatatgcattatatcttaattctcacaattctttgatgcaatgattgttctccttgttttctcgatgaagaaactgaggctcagagaggtagtatgatttgctctcaaggtcatagagttagtatatggcagccctgagggccattgctttacattcctgattgttttttcttgaggctattatcttaacactctgagtttaaatgaaaacctttcattaaaacttattttgagttttctgtttaaaagctttttttgtagaaaaatttgttatcctaattgcaaatgttttaaaagtttaaaaactgaaagttgctgctcccactctcttccctaggaaggtagattgttaaccattatatagttttttgtgtatgtataaacatactttggaattaatacagacaatgcttaggcatatttttattttaacttttaaaattacagaacattgaaaacttatggcaagttgataaatatgtgttgtgttttttttaaatagaagagtatgtagtctttggcaataataacccctctgcaacccttcccccaaatttatatgcttttacctagtatattcatttttaagaataattagggctacagaaatagcgacttgtgcatagatatggataagggtggttgttgcggcttttttggtggcaatggaaaaatggaaacaacctaaatgtctcactaattgatggatggttaagttatgatacattggggtataatggaatactgaactgccatatgtatatactgacataggagggatttgttatattaattaaagaatatatactgaagaaactacagtatggctaccccaccccacccattttgggggtagataatgtgtgtctttgtacactcatgtgccacataatgatgttttggttagcaacagacccaagatacgatggtagcctcatgagattaaaatggaactgaaaaataactatcacctagtggagttgtagttgtcataatgtcttggtacaattactttttaaaaataaacttagtgtagcctagttgtatagtgtttataaagtctgtagaagtgtacagtaatgtcctaggccttcacacattcactcactactcactgacatacccagagcaacttccagtcctacaagcaccattcatggtaagtgttgtcctatacaagtgtaccattttaatcttttgtatcatttttactgtatcttctctgtttatgtatgtttagatatacaaatagggagcactgtgttacagttacctacagtattcagtacagtaacatgctgtgcaggtttgtagcctaggaacaacaggctataccatatagcctaggtgtgtagtagactgtcccatctaggtttgtataaatacctctgtgatgtttgcacaacagctaaatctgctaatgatgcatttctcaaaacatgtctccattgttaagcgaagcttgactgtatgtgcatagagaactgtctggatagacttatgaaatagttaacagttgctatatttacatgtagatgaactaaagggcagtaaggagtgaaaagcgaacttctgcttaccaattttttttaaataagtttaactcagatatattaataacataaaattcacatactatacaattcacccatttaaagtgtacagttcagtggctcagtatattcacgaagttgtgtagccatcaccacagtccattttaggaccttttcctcacctcagaaacttcaggccaggtgtggtggctaatgactgtaatcccagcagtttgggaggccaaggtgagaggattgtttgaggttgggaatttgagaccagcctggacaacatggtgtgagcctccccttttccccccacaaaaataaaaatagccgggtgtggtggcttgcacctgtggtcctggctactctggaggctgaggcaggaagatcgctggagcccaggaggttgaggccgccgtgaaccatgatcctgtgattacagcactgcaactccagcctgggcagcagagcaagaccctgtctccaaaacaaaacagaacttcatagctgtcaacctctcttaccgtcggtctttcccagctcctggcacccactaatctgctttctaagattttcctgttctggacatttcatataaatgatatcataacaatatgtggtcttttgtgactcgcttcatcatttagcataatgtttttaaggttcattcacgttgaagcatgtatcagtacttcattcctttctctcttttttcttttttttttttttttgagacagggtctcactctgttgcctaggcttctggtgtgccgtggcatgaagatctgggctcactgaaacctcgccactgcatcctgggctcaagtgatcctcccactttcagcctcccgagtagctgggactacaggcacatgccagcacgtccagctagtttttgtattttttatctttttttcttttattattattttatagagatggtgttttgccatgttgcccgggctggtcccgaactcctggccttgagtgatccacctccctggacttcccaaagtgctgggattacaggcatgagccaccatgcctggctcaatttttgtgttttttgtagaggtggggtttcaccatattgcccaggctggtctcaaacacctgggtaaaagcagtgtgctgactacatcttttcaaagtgttgggattataggcatgagccactgtgtctggccacttaattcctttttttttttttttttgagatgagtcttgctctgtcaccaggctggagggcaatggtgcgatctcggctcactgcaacctctgtctctcgggttcaagtgattctcctgcgtcagcctcccaagtagctgggactataggcatgcactgccatgcccagctaatttttgtacttttagtagagatggggtttcaccgttggccgggatggtctcgatctcttgaccttgtgatctgccctcttcagcctcccaaaatgctgggattacaggtgtgagccactgtgcccagcccacttaattcctttctatggccaaataatttgccattgtttagatatgccacattctgtttattcatccatctgttgatggacatttggtttcagtgagcctagatcttcacgccactgcacaccagtagcctgggtgagagtgagaccctgtagtggaaaaaaaaaaaaagaggaatgaagtactaatacgtgcttcaaaatagcccatcccacctttgggctactttgaataaatctgctataaacatgtatttgcaagattttacatggacatgtttttgttttcttggatatatacctaggagtaagattgttgagtcaaatggtaactctgtgtttaattgagcaactgccaggctatttttcaaagaggctgcactattttacattctcactagcagagtatgaggttacttgtttactttttacatctgtatcttatttactgagtgcatgcattactcgtatatctaattttaagaagtattacactgcttatcagactaacagtaatgactcaatttcttccttttgtactgttggtataactaccactgtggggttcacattttacaagtcaggtgctgtaatgaaccctgaatatttcctaaggattggtcacatctgcgatttgtagtgttttttgtttgtttgtttgtttgttattttacataatacccagagtggtctaatgctctttctagttttaaaaggaacctttagcaagtacttgattctgatgggttgcacagtttcctgtgatcttggctttttcttatggatttggaattcctatagcagttttaacttttctcagatacttaaagcagcacctcttactttgaactattttaactatttcttgtctcctctggactgtaagttctttaatctccctttgctgccacatctaggcctctacctaaacctgtgagttacacaccaggatatctttcacatacttaggcttttatccgtactgcctccattctaaatcaagccactagtctcttactgtaattgtctcctggttctcttctttattctttttctcttttaatccattcaccccacatcaaccagggtgatcttaaaatcaaatcacgtcactctgctatttaaaacctgtcaatggctccctgttgtatttggactgtattttaaacttactactattcacatgatcttttcctttacatttctccaacttcaagttgtgccactcttctttctgattcggtacagtttagctacaatggtttcctccttttagttcttcaaaattatcaaggtctttcctgtctgaggaacacatgcacttccgtatattagaaactggccttgccccaccaagtagtcttttctgatcactttatctaaagtaggtcttcggtacccccaaaccccagtccctgtctcagcatcccgtttgtttcctttatcacatttagcacaatttgtaattattaccatctttttctgtcttctgcgatggtatataagttgtattaatgcagagctaacagtgtcatactgtctaacacatactagattattggtaaattttgactgactgcagtgcagaaagaacatcattttacagaatctatttggtatagaaatggaaggccttatttctgggtgaagactatgtttaaattgagacttttaatgccgagtggcaaatctttgtcttggtatttctgtactcattaaaaaattagagtaggccaggtgtggtggctcacacactttgggaggccaaggcaggcagatcacttgaggccagaaatttgagaccagcctgatcaacatggtgaaaccctgtctctactaaaaatacaaaaattagccaggcatggtggcatatgcctgtaatcccagctacttgagaggctgagacaccagaatcacttgaatccgggaggcagaggttgcagtgagctgagatcgcaccactgcactccagcctgagcgatagagcgagactctgtctcaaaaacaaaacaaaacaaaacaaattagatttgactgggaagatagcttatgtatatatatataatgtgactgcagattgagagtttattttgtaattggaatttgatttctagttcagtgtcactacagatgagtacattttagttgggacatccgggatgcttgtgagagttttttcagatttctctgaaaaaaatctgaaagacataacagtgcatattgataggcttactgtataaacagtggtttcatgagagataaaactttgactctttaaattaattcttcaataactggaggttttgaggtagaattgccattatggttaaaaaaactttatgtgaaaatttcaaatatataaaagtagagaaaatagtttaataaatctccattaacttatctcactggtcttcaaaagttaccaactcatgacccatcttgtttcagaggtactcctactcattctgcctactccttggtatataactttatgtattttatagttaaaagataaattctttttaaaaacccatcaccacacacaaaaacctataaccacagtaacattgtcaattatatagaaaattaataactccttaatatcatcagatatttagtatgtggtcagatttccctaatagatgtctcagcttatactttgaataagaatccaaataagatctatatattgcagttggttgacatggtcacttaagtctctcttaattctgtaggtttcccttctatgtcggtcttttgtcttgctatttaaagaataggggttattttcctgtagttttccatagactagattattatttgcatcttgtatttcattagcagttgtaaaatagtattatcaaattcttttctttgtatattaggtagaattcttccctcatcaactacttcattctatactagttcattttgtgtaagaaaggcgggatagatacttgattctttccccttacttgctagttttcaaaaataaaaggttagttccttaacatcttccactggtgacctgtaggggtgtgcgtgtgtgtgtgtgtgtgtgtgtgtgtgtgtgtgtgtctgtctctgtgtgtgtgtgagagagagaatgtttctttatgaactcatatttaaacatcctgaaacccaatccattgcatttaaccattttgctcaaattatttcatttttagctagtgagtctcttcaaattgactcccaattatttctgacttaccctcagtagtcttttatatgtttcttacattccagtttaatatgatgtttcagaatcaaattgtacattttcttttctagacctggaattggttatattttctttcaggtgccccatcttcttttgaagtgggaattagtctttagggaccacagtctaggggcttagaatgctcattgctgctgggttgatactgtaacttttttgcagcgtttatttttatcttatgaagagtttgattatattgttactcttcacctctgttgtgtgtgtgtgtgtgtgtgtgtgtgtgtgtgcatgcgcgcgcgcgcgcatgttttttagagacaaggtcttgctctgtcactcaggctggagtgcagtagcataagctcactgcagccttgaactcctgagctcaagggatccttccacatcagcctcccaagtggctaggactacaggtgtgcacaaccacctaattttttttttttttcagtagagacagtcttgctatgttgcccaggctggcgttgaactctggggctcaagctgtcttcctgtcctggcctcccaaattgctaggattataagagtgagccactgcacatggcttctgtatttttttttttttgagctataagtcatatcacataaaatccacccttttaaagtatacaattcagtggtttttagtatagtcataaagctgtagaaccattaccattacctaattccaaacatttcatcaccctgcaaaggtaccttgtacccattagcagtcactccctattcttccctcaacctggctcctggcaaccactaatctactttctgtctctgtggatttaccttttctggacatctcatacaaatggaatcacacaatatatggccttttgtgccccaggttctctcatttagcataatgttttcatctatgtgtgtcatgtatcagtattttattccattttattgctggataactccattatatatactgtgtgtgtgtgtgtgtgtgtgtgtgtgtgtgtattttttgtttgtttatccattcacattttgtttgtccattcattgattgatgcatatttgggttgtttgcacttttggccatcatgaataatgctgttacgaaaatttgtgtagaagtttttatgtggacataccttgtcagttctcttaggtatatacccaggagtggaactgatgggacatatgatgactctaaacttttttgggaactgccacacttttcctcagaggttgtaccactttacattcctgccggcagtgtatgggggtttcaccttcacattccatctacatctgacattagtatcttcctcactggagttatattttgttatttaatagttttgcaaaatgcattaaattcacttccatttaaattgtttaagatacagcagtttgaatgtgtcaatgatgctatctttagaaattttattctaaaacacaaatatcttttgtgtaatattaggacagttttttaaaagtaattcagtatgtttcttttttgaaaaggttctttataacagtatcccgttcttttaataagttcataccctcaaattttctctgcctttgcccttctcctttttaattccaataagtgcctttttgcacatctttaccttcctatctaaagtagcatttctgttacaccatcaccaaactctgcttaattttctttgcagcagttgcctactgcttaacattagttatctgtttctttgtttctaatgagaaagaccaacaataaaatcaagttccatgaatttctgttcacagtggtgtccccaaagtctacaacagtgcatggagtgtagaaaatattgaataaatatttattgaaaagaatgaataaatgagataattttacattagtttcagttcttgagctaggccaaatcacaaaagtttggcttggtttgaagagtggttaagaatgatgactccaacttggtctgttactgaaccataaggttcttcctcatccttccagcctctaaaaaatggtgcacccaaaacccctgtccttagtcatcttagcctctccatttatacttgctcctgcatttggctttaatgccattcacacactgatgtctcccacatttatgtttatatctctaggctccatcttcttgatctctagtctggtttaactagcactttacttggcatctttgtttggatatgtgataggttttcaaacataatgtgtctaaaatggaaactttaatttcttgttccttgtccgttgagctgtctctgcatggcacgagaagaatagatttttcttacaatgctcttcatcaataaatagaaaatccttgcttccggttgctgacacaaaaagcttgacttctctttttctatcctatttaattaatccactcaaatcctatgggcagtattttcaaagtatatccagaatcagtaacatcccaccacttctatctctactaccttttcattgctatattgtctcttgctggggttaatgacgctttctaattggtcttcttttgccccttacccccagtagccttgactgttctctacccaacagccaaaatgattcttttttttgtttttttggtttttttttgagactgagtctcacactgtcacctgggctggatgtgcaatggcgtgatctcggctcactgcaacctctgcctcccaggttcacgttattctcctgtcttagcctcccgagtagctgggactacaggcacacacccccatgccctgctaattttttgtatttttagtagagatggggtttcactatgttggccaggctggtctcgaactcctgacctcgtgatctgcctgccttggcctcccagaatgctgggattacaggcgtgagccaccacacccggccaaaatgattctttagagtaagtcatctcctaccattcctctgctcaaaatgcctcaacacaatctgggccttgctactgcttttatgttctcttgttcccttgcttacattgcccttaaaagagttttatgctgcacattgaagcccagactccctgaaatatcctgtgttacagaagcttagcaaactagaaatgttggttttgcatgagactgttcaaagaaaagagcaacttacttactctttgtataagcctatttttgggtttctagttggatattctttcccccttttttgttcttataaaaccaggtaaaggtattagtacagattgtaagtttttagaagagcatagaatatttgggtaataaggcaaatttatttttcctattttgctcgtaagtcagtttggtttcctcagatgggggatccattttgaatttagagataaccacaaaaacatcctaaaatactacaagaataatgattttgcatttgcaggttgatgttatttatttttttgagacagagtcttgctctgttgcccagactagagtgcagtggtgtaatcacagcatactacagccccaaccttccaggctcagttgatcctcccacctcatcctcctgagtaactgggactacaggcatgtgctgccatgaccagcttttttttttttttttttttttttttttgagacagagtttcactctgttgcccaggctggtctcaaacttctgagctcaggctatctgcctcagccttcgaaagtgctgggattataggcattaagccaccttgcctggcctgtaggttgattttaattgttgctttattcatccaagttttatgatattttttgttttactacgaacattaggaatgttagcctttgatactgtttttgcagaaacaggttaagactaacaggagttttacaaaggaactgtcaaattgggatttgactagtgggaattggctgggtgataatcaactttttcttggctgactctgatcagcttcttaggcctgtgtatatacaatacctttgtgaggatatggccgattaggggaaaaactattgccaattttgcctcccctcctcttttttttttcttcttccccctcttcccccccacccccagacttcaccataagggaaagaagagagccttgttggacactgaagaagggacggggatttctcctcctaatctgggcctcttgtcatggtaagtacaaggaaataagagtaaaaaaaaaaacaaaaaaccctgtgtcctgacaattaagtgaacactaataaattcatacttacccatttttgtttttgtaagaaattatttctttttctttcccagatctcttgtgtcttttcttttcttgtttacttagtagtaatagagtactccaatatacagagcagtttcatttctgttaactttaatcctgtgagctagatgttgtctcttatttttcagtcagcaagtaaatggaatcaagactaaaacatacagttctcggactccaggtttttaattccttttctaggaagtagcgtgtagtgaaaactgtgtgtgtgtgtttgtgtgtagacaaattgtaagatggtaatctgcatatttacttaaaaatttttttaaattgacaaattacatatatattgtgtacagcataatgttttgaaatacatatataccttgtggaatggctaaatcaagctgattaacatatgtattacttcacatagtatatatgctttatgaatttatagaagcaattccctaccttccctgttttgtctctttaaggcagtattttgatcccatagtaggtggagcagccctgcacaccccctcctgtatctttaaccagaaagagaatttaatggacaatttaatgacttacgggccatttcgggcccagctcaagcagagaagatggagcaacaagccagccacattttcatcaatcctgaggaaatgtaaacagtgcttcaaggcttaaaaaagaaatggtcctctgtaatattgtccttcttctaccttgtgatgtttcctagatccaaactgttttatgctgatgcacagagaaggaattgaaaaggctacattaatttcaagcttcattagggacgtatggaaaatgcttttcaaaattagaaaaagtaaaacaaaaaaactagttgtgcagaaatgtcatattaaaaggaagagaaaggtaactgcccttatcttaaaggcatgccaattttttcttagtttgtgggcattacaactttatgatttatcttatacctaaacattgatgaacttttcctgttattttcttgattatattttattttattggttttcccacagagttttcaatgaattgaaaaagtgcttgtctagtatttcagccagtgctaatgaataacaaatgatgggcttatgaaagcagctctgttctgtattgagggtttgtccttcattgtataccacacggctagtaacagtgtggtcctcttcctggtgctgctgggttctccatggtgcctagcagaaagtcttcctggtgttttccctggcctgatgctttagacaacgcttgggagttgattctgtgtgtactagttggggagtagcatggccatgtatgtatcttttgtttttgtttagtttctcataaagtagcattgttacaagtttttacaaattctcatttataactctaccaccagaacccatggttgtattccgttttcttttttcttgagacagagtcttgctctgttgcccaggctggagtgcagtggtgcgatctcggctcactgcaacctccacctactgggttcaagcgattcttgtgcctcggcctctcaagtagctagaattacaggcacctgccaccatgcttagctaatttttgtattttcagtagagacggggtttcgccatgttggccaggctggtctcgaactcctgacctcaggtgatgtgcctgcctcagtctcccaaagtgctgggatcacaggcatgagctgctgtgccccattggttatattcctttctaactagttcatgtctcatatgtatgttttatatagttagaatgataaaataattaagtttctattttgcttatttcacttaatgaattaaacattctcccatgttgattccttggattcctaatgatcattttactagctgtataacattctgcaagttgttgaaccattgattttaattatatactgtataatagcatttagagtgtatgtccttaatccttagtttttgtgtagacaattcaggagcattgaacattctttttgtttttaactgtaaaccgctgtactaatttgagagtgacatttttcccttgtcttttatactcttaaaggttcttaaacgagattggagtctgtctttgagaggttaagcattagcaaaatatattttcatgttttgtggaaaatctcaagcctatgcagagagaaaagtacagtgcactcatatgaacatcattcagctgcagtaatcataaattcatgactattcttgtttcatttgacctcttttacccctacccttttggcaataatcccaagcattttatcaagggaaatgtattgtttgtcttctaataccagtcttacgaatatgactggaaatgacagtaggactgataattattttcacttctacgctttgcaaacacgaacactagatatgaattcagttagtaggattaattgactggtcatcagtctctccttcccatgtactttatttttttgaaatggagtttcactcttgttgcccaggctggaatgcaatggcgtgatcttggctcactgcaacctccgcctcctgggtacaagcgattctcctgcctcagcctcctgagtagctgagattacaggcgcttgccaccacgcccagctaatttttgtattttagtagggacgggatttcaccatgttggtcaggctggtctcgaactcctgacctcaggtgatccatctgcctcagcctcccaaagtgctgagattacaggcatgagtcaccgcacccggcccttcccatgtactttaaatatttatctctatggttgacttctgctctgaagcatgtactttcctctcttagctgcataatttagccaatagcagaaactagcctggaactgtggtgactggccctttttcagtattttgtagatgaccccactgactttatggaggtggatggagactacgaagtgccagatgccacaatgcctggtgttcctcagcagtaccaggaaattaatgacatggaatacatctctctaataagttactgcttatagctaggatacgtttgtttccaaaactgttaccagaccagcgtttcccaatttatcttcttccaacttctcaccttattaaccatctcaagtttggccttcctcacctatgaaactcacagaaactataataaattcaggctaattcaactgctaaattcaactgttcagccacatgggatcaccagtcccctagattcaatgaatcctaatgttacgtccttggggattaaatgcatttttgtgtacaaggggagaaaagttctgaagctttacaggtaatgtgaattgagacaatagcttttaaaaagaacatttgtttgattatgaaaaataagtacttcatattcttgccttgctggcctaattctcagttgttttatgttgaaaatcatgcattttcagttttcagtagctactttggtgatacatattggtctggattagcaccctggtgagtgtgccagcaagagtgagtaggtaaatggtttctttttgttctttacaagcctgctacattacttcagttctgtgctaaaagtcagcagaaaactaggtcaaggaatcacttaaagattaataatgggtacctctgtaaaatgaccttacacagaataaaagtctaggccttatgagtttatgtgaggtaaaaagttaatgtgatgctgagaagttatgttaaaagtatacttttatgtaagatttttgctcccctccatgtttacatagcatttccttactatcccatattggtttatgagaaaaatctccctaaattgaagattcttcacatctttcatttggtctctttttttggagacaggatctcactctgtcgcccgggttggagagcagtggtgcaatcatggctcacctttcatagattagcactaggagaatggttttaggaaaagcctggcttttggagtgaagcagctttaattggtatttagtattagagtatagtagagaagcagctctgatggtttccagacctctttttacttcttaaattattgaggtacccccaagagggtttgtttatgtgggttatgtctgtttataccatattagaaaataaaactgagaaatctttaaaatgctcataaattcatttaaaagtaacaacaaaccaattatatagtagcataaataacattttttgatgaaaaatatttttcctcatccaaagatagttttagtgttaacatttttgcaaatctctttaatatttggcttaatagatgacaggtaaattctcatatctacttcggcattcagtccgttacaatgttttctttgaaatatataaagaaaatgcagcctcaggcagatacgtggttagaaaagtagttaaaaaaaggaagagtattttaagttttcccagataatttatatttttctttaataccaaaccaaaacttgacaagtgatgtgtttttttgtttttgacacaaggtcttgctctattgcccaggcttgaccgtagtggcgcaatcacagctcactgtagccgctacagtgcacctcaggtgcaggtgatcctcccacctcagcctcttaagtatctgggactacaggcatgcgccactgtgcccatctagtttctctattttttgtagagatggtgtctcaccatgttgcccaggctgggcttgaactcctgggctcaagcgatctgcccactgtagccccccaaagtgctgagattacaggcatgagccgtgtacctggccagtggtggttctttaaaggttagttgcagtgtagaatctgaaaccatatcagtgaactttttgtattatattacattaaaaccattagtctgtcttgtactttgagtgaatcttttatccacatatgattttgtaacatgcattggtcattaggaaaataatgggttcgttgattgaggcagatcttcaaaagttgacattttattatagtgtgtgttttttttttttttttaaatcacacttggtaataccttcactttaaagataaaagttgtaagtactaggaagctataaagttcatggtgggagatgagaggttttccaaaatctaatctttgcacaaaagctttattattgacaactaatactatcttttgttgttactgtttgtttttttcctaatagtgtcttttggaaaaaagacctgccaaatgtccaagtctgcattaccatagtttttccatcagttgttcttccaattaagaatgatactcaatgaaaaaaaatggctagttcatctcttaattgaagcatttgcacaagtgctttactttgtgacaccgtaatattgcaccatacatcagaggtgttttacttgtatttcctctgtaaaaaagacttctacttaagggtcaggatttaataaatagaatttataatatttccttgctttatcaaggtcattcttatgaaattggcaccactgtctcaattgtgctaaggtaccagcagttttacctaccaggtttttttgcactattagtatagatgtcaatacagtgaagaaaggcaataataccgtaatattattgggaaggttttgacctcgcagggcccctgtaagcatctcagagtctgtggacttcattttgagaatcatgctagtgtagagtattaccagtttatgattatggttgctgttagtaaaaccttaagtgttgtttatagataagaagaaaaactctttttgggggaagacttacaaaattattggaattgtgttaagtagtgtacacagaagcaaccagtaaccactggttataattcttaatgctgtcagttgaacatgatgtggcttttgctcttttaaaaattgctgtgtggggccagtcttggtggctcacacctgtaatcccagaactttgggaggctaaggtgggaggattacttgagcccaggagtttgaaaccaacctggacaacataacgagaccttgtctctactgaaaataaaaaaaattagcctggcatggtggtgggcgcctgtggtcccagctacctgggaggctgaggctggaggatcacttgagccccggagttggaggttacaattagctgtgattgtgctgctgcactccaacatgggtgacagagcaaaaccctgacttaaaaaagaaaagtgctgtgtaaacagattctattataatttagtcaggctttgtgatagatgacatttctctcatgtcttcctataccataaaaattcataatgcaaaatattactttttaatacaaattgtaatttacatgtcatctagatgagaatttattgcttcctcttttgaaattgtcttaacagaaatctattttgtaatataaggcagagtaaatgaaggatagtctttcatatattttcaacttgggaaattcagttcttaagcttactttttcttagaaattgttttcaagctttctattatgaaaatttcacatataaccagagtagacacaatggtagagataatgaactctcacccagtttcatgaattactaattcatagatagtcctgtttcacttatgtcccgcttcttccttactcttgccccagttattttgaagcaaatttcaaatgtcacctttcatttttaaatatttcagtatgtatctctcaaataatttaagatcgtaacttaaagagaaaaaagcattatatcttggtttctcttaaaagtagtgtggggctgggcacagtggctcatgtctgttatcgcagcactttgggaggctgaggcagctggatcacctgaggccaggagttggagaccagcctgaccaacatggcaaaaccccgtctctacaaaaatagtagccaggcgttatggcacgcacctgtagtcccagctactcaggaggctgaggcaggagaatcgcctgaacccaggaggcagaggttgcggcgagccaagattacaccaccgcactacctgtgcactacactaccagtgcaccactgcctgggtgatagtgagattctgtctcaaaaaaagaaaaaaaagtattaagaagctgttagtgcctaatagaaatattctaacctctttgacattttttttgcatcaatgtgttttcagactagatgtaactaatgtattggatagaaaaactttttaagatcaatattgtttccttgagcttttctgcctgttcaccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggtaattataggccacttttaaatgtaaaatatttatttagcattaactgtatagcagagttaatggatttaagtgtaacgtactatattatatatatatataacatacatgtagtagaaatgcaagctggaaaacatctcattttagcaagacttatttcctgagaatccactgtttaagatgatcttctctgtatcattcctttagtagttcagaatttgaataactagatatatttgaattaggtgggtataaacccatcctctttagcttccttatctacttatgtgctgtgttttcaacttcagtggcagaggatttaccatccattcagccaactgatgtttgaagcttttttttttttaactgcttcagaactctgaagggtttctttcatttcgaaggttcctttccttgaacttcatggagagagcacagagtttgtgggccgtgccgaggatgccatcattgccctttccaattacagacttcacatcaagttcaaggagtctcttgttaatgtaagtgattaccagctgttctccctctaaggtaaatggagaaagtaagtcaaaaaacttaatgctctcaaagagaggagaggcatacagaattgggagagaaagcattatgtgctctgcttttctcacttaatttagcactcaaggaacactggcttggccaggcgcggtggctcacgcctgtaatcccagcactttgggaggccaaggcaggcagatcacgaggtcaggagatcgagaccatcctggctaacacggtgaaaccccatttctactaaaaatacaaaaaattagccgggcgtggtggcaggtgcctgtagtcccagctactcaggaggctgagtcaggagaatggcatgaacccgggaggtggagctggcagtgagccaagatcacgccactgcactccagcctgggtgaccagagcaagactccatctcaaaaacaaacaaacaacaacaacaaaacacactagatcagcaagcagctcttatgcttgatttaaaatgatgtgtgtagttgtcagctgaggtgtccattgtttagtttaacagtgaatgatttgcattaggtaatgctgtatcattaagctttataaaggtataaaggctgaatgggcttttattctgcaatctttagtagttaccaactgcctcagttgagataattcccttggccttaatgtcaaaagatgagatgcactttgagctcactgcagactctcattacagcatgaggttactctaatgactccttggtggtataagtgtagatgttaagtataatgttgatttgcataatggactatgtattactgaagaaaaggaagcctcttgattctcaagagtacatttacccttttcagttatgaatgtcctctcagtgaactggttcttccagtgctctgctatcattagccttaaatgaaacgaataaaggcttgaaaattcatgtacttacagcaaatgccttcttccttctttacttgccagtgttgtggctttctacactccacttccagcacagagaagtgtattatgacacgttaaaacagctcaggactgtaattccatgcagactgtgttttggcttcattttgggattctttgaaatcttgttcattcgttttactcagcaattaaaaaaagactcagtggctgtcattttttttttggtagttgacattttttacttcttattatcattcttctttgtagttaagcatttatgtccaggagcagttttggcctgaatcccttctggcttctagatttgggccatgattatagcagttacatcagttttctgtctatcagctaaagatacacaccagattcattaaggaaagaggcaatgctgttctttcatactatgtagcactctgttcagaagggtccacttggatttgagtagtcgtgatggggaggggaaaggggggaaacacctataaaatcccagcaactgagaattccccaccagctactgtggaagtaatgatagtagtgtttagtagaactgcccaatttaactttgtgttctttcagtgtttgaattgctggaattaaattataattaaattgcatgtgagaatgatagtttcatatcattgcattttctcatatcatcctgtatttatcagtttattggttgatggccaagtgtttcagagactattttagaactatttgggaataaggtctgctggaaagcaagcaggaaagaaagaaagaaagaaactgatcatgtcattcatcagcttaaagcccttcagtgtttcttcactacttctatgatgaagatcagattgtttagcatgacatgaagctgtctgacaacgtggcagggaccaaggatcacagcttccctcctttccccattatcacatttttacttgtaaaagcagcctctttgtactattcagccatacctcacacctctgtgttctcttttcggcccaggaacttctgttcatctgtcaaaattcagttcaggtgataacttctcctgtgaagcctttcttagtcccagttccctctgtgacagttaactacactctttctttgctttgtctttatcttgtacattcttttataacatttaccaaataggttgtaatttttggttaattgtttttgtgtcttcaagatccagcatgtctcctggtgccacaatattcagtaaatattaaatgaattgaagttaatgtgggtttgaagtgggcattagaaccttttccccctttggtgtttaaagctcattttaaaacagtacacttctgtgtgaataggctgtggcttaattgtctctaaggatagctgtgtgagtaggttgttgactggaattgttgatcccccattgtgattgagagataatgcttaaggaaacttgccactgttctttcttttgatcaattttcttaatctgaaagtgttttttttctgttagcatcataaccctctaaggcatagagcctacatgttacttaaaaagcccagggtaggccgggtgcagtgatgcacgcctgtaatctcagcactttgggaggctgaggcaggcagttcacctgaggttgtgagttcgaaaccagcctggccaaaatggtgaaaccccatctctactaaaaatacagaaattagctgggcatggtggcatgtgctactcaggaagctgaggtaggagaatcacttgaacccaggaggcggaggttgcaatgagctgagatcacgccactgcactccagcctggatgacagagggagactctgtcaaaaaaaaaaaggaaaaaaaaaaaaacacccaaggtaatggctttgtacagaaaaatgatggtgtaaaagtattttggcattgcagtgactttaaaaatttcagattgaggccgggcgcggtggctcacgcctgtaatcccagcactttgggaggccgaggcaggaggatcacgaggtcaggagagcaagaccatcctggctaacacggtgaaaccccgtctctaccaaaaatacaaaaaattagccggacgtggtggcaggcacctgtagtcccagctactcaggaggctgagtcaggagaatggcgtgaacccgggaggtggagcttgcagtgagccgagatcgtgccattgcactccagcctgggtgacagagcgagactctgtctcattaaaaaaaaaaaaaaaaaaaaaaaaaaaaaatttcagattgagagagactagaactcctccataaaaataaattaatttcatcacagctagtgctaagagattcctgaaacctgaaacctggaggtacttaggaaacaaggattcttcctgcatcgggtcctggatggagatcagacagttggtagtggtgttgcccctccctctttccttcccttagcaaataagtatttcaataaaatatgtgtatttcaataaaatgttagatcaggaggctctctttaaatgttattttatctatatcaaacacatttaaaccatcaaagcccagacataccagcatatgttgtggcatgccccagttcatcattttgtatgcttaaatcaaaatacttagcacttcagaaaatgatttaccatcaagttttaaatagctacctgatatcatatattctcttttaatttcacagcacattgagtaaaatgtgtctgtaggttttgataccgtaaacatcattactttaattcacacattcactgaatatcaagttccagttcctgtggtaaagaatctctgtagtagagtttatgtgtagcatttaaggtatacattgctcctattctgtgcttttcccaaattattatatatttacagacatagttctttgaagcttagataaattataaacaagtgttcaagtggaattcatgaacgtttaaaagtttgtttgtgtgtgtgtgtgtgtgtgtgtgtgtgtgtgtgtgtgtgtgtatgtgtttgtaatttaatagactgcttctcaatctgctgcttctaaaatccctgtaagtagtatgaaaatcctaggcggttgctgcacctgtgcttggagcaaattggttttgagtgttagatgctcaccttgcaaatcagcagaatgtttcccctctgcatgagtccttttcctcttactggaccaaattccagttgtatgctactaggagaacaatttgtagggtaaggaaaaagccctgcagtttatacataagcagatggaattgtgaccttcaaaaaaatgtagaacaagtttctgttagaaataatttgtaaaatcaacactagtttttttttctttcactttgttttttggagacggagtttcactctgttgtccaggctggagtgcgttagcacagtctcggctcactgcagccttagtctcctgggctcaagttattctcccacctcagcctcccaaagtgttggaactacaggcgttagccaccacaccctgctgcgaaggaggttattgttaacatttaatgcactttgatctagcattcatataacagtgggagcctctgaaagcagtgctggaggcttgtaaattgtcaaaggtgaacaatagagtttgaatcttaaaccagtgacagtcttctgctgattagtgggtttttggtggttgttttttgaaacagggtcttgctctgtcgcccaggctggagtgcactggcgccatcatggcccactgcagcctcaacttcctgcgcttaggtgatcctcccacctcagccttctgagtagctaggtctacagacacatgccaccgcgttcagttaatttaattttattttttgtagagatgatgtctgtgttgcccaggttggtctcaaaactcctgggctcaagcagtgcacccactttggcctcccaaagtgctgggattacagatgtgagccactgcactcaattttttattttattttatttttattttattatatttattttatttttatgttatgttatgttattgtagtgacagggtttcaccatgttgcccaggctggtcttgaactcctgggctcaagcgatcctcctgcctcagcctaccaaagtgctgggtttatagatgtgagtcgtcgtgcccggccctgattagtttttaaatgaaaagatttttgtgcccagatattccactttattactgattttagatttagactcattatttttactcttttactgccattttaacttcacgtgtacaagattagtacttcccattcaggctataaaaagggtgtttgtttttaaaaaggtaggaattatcccactctagattctggtgtttaaaaataatgcacatgtatgcacacacacccagaatgaaatgaggtaaatatagtagggtatgatggcatcagttccctctggaatgtgacagtactgtggacataacctgtgcatgtctgtatgtctgttaaatttttaaactgctgctcttctgctttttttggattgatgctcttcagggtgttagtgtctataatgtaacttggctttttgaggaattggttgtagcactgaatgtgtttgatgcattgtttgagcatgagtttggtgaaatttatattaggaaaagcattgtaaggtgagattgcgttacctggcaggtggagagatagaggagagaggagcaaaaagaaaatgagttgctacaagacattgaatcagtacgtttgagaggatttgaaagtgagtttatcttgctactcttttacaaaaggaattgcatctgaggagttttgatttaaactctgttttcctcttgaagatccctggtggagaagctacttatttgtgaaagaaaaactaaagtagagctcatatggaagagaagcccacgtgtaggggcagaaagaaagacacaccgtgtatggtggaaggagcccaggctggaggacagacatggatcctggtcctgactttactactatattagcttatagtgtagtagtttaaccttcctgggctgtaaagtggactggctcttgaatctgtaatttgcttttgaggttgaatatagggtatctctagttatagaaatgttaagagattgttttcatatgtgaggaaatttgaacctaaagcagtgtagtgggccttaagaaaatagagaaacagtatgttttggatggaggtatgaacaggaaaagaaggtcaattctgccttttagaaaaggcaatctggactgggtgcagtggctcacacctgtaattccagcactttgggaggcctaggcgggtggatcacctgaggtcaggggttcgataccaacctggacaaatggcaaaaccccatctctactaaaaatacaaaaattagctgggcgtggtggctgggatcacaggtgcctgctactcaggaagctgaggcagggagaatagcttgaacctgggaggtggaggttgcagtgaaccaagatcgcgccattgcactccagcctgggcaacagaacgagactccatctcaaaagaaagaaagaaagaaagaaaaggcagtctgtgcaggaagtgctgaagggaaacactgcagtagaaaggagaagaaaagggagatatttgttataaaaatcaggtgtttctcttttgtatgtccctattcttgctgcgtattaagctttcctgcatgtgacagtctgcatgaatattaaaatctgctgttctccgtatctgtgacttgtaatacacatggttgattttggtgacttgctggtgtctgcaatctgatttcaatgcatagaaccaacattctaattcttttttcttcaatttaagatgttaaaatatagaaaaaaatatgtatatattgcctgaattttaggtagcaaatgttttgcatggtctgagataattttatgatattaaatttgggcacgggccattgggctctggtttagtaataaggatgtaaaacttacctgttctttgtagcaaagtagcaaaggctaatccatttcccccagcagctgctaagagcattagctggttttcatgtcttctgtccataaagaaagtcagttgcaggggacttgggatgcaggtgactgctgcaagagcagcctcttcttgtggatttgtaaagctcactctaatcctatcccagactcttcccaggccccatgactgagatttccttagttgtgaccaaggttcagaaagcagaggctgatggcacatgggaaggctggaggcttgcccaatgaagccagcaaaattttaattggtaacattttagaaaattgagattagaactcacggctcttaattgccagtctggcagccacattttggggggatatagtgagtaaggtagttagcaggagtatatacaaaataaaaagcagtaagtgtctgttacaggctacccagagaactggcctgagaacaaagcaaagttatcttctaatctgtcttcttaatctcaatatttcttctttatagttttatctctgataaattgtaggtttgtttgtttttttttttccttcttagatgcacaggtctcagaagaattcttagttgcatcagttgcagtttctcacagcaccttggggttaaggacgtaaataaaaacagaaggccaaaagctccttttgttctcagaacacaggcaagatttttcttttttcttttcttttttttttgtttttgagatggagttttgctcttgttgcccaggctggtgtgcaatgacacgatctcagcttaccgcagtctctgcctctgggattcaagcgattctcccgcctcagcctctggagtagctgggattacaggcatgcaccaaaattacaggcatgcaccaaatacaggcatgcaccaaatacaggcatgcaccaaaatacaggcatgcaccaaaattatccgcacctggataattttgtatttttagtagagatggggtttctccatgttggtcaggctggtctcaaactcctgacctcaggtgatccgcccacctcggcctcccaaaatgttggcattacaggcgtgagccaccgtatccggccaagatttcttagtctttttctgacccccagtcctattacatttgtaagggaatttttatagactgtagacttaaaagcaagaagactttagtcctaaggtagaaactcccagtcatttatctgagtaatattattttgctttcttctcttctttaacccctgctccagtttctgtttctttgtccagcactgggcttctttttgatccctgcatcctcattctgagagttctctgctgactggcagctctgtggtggggcagagtttgcaggaagcttgttcctgaaactggctcagctaacacgagggccagcctgtgcagacagtactcttgttcctgtctgcattggaggagactgtcctcctctttgcatactaaacacaagttgttggaatgctatttgcaactcccagagccacattttggctagacttgatacactgtaagaggcaaatggcccactcctttttcaaggagtaaaagtattcactattattttaccaggtttgccttgaaagcctagaaattgctttttgaagccaagggttgaattaggatgatttaagggataggaggaggatcctcatattatcctgaagatttggcaccctgtctagatgcttttgcttctatctgtctcccttctctctatctgctgttgtacataatcctgtgtccagtagagtctgtagaccagattggcaagggggaaccattccagcttgttcaaacctcaagccccatttggcaaacggggcttctaactgattttttgaagcaaatctgacatagttattatagctttagcatccttgatcactgtatggccttctccctcctttttgatacttttgggtctattctacttagtagagagcctggccagcagctattgccccattgtcttttctgtgcaatccacagtcagcttagaactctagtctttttcaggagcctcattggctgacactaagccataagcccactctgtcatttggggcaaacaatagtctcccactggcattctgatctgtagttcttttctataagcaagaaaagattactgttctggctcccttcagcttctatgtcattgcatcattgcaaatcatagtcagttatagcatctaaaagtagtactctgatcttgtgaattcggtgcctgagagatatattctccccttcttccaaaggtggtgccacctctttgttgccttcatgctatgacatgacttgagaccactgatttagagataaagggaagtcctaattcactttgtagtaaatcacttgagtactgttgatccagataagtttgcagttctatttttgttgctttcccttatagatctttttaattagtcttgttggacacattgaagaactccagggtcaatgcctttttgactaagaggacttcatttttttaaaattgcaggttccattacagcttatagaaagtgttgaatgccgagatatatttcagcttcatttgacttgcaaagactgcaaagttatcaggtatgtggtatggtatgtttgtgttgctgtttagtgtggaaaatattttttaaagaatgggtccattatttggtaacttagtaaaataccttttgatgattagcctcattaggaatattttctgagtagtttgtgcctgaaatattttatctgtaggatgtatactttgctatgttgaaagatgttttttttttttaatttggaaataattttaaatttacaaaagggcaaaaataaaaatactaaaaagaacatcagtacaccattcacccagattcacttgttaacattttaccatttgctttattatttgcagaggcgtgtgtgtatgtgtgtgtgtgtttcttttcctgaacagattgagagtaagttacgtaatcatggctcttaaccccaaaatactttagtgtgctttcctaagaatagggatattttcttacataaccataacattatcaattttcaattttacattgataatacttacatccagtctactatacatgttccaattttgtcagttcacctaatgacctattgatacttttttatagcattctccctcacctccatctcattcagtacaggatccagtctaggtcatatattgcatttagctgccatgactctgtagccttctttaatctggaacattttctttttgtttttgtttgtttgatttttgagacagagtcttgctctgttgcccaggctggagtgcagtagcacgatctcagcgcactgcaacttctgcctcctgggttcaagcgattctcctgcctcagcctcctgagtagctggggttacaggtgtgtgccaccacacccggctaattttttgtatttttagtagagatggggtttcaccatgttggtcaggctggtcttgaactctgacctcgtgatctgcccgtctcggcttcccaaagtgctgggattacaggcatgaaccaccatacccggccaatctggaacattttctacagccttattttcttttatgacattcacattttgcagaatacaatcttttgttttaatggaatacttctcatgttgtgtttgtccagtatttcctcaattaaattgaggttctattttctcaactggaatactgtatatatgatgtcacatccttttcagggtattgtattacatctggaagtacagtgtccacatgtccttcattggtgatgttaattttgattattccagtcgagatgtcacctggcttctgtataatttctgcgttttctctcttgcaactaaaaacagtctgggggaggcactttgaaacaatgcaaatgtccctgcttctcataaaaatttctccataagtttagcattcattgatgatttgtatctgcgcttaactataatggttgcaggctgggtgtggtggctcacgcctgtaatcctagcactttggcaggccgaggtgggggtggatcacttgaggtcaggagtttgagaccagcctggccaacatggcaaatccccatctctactaaaaatacgaaaattagctgggtgtggtggtgcacgcctgtagtcccagctacttgggagtctgaggcggaagaattgcttgagcctgggaggcaagaggttgcagtgagctgagatcacgccactgtactccagcctgggtgacagaacaagactccatctgaaaaaccaaaaaccaacaacgatgcctgaaatgcatttttaaatttaatagctctagaggtcttaaattccacaagtttttactgcattcctctgacctcttctggggtgtcagtaaatattatgtgttggcatactgatgagccaccatgattgggatgagagagaggtttaagtgaccccttggttttaagatagatatttatattgctttttagtcagtgagatttggcttatttttgatagatactggctacaactcacagtttaagaaggtagttgcttattaattagtcagtttttaacattgcattcaaaaaggccaaatatttaaacaaatctttatttttatttatttattttcttgagacagagcctcactctgttgcccaggctggagtgcagtggtgtgatcttggctcactgcaacccgtacctccctgtttcaagtgattctcgtgcctcagccttctgagaagctgggattacaggtgcacgccaccacacctggctaatatttttgtatgtttatcagagacgggagttttgccatgttggccaggctggtcttgaactcctgacctccagtgatctgcccgtcttggcctcccaaagtgctgggattacaggcatgagccactgcactcagcctaaacatatctttaataaattagttttcactaattattttaacttcttagttgtatatactgaaaatcgcagttgacaatagaattgttttgttctctacatggtcatagctgaaagtttcagtgcaatctgtcttttggatctgatttgtcctaatagctaaatattgaaattactacctaactggctaaaaataatgctgtttttttttaaacttgatctaatatgttactacaaaacaaagatttttctaaacatattttttatgagggacaaccataaaacttcgatggaagaagtagaatgaaactccactcatgaaagagaatagctgccatttttctgtaataattgtcattaatcttagaagagatttcattagtctaaaaaaataggttttccaatggtcagcttcctccttttggacattttgttccattggctaacatttgtttttcttataagtgataatgagcatgcgaatgactgactgcctcagatgctttcttggttgtagttcccacttcactacgagtgggcattcttgaaataatggcttttcttacatttcatttcaactgtcttctgattacatccatacttgtttggctttacaaaaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggtacgcctttctgaaatgtgcaaatggccaggggctttatcaagctactgatggaggtacttttaacatgaaatgggacacctaagcattcatatatcaatcagtgtatattttaaggagcacccagcaagtgcgcagcattcttttaagcttaatagaacatcttttctgccttccggggaagggaagaacactagaaggcatcacaatctattgggcctaaaaacagctcaactataataaggttttatgaatagtatggaagcctgatagaaaggagccatgagttttgtatacatgtgtgggaagacttcacatttaaagtggcttttgaatcagctttgaaagttgaataggagttaattggtgagaggccaggttcctatcaagaacaaatagatagtggggtttgttttttgttttttttgagacggagtttcgctcttgttgcccaggctggagtgcaatggctcaatctcggaccactgcaacctccgcctcttgggttcaagcaattcccctgcctcagcctcctgtgtagctgggattacaggcatgcgccaccatgcccggctaattttttatttttagtagagacggggtttctccatgttggtcaggctggtctcaggtgatacgcccgccttggccacccggagtgcttggatttataggcgtgagccacagctcctggcctagattataggttttaacatgtgaccccctcccccccaaaaaaaccaaaaagagatgctgagcctgttctggaacccaggcttcctgactcctctatagtctttgtccccctcactgtcattctccgtcagaaatggctttgaccatgttatttctctgcatgtagtttcttgtaaactttatgtggtcataaaactttgctggtccaacactgacttttagtgtgtcaggtttcaaagtgaagtcttaaatttctgtgcagtgaaaagttgtaagcctccttcaagtaaagtttactcttgggacttttttctagaaacctgaaattttaatcctgaatcttcaatcttataagtctgccctgggtcattttaaacatttgaggctaatcttgctatgcttttgttactttgttctctggccccatgactaattgaagcttttggttcacattcttgttctattaaaatgcttgtagcattagcattatcttatgtttaacaatgctttgataaatacttttgtttgatcctcatgaccttgtcaaacaggcaagataggttggtgtctgttttgggagccaaagaaatggaggctcagaggtaaaaagcctgttgtcaagtcccagtgctagtcactgacgacagaactaggacttaaaaccagttctcagttattcagacctgaccatggtggatgctgtggatacagagtttgaaaaacaaaagcacctgccctcttggagcctcagggaaagcctcagaatcccagcttctcacaggcgtgtccaggctagcagaatcctgtcacctacgagagaccacaccaaccttggaagtttatgagaatgtgcttaaactgtctctcacttcactccgattgttacatctattttttttctttattgaaatgccatcacattttaaatacattttttcattttttatggctcttttcaaatttgggggtttttcttaaagagaaagtttacaaacagtgatgtgtacaaatcttacatgtacagtttctgagtttttaaccattgcatcttctttattaaatttttagtttctaccatctcctaggataatgaacttaatgagtgcatcctactgcattatgttatataagaactttaatttgtttaagacccctgactccaagacccctgactccaagaggtattccctaattttgggttgccagcatttactcagcaagatttgctttctcctatcctgttctctcacaaccacagactgaaaagtccttatctttttaggagagcttttttagtcccttgataatttgagtttcttttagatttcagcaaactcttaggatattcctgagaggtacctcagtctagtcttttaattatgggtggctctgccctgaggtgggatgactttggtccccagacccttccccttcctgatgatatctggtattctttggccatcaggacataaagatatctacagtgttctctgtcttttcgtaggtttgtgatgcaagggcatgtgaggggtaaagtactgacttaggaattaggaaacctgaatttaaatgcgtattctacgatttagttgaaaaaaagaacactgggcaaagaatttatgctctctgtgctttagtttcctttgtgctttaaagtgggacattcatgctcttcctgcccaggctgatccaggtatcctgaagatcaaatctgttaatgctgcagagttcaattcagtaaatgtttaagtgccccctatgtgccatgcttatgaaaacactttggaaattatgcaactacaaggtaatgcaatcataactgtttggctagagattatgagtaagggttgcattttgtttcttcccagtatacacagtccacattgatgttaacctgccaccactcagcatggaatcttgtatttcagtgacttggttgaatgtatgtgtatgtatggcttttgccttttatgtatattcgctgtggagtacaaaggaaaaacttggttttaattaaaaacaaaccaaaaaaaaaaaaaaaaaacacctcgaggacatccagtcaacctgtttcttttgtcattacctcatgttgttgagcagtggcggtgtatatagcattactcatcaaatattagcataccagacaaccacatacttataagtcatctttaggatgagacaacacttgggatatttcaaagtcatgcctttttataatctgccccagtacatgatatcacaagtgtagactctgaggggtggaagttagtttaatcttatagcagttaataaagccttttatggagtcttctctacctagcctgctagaagtagaatgtatcagagaggagagaaatgagaaaattacataattgtcttagtattcatataaatcttagtttctggctgttgaaccggtcatagttaagccggctgtactgtggtcacagctctaaggcttaatcagctttggaagaagtttcaacattgctgttggagtttacctgtgaaacctgcagaagcctttgccaaattcttgacccttctcttagcccctcaaactctaaaaaagtggactgaaagctaaaagcttctctcccatgtccttaacttcctgctcctcattgcaattgacttgttggtgatggctctgtactagagtgttaatctggaggcctgacagatgactgggcagcttagctgccagtttagtagcatcaggcctacctctctaacctctctcatgtgaaatgtcccttaagcccatcttgtttatccacgactagcatatgactctgggtcttaacactgctgtgaagctgcctatttatctgtcttccgggtttgaatgcagtccaggaagttgcatctagaggatttactgtgacctttgtacatagaaaagcataattcctttctccatatttgaaaatctgctaagaggtagttcttaccttctctgactctggtattggtctgcttcctcacctgccaggtaaaggcctgtcccttctgtcccaggccttttaagctgtgtgtaattgtgggcttgactactcaggatcagccagggagctagacttttgggggaaaattttttagattgctgattgacactgtgtttgtgatagagggagttagggaacttcattgcttttaaaaagaaagttttcatttccactaaagtgaaaattgctggactgtattatttttattataagaaacactaaatgctgaaaagggacaaaggcagataggaagggttgaaatggaaatataaagccaaacaaaaaccttatagccccagtatttaaagaaagttgggatatcacaatgtatttaatgttgaattgattgagacctgagaattctgagatggagatttttaaggggaatccagcaatagatctgtttgtgtttatttttctggctaagtaaacgtgagtgaacatctcacacaatttgcaaaagctggttgaattcctgatgtatgtaatgatgtggttttcaaataggttatgatccagtagtgggtcatgaaatctaattttaaagaaatggaatagaaaatatcaaattgtgtcacacacatattaagagtgggtattgttttgtgaaatgctttcaaaaaaataatgtatgttgtattagctgggcacagtgtctacctatagtcctagctattcaagaggctgaggtgggaagattgtttgagtttaggagttcaaatccagcttaggcaacagagggaaaacccggtctctcaaaaactgaataaattaaaacatgtttgttgtattgtgttgtaaaacataattcttattgtgggttgtgatggtcagtttcagagtttatgaagtcactgccttagaggatataaaaataattaaaactcattcccattcccaaagaactcgaaataacagattttctatacctgctagtcagtatatatttctgcgtatagctcagaatgttgtgctctggatggtggttctaagtccttctttggggaaatggttctatgaagtaaattgctagtgatagtgattgttactgttattattttgccagtggttatttttaaatcacaagatcctttaagggtatctatgtgttttatcctgagatagaggtgttaatgtaaaagatcattaatgtacagttcaagaaaagcacaaaaaaaataaatcattaatgaaatacttacagcttttgcaaagacttggagctatatcccagagtcgggggaaaaaatctcttaatgaacttggaatttgccacagttttgcagcttttagattgggattatgaattaaagactccttgtctgttttttttgttcgttttgttttgtttttttcccctttttttgagacagggtctcactctgttgcccaggctggagtgcaatggtgtgatgatggctcactgcagcctcaacttccctaggttcaggtgatcctcccacctcagcctctcaagtagctgggactataggcatggaccaccacaacttaatttttgcatttttgtggagatggggttgcccatggggttgaccagatgttgcccaggctggtcttgaactcctgggctcaagcaatctgcctgcatcagcctcccaaagtgctgggattacaggtgtgaggcaccgcgtctggcctagtattcttgatggtcaatattccttgcaatttgtagacagatggcaccccaattcagatagttttttcctgtttggaagcctgctacattgcttctaaaacttttccaaaatgggatggatttagtttttatttcttcttgcacctcatattctctcaacctcatctttttatagctctccttcaggaaatgtataatacctagcttgagctcaagaaaagcagtttaaatgggaagtagtttaacagaattgtcttccatccaagtaattgctgtttcctattctgtagctcctctcccagggagaacaaagctttatactctgaacactaaagtgaaatctgttttgtgcttttgttgttgtggtttcttccagccctgctagcacttattttacaacctgtaccactatatattagaggttctgcttaatattttttaaaataacatgctgccctaggactgtgtatgttttgaaggaagaaagttattttagatttactgaatttatgttagcttcgtttctacctctgttttgcttttttaaggaagataaagccagattcattagggcaaatatagccagattataccagcttgggtggctgttcttgcaaataatcagcacttagtagtatggtgtttcctgagattcctggctggcagttatgattccatgacctgttaacctgccatcatctaaaaggctctggaaaccagaatgtttttcataccctatttggtgtcttggctggacctgatctgagctgacatgaggctatttgttgctttatttatcccacctggtatgaatgatctatacctttcacgaaagaaatattaatatttgtttaaggagatcttgttaagcatgtgagcctaatattatattcgctgtcttaccttaacgaaagtttggaaaactctcaagttctaaaatttggaccaaagggttttggatgaggaattatagttctgtattgctactcgtggtgatcttgttattgattttatttcttattaagtgtactgtcagtctgagtgtggaagtaggcaagtagccagtgtaggacaagagcatggcttctggggccagacaggcctgccataataacctgttttaattttgtcctttgtaaaatgagctcagtgatactgttctcagagatgattgtaagggttagatgagataacataactcttgatcagaattaatttctttcctctttataatcttaacctgacagggatctttctaaactaaaactatataatatatgttactttattatttatacaattcttacctttaaaaatacacaggctgggcgcagtggctcacgcctgtaatcccagcactttgggaggccgaggcgggcagatcacatgaggccaggagttcgagaccagcctggcccatgtggtaaaaccccatctctactgaaagtgcaaaaattagccagtcatggtggcatgcacctgtaatcccagctatttgggtggctgaggcacaagaatcacttgaacctgggaggcggaagtttcagtgagctgagatcacaccactgcactccggcctatgtgacagagtggaaccctgtctcaaaaaatatatatatatttacatatatgtaacatatgtatatttctttgtttttattccacctgttttgcaaaatggtattcatttcttcctttctgctgtttatctttggcctctaggggagcatgtaacttcaaggtttaaaaacgaggtggagaggatgggttttgatatgaacaacgcctggaggatttccaacatcaatgagaagtacaagtgagttatatgggtccctgtggactgtttcacagccagtgcctttgcagaaaccgcaattctcatgtggcagaacatttgaacttagactttttatttgaaatggttttatttattaaatctaaaggcatgatcttcagagtatttattgaatcttctgttcccgttgctatcattggagtggaaagtgatccttacttaacaggatcctagaaccttcccttttaccccctctaggcctctgttttttctggtacatgcatgtctaaataatattgtatttgcctgtaggcaggcagttaccatttttctcatcaccacttggcatcacattagagagaggatcagtggtctcataagcagtgacagaacatttatgaactagtttttatgactgtaattttactccaggtggtgtgaaatagacataagtacagttgagtatcccttatctgaaattcttgggactgtaaatatttcagattttggatttttttcaggttttggaatatttgcatgaacataatgagattatcttgggcctgggacccaagtctaaacacaaaattatttgtctcatatacacattatacagctggaaggtaattttgtacaatattttaaataatttcatgcatgatgttttttacgaaaagttttgactgtgacttgactgtgacccatcacatgaggtcaagtgtagaattttccacttgtggcattatgtcagcactcaaagttttggattttggagcatttcagatttttggattaaagatgctcagtctgtattattctgtcctttaatatattgatctaaaaccaacttcactgctatgatcatttaaccattaaatattaatgtaacctttatttggctggacatggtggctcacacctgcaatcccagcactttgggaggccaaggcagatcagctgaggtcaggagttcgagaccagcccagccaacatggcgaaacactgtctctactaaaaatacaaaaattagctgggcgtggtggtgcacgcctgtagtcccagcaacttgggaggctgaggcaggagaattgcttgaacctgggaggtggaggttgtagtgagctgagattgcaccactatattccaacctgggtgatagagtgagactctgtcgcaaaaaaaaaattaatgtaaccatttagccattacccagttccttaaaatgtgtaagtgcgttggtgggggaggacagttaactactatgattttggtgatccaaatttctataaaacaaaattgtccatgatagttaaatatcttaaatctttaactatatccttcttggccaggcgcggtggctcacgcctgtaatcccagcactttgggaggctgaggcaggaggatcatgaggtcaggagatcgagaccatcctggctaacacggtgaaaccccgtctctactaaaaatacaaaaaattacccgggcatggttgcaggtggctgtagtcccagctacttgggaggctgaggcgggagaatggcatgaacctgggaagcggagcttgcagtgagctgagattgtgccactgcactccagcctgggcaaccgagcgagactttgtcttaaaaaataaaaaaaataaaaaaaaaaaatatatatatccttctcctacgtttccctgcatcattaatcattctgcggtcctcttagctgtctcaaattatgacgggcattttcctggtctgtttgtggctagccgtcagagttttcactggaaaagctatagctaattgctatacacagttcttaatgtggaccttctccagggagttgagaacccagggtgttttgaagagttggagctgcagactttttatacttttgcctgttctcagtgatgagtcaaagcaaagaaggagggtgaatgctggatgagggggcggcctcagagagcctgtggctgcattaggctttcctgagtgtaacctatactggaaattgtttatccacaagtgagtaggtagtgcatactgaagagctgactactgggagtgtagtacctataggacaatgaacagaatgtttagaaaattagatcaagtaaaaaaaaactgtgaattaagacagacttgttggaaaataatccccaattcggcttttaaaaattaacttcttgagaggccaagatagaggattgattaagcccaggagtttgagactaggctgggcaacatagtgagacctcatctctacagaaaatttcttaaaaatttggccaggcatggtggctcattcctctaatcccagcactttgggaggccgaggcgggtggatcacgagctcaggagatcgagaccatcctggctaacacagtgaaaccccgtctctactaaaaatacaaaaaaattagccagcgtggtggcgggcgcctgtagtcccagctactcaggagactgaggcaggagaatggcgtgaacccgggaggtggagcttgcaatgaaccgagatcatgccactgcattccagcctgggcgacagagcgagactccatctcaaagaaaaaaaaattagttgggcatggtggtgcatgcctgtagtcccagctactggggaggctgaagtagaagagttgtttgagcccaggaggtcgaggctgctgtgagccatgaccgctccactgctctctagcccgggtaacagaacaactgtctcaaggagtttaccagttatacctcagaaccagtctttaggatgttatcaccaccataaaacaaaatggggggtggtgggaaacaacaggatgttgaaagttcttcctactacaaaggtagaagagtgagagccaagtttactcttgagtttaatacataataaagggaatgagattcatggttagatattaaccatcattactggctcccagcttatttttaggagtttgtgaataggtgttaggaagtttgtatagctactcttagtcatagccattctcttttgttcagtggcttttaaattcctgaaaattccagaagtctcctcttctggaaattgaggagagatttagtgcaaaatgatcaaaacccccaaatcctaagccattttgtgtttttctgcgctttctgctatgtataggataggctagggcagggggttggtggtgttggtggagtttgtgtgttttaggatttggattaaaggccttattgccttcactattgaaaaaagaagattggattatccagagagagacattgtcctgtaagtaaaaatctatcggaagtattgcttcctaggataccggcttgactgtagctgggatcttccctaattaaaagaaagcttatccccccgcccccagtataatttgttctgaagtatgttttatggaaattatggttaatagcttagtcacattactaacctggttcaatgggactgaggctgtgtatgcagatagactggcttgtgttggttttgcatacccatggctgcacctgttacctataaggatgacaccctgtttggttcaaatcaaagaatgagttaatcctgtgaagtctctggaaacttgcaattgtgggcttttttccttccctgagggtctggtagaactgacacggactctcagttctgtaattggactgggcgctcatgtagttagaaataacctatgtacttgttacagcagaagagttgtaatggagtataaagagctgaccctcgactcccctttttttcattgatagttaagattgccagattcccaaaaggtagcatcaagtggaacaattcaagatagtatcatttgttgtatacacataagtaaacatttaaggcaacaaaacaaaacaaaacacacttatggtaacccattctgttgaggagtccaaaactcgaataaagcgcctcattgcctttaactggttctgtggcagtgagatcatcatccttatgctggctcacctagtgtctctctctctctcccgttttctctctccctctcttatccccttgactctccccacttctcatcttctctttagattatgtggtagctatcctcaagagctcatagtgcctgcctggatcactgacaaagaactggaaagtgtatcaagtttcaggtcctggaagcgcatccctgccgtcatctacaggtaagttaaactggaccagtcccagcttgggctggtgctgctgcctgctgcatatggtctgctgcctctgctgctgctaacctgggaagggtggggagagttcagagaactttctaggcaaggctgtacttccttattgttaaagcttctcctccagtaacacatcagtactgactgcattcagaacactagctggttgttcatttgaaacagataagaaagttttagttgtaaagtggctggacttgctatttcaatatccttcttacattctgtgagaagataatgtgcttactaagcatttagcttcagctgttagcagggcttttggattgagagatgagtcttagaaagtgatctttgggaatatagggtcgagttggctctgattgtctttgtggttgaaactttgacatgtggaagaactctgtttcgagaggaagcatttagagaagaagactgaggcatgactagatagaagatttcagtgatcagaggcatgagagccatgggatgcaagttctagatggggatggtggcatggtgatggagcacagattttggaatcacagatctgaattcaggtatattcttagacttcttgctaaggcaccttgaataagttccctaactgacctcagtctgttcctaatgaatacaatgggaatggtagttcttattttgtagatatgttctgattctaaatgaggggctataaacactgagcttctgtaccagcatttggaataggttaaatctcttgagtgctgcttttgtaattcattgaatatcttagttctcacagaatcctattaaattttaaagaagtccttccttcttattctggaaatgttttggatgtcatctctttgtaatgtttacattctccatttcattttcccagtttgccggctttttggactctccctgagttgggccaatccagtggcttacagttagaaacttcattccactgaaatattgagattgtaggaagggatttgtctccttgtggaattcctacagaggtaaccagcttgttcatttagtctactaaaggcaaactctgatgcccactctgaatggagagagatggaaaagtatttgctctggcccagtggaactcattacgtttttaatctcaattctcatcactgttgttttcagacacccctagaaaagtcagtcaccaaatttacctgtcattcaagtggtaaggatgctacaggaactagagagtagtgaaagctgaagggatttatgagtcttatcaatgatcagctcagctggaatggggaaagcagccagttgctgctctggccaacaactgtgttaggtcagcagccctggcatctgtggggcttgctgactttgaccaaaagggggaaggtactcttacttgcaaaataagaggctttaggtgaattctccctttgggaagagaagcttaagagggctggttgaagaaaaacttcctttttttctaaattttattctagagggcatgcaccttctaaaattaattctagagggcatgcaccctaggttttccccccctttttctagagatacaagaggatatataaatgaaaaattttatttgcagtttttcagagaaagtctttcaaaagatcacaaagttcttggtgtagtcatccatgcaaaatcaggcaggtttcctggaactgggctctgtctcagaacatgtgtcttgtatcgctgagatgcagactgggttgctgtagtatttgggagctttgtaaggggcgtgtggaagaatcggatcctccaccatgctctgctttgccagcctaggtggcaggatgcctggaactcttgacatccatttcctgaatttagttgtctgtagattgggtcatgattcctgaggttgccagcagcagttacttgacagcaccatgctgaaccagcgcttgattagggctttgtcctactgtgatgagagagcacttaattggatttataactgaaggtagagattgctctaacatagcaagatgatgtaaagggcacccatctgtagtgcagttcacagctttttcctttgtgcatgtggtgattattctaaactcctagttacttaagggagcttgcctaaatctaagttgaggttacttaagacaattctgttcctatataaaattgaagcattctgtgttttagtagggagggctttatctgttggacatcataatttttatactttgcctggttctgttagtgatagaaatgcattcctttagtgatttttaactgtagtgtttgaattatctttcatgtagtctgaagcattttagaagactgcagaaaacataattgtttattgcaatagtccagttgaaatctaatagctactataatgcagtgtcccctaaaacccaagatccaggctgaagagcgccatctactgctcctcttgggcactgctgggaagcattgaagaagaggaggatgttcaggaaaggcccaaccagcctcttgtgcagggtttggagtcattcagctcagtggttgcctgttatttgctaggagacattttataaagaatcattgaggttttatttctattttggccccattcagcacgtgagccagttgagcatgttggcaatacacaagtacttacagctacttgtctcccagggagggaggctttaaaaactacaagcaaactggtgatttcagtggaatttgattagtgccaaatttaacttatttgtgagttttaggagtaaaaacaaattacagtacattttcatcgtcccaaaaaacccattcacagggcacccagccaccctagccctgaataattaagatgtccaatggatgaagcccctgctagtaaaacatagagtgcttcagttttatatagaaacatactcgttttaagtaaccccaacttagaattaggcaagctcccttaagtaactacgagtttataatagtcactacatgcagaaatctacttccatctttatagattcgcctattctggatacttcatgttaattgtcgtacaataagttgccttttgtgactgacttctttcacttgtcataacatatttgaggttcatcagtgtcctagcctgtatcagaactttattcctctttactgccaagtaatagaatttttctaactttttatcagttaaaattgcctaactaggaaaagtctgggttttaatagcaccttaaagtagactgtgatttctggtctgtcttattggaaaaggatatgtcagagtatggttttctgaggttgatgctcttcttctctttcttaagagccctaggaagggtagctggctcattgagctatctgcctattataagagcagtctgtgactcatgaaatctcaggagattttgtaaagcagttcactgtgggccaggtaaatgttttattcccagaggcgggctcttggttcagcattaagaaggtagcagatttcactattgggtagcagaattagtgtagtacctatagatttaagttacgaatattgatttattttcactaagagtacacattaattcttttttgttttttggaaatggggtcttgctctgtcacccaagctggagtgctggagtgcagtggcacaatcatagctttctgcaacttcagccttctgggttcaagggatccttccacctcagcctcctgagtagctgcgactacaggcatgtgctaccatgcctggctaatttgtaaaaacttttttgtaaagatggggtcttgctatgttgctcaggctggtcttgaactcctgggctcaagtgatcctcctgcctcagcctctcaaagtgctgggattgcagagtgagcctccatgcctgacccctgttagtcatttttttgggtaactttacagggatctccgtgatgttatggtaattgagaaagacacacaggttttgttgtttgttcttgttggttgtgtaagatttctaccctctttaatactgagaggacttgaagctgacccaacacttacctagaattagactgttcattaaggcacttaaaatctattttgtgtgagtacagagagcatctgaatgggtacagttgttgtctcttgttcctcacacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcggtaaggtgctccctggacccatggcaatgatttttatagcatctaagaaccttttcttgaaatggcctcttccttacaagacatagatttacttttatagaagtgaatgtgcagagcttcacttgatgggattgattgaggagtcatgggtcttggcagagaatcagaagaccctttgtttcaaacctgaatcaagatattagtgtgtttgttgtctttcttgccattgtgacaaaaatggagtgtttatgtaatagaggacttgcagtatctgcagaccatggcaggaaatgccaggcttcatgaaaggacaacagatacagaaatgaagtataagagactgggctgtgtgaaccccatgtgtactctgggagtcagttttggagaataaatccttctcatctttcataagaaggccacatagaaaaaaagagaaaaatcctatgtatcaagggttttggttaggggatttcattttattgagccttttttgtgccataagatgtgcttgtgggtctaattctgcacagttctgggagagacaggctcatttagtatgccctctccctctgtgtccctagattcttctctgtcaaatgcttcaggagcagagagtttagccatccaaccgcagaagcttttgatcttggatgcacgctcctatgcagctgctgtggcaaaccgagccaaaggaggaggctgcgaatgcccaggtgaggtgtatggtgctttgttccccatactttctccttgtgagtgtagcccttgcccaactgagacttagttcccaatttgaaataagtggcaagccatattcctcatccatcctgtcgtgagagtgccagagcttctctttggattcttaacactgtatgttcttttctgaggagaaatggaggaggaggtgcagtgaagtcacataatcttccttccttgtgccaacttgtaggtgataaggaaagcagatcttccccataataagacctgttcatgtttggaagctgctgctttagtgggctcaatttctcagccgtctaaaagctttttgttgcctttgacagagggtatgctcaccactggccttgtagcaaactcctcaagggcctctccttagaaaacctggggtgaaaattgaagcagtaaatacagaaccctagtaaggtatctctgtcctgagctgtaacaccattactgttggaatgctagctttccccaaggagggacccccctcagtgcctatggcacaggcagaggcaccaggctctttgttcagatgtggtctaagctggaaattgaaagcagctgtaccaaggtgaaatttgaatgtgtgaacgcattgttctgcggagttcttttcaaagagatttcaaagccacaagttagataaggcccaagaagtaaagccagagtgagatcgaagtaggcctttcttttaaaaaataatagcttttattttatgtcagtatcttctttacaaatctaaccttcccttttcacgctttttgaaaagatagctaaaattcagtgtgttcctcttattataaaggattgggctaatagttaagcatttcaaaacatttcagtttcgttaatcagaagctgcagtgggtttgttttatagccagtttgcttttaaatttggccatgtgggctttaagttcaacgtatttgtgttctctttattgttactctctccagagtattacccaaactgtgaagttgtgtttatggggatggcaaacattcattctattcggaggagttttcagtctctgcggttgctgtgcactcagatgccagatccgggaaagtaagtccttggccttggctttcattttgcatcgctcttaaataataagtttgcttctttccttgaactaagggggaaaaaaagaaaaaaaaattaatttggagcagtctttccttctgtttcttggtaatcttcagttaccagaccagtctctgcaagtatctccttgctgggtctgaaatgtggcagcacagaggaagagttgggagaaaatacagccatttgaaaggttttaaaatctgcagcacagaagaaatctcagcatcaaaacagaagcattaccttactgtttgtcctgggacctttcccttccacgtcatttttagcccaaagaaatttaattcttcagtttctgatgtcccatagtgatacataacctgttttgaactgggatgttttatcatgaaaagtcagaatttattcatcatgttctaaagggtttaaacttgccattaagtcagttccttttacatctgctttcaatttctaaactgttctcatttactaagcatattatcctgattcttattgcttattaaatatgaatggctggcatttgcagtgaggaaggtgaactaataccccctccaagggtactgattgaatacaagataaattaggaagaatgctctgtaaaacaaatatggacagataagtatttaaaaatcctgttttactatttcaggaagccagagataggtgccagagaagacagaattttcttttttctggtatttgtgctggagcccatagttgtttctctgggtcctattcagtagatctgatgatcacatcaagttttactgcgttctttatttgatttattaaatcagatgctgcctaaaccacttatattgactgccaatagcaaatgattaaattcaccgtagttgtcatcagccaagaggatgaagcagtgcctttggggaaagcctgaccggagaattgagcttgctgcctcctttggggattagccatttgcatttgctacacagttccaggtcccagctagcagcgctttcttccctagggtggtatgtagaaggagccttactaaggacccaggagatcggccgcgaactgtgtaaccttggccaaggggtttaactactgtagatctcagttttcctgtctataaaatgaaagacatgtaatcaacactacatgatctaataccctccatatattaaaattcttaaagagctatcagagtcaaaaaagatagaattagccctcacctggtccacataaatgtcttggggattttattaaaggtaatgcttttatgtatttggcagcaaatcataatgctgcactgaagtctccctcatgggtaaaaagcagctgtagcagtgatgggcagctgtaattaggcccccggcctgtgtttggggctgtggaggataggggaatggtaggcttctagtgcaggttgagaacaggacaagggaatggggagtctctcagcagcccctccttggctggcaggttttggagtacagcttcattagtcacagacaacaccaactggtattaaataatagtttagttaggttcaaaagaacctcacaccggttctcttgtttaccatttcttcaggtgctaggagataatttagtatttgttctcctaagccttatcttttagttcctttcaagaatatgtgaggaatgaaataaacaattgatccatcaggaaaaaatgtttctcaggtacctgctaggagatagaaagtcttacgattggatttttacccataacagacttacaattcattaaacagtgggactccctactgtatgctaggcactgtgctgggggtacagttatgactgagacatagtgttagccctctgaggagtcacagtctggttggtagtccaaacaaatccatatacaaccagtacttatgcactgcattctgttgtctctttgcctggaaagacccccacctccttagactatgccaaaatttcatacttattccacagggtttagtaggcctttacagccttcccacagtcccctgacagaaatgtttatttcttcctctgactcagtgtttgaaagacttgacttgtgatcttaactacaaatctgatcacatttgggaaaaatcaactcctttttagggattgggaggggtgagggaaagcacaagaaacaaaatgcaacagagtttaaaaagcaagtgtgattagcttgtgattactcccaaggggcagctactgctatctgatactccaaaagtgagatggagtctctctctctcatccatgctggagtgcggtggcctgatctcagctcactgcaacctccacctcccgggttcaagtgattctcctgcctcagcctcctgagtagctgggattacaggcgtgtgccactatgcccagctaatttttgaatttttagtagagatggggtttcaccatgttggccaggctggtctggaactcctgacctcaagtgatccacccacctcagcctccgaaagtgctgggattacaggcatgagccactgcgcccggcccctaaaagtctttcaaaaaaaggttcttcctagatcgctgctgaatccagtctgtgttgagcccagcaatactgtgtggccattggtatactaatttgtatcagtataaattatcagattgggctcatcttgttttagtcagtaaacattaaagaattaaacagtggtaagtgttacagtctgggtcataggcagggttgtgtgtaccattcttgtatatggcatccagcttatgtctcatagatatatttgtattcatgagtttttcttttcttttcttttcttttttttttgagaacttgttgggcgtagttgctgatcattaaatataaatatcttctgttttacatctcagaagtggctacattttttattcaggagaagattccagaaagagccactttccttataccatggactgaaaaatgtcaaatattttgcccggggaatcatccatacagattttggaacaaaaggtgtgctattaattgtagcccctatttctaaggctcttctctattgtatagtagggcttgggcctcatcctgagacatgctttataaacacacagatttttttgttttggcagtgttatatttggagagagaaatctttggaaattgctttttcatttgacaatcattgagcatgatgcagtaaatcataaaaaaatcagcattttctaatcctctcctgtttttatagttggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagaggtgagcccatccaaatgggaggggttggtacttcaggatgagccagggaaacgtctcaggagtgataccagttttgggagtggtgattcggttaaagaaagtgaaatttctgttttggtcattgttcctttatgccatgagctaaattgtggtggttcctcccacagttcttgcacctcttaaaatggggcagattatgggtaacaaggtattgagaatatagacatattttcctttacagtctatctacttgtaaaagtttttagctacctcaggaaaataaggagtctgtaaaaggatcttggcatgctagatattaccagagtgttctgtggagaagcagctctacctgaaataaccatctgttgggttaaagatgaaagaaaaatcataaagtaccctaaaatatatgcaagtattaattaaacttggggtatagaaggattttacagacttgactttgtaacaccagaggcagaaatgttaagagaaatttaggggaaaagtgtggtttttatatagtgaacacaagaggctaaaaatacacattcaagaaaggcttagataaacgcagtcagtaccattttagtgatcatggaatggagttcagggaattgggaaatttccctaagtgtgtgcctcatcagggatagagccttccaccaaagggcaaggccgggtgggctttctgggaggctgttagaggggattgctttctgtgacaccaggcttaggactgtcacagtctggatagtctagcacaaatggtctctcctggatgcttccctgcagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtaagtttcttcattttggggactttctcaatttgaaggagggtcagtacaaatgttagtgggccagttctcacatgaaactgtgctgcctcttcagaatttaatagaggtgatttttttcctgtttctgcttttttttttagtaaataattttgctattttcaaaaagagaaaatccaggtataccaggtttgcatgaagtccttgtgttgttttaaacttagtttttttttaaagggatggtagaaaccctaaatagcagttagaaatagaagcaatcagaatgtctggaccatactccctccagtctgtctaccagacccccatgactgtctcagactctgcaccctctcctttgatggagggtacactatccctgccctctttcagcccctctgtccatttgtataccagctctcatctcctctcatctgctgcactggctggctccagcatttctcttctctgccttctgcatcagtgcgtttccctctctaccagagcatgggtttcagcttaaaaatgtgtagtgtctctcatctttttaaaacccattcttggtcctgcatttacctctagctatcatcctattgctcttgttcccctttacagcagagctcctcaagttttctacccttgctatctcaaatttctctttccactctctcttaaacccacttcaatcaggcattcaccccactgcttaacaaagctgctcttgttaaaatgaccagtgaccttcatgccaccaatccagtgagaagttctcagtcttcatctctttgatccatcattaccatttggcacagtttaaccactccttccttgaaatgctttcttcaattgaccttctagtacttccttgcagttgacttctagtacttccttgctgttagttctccttttaccttactggattgtttctgcctcctttgctgattccccttaatccctccagttcttttttttttttttttttttttttcagatagtatcttgctgtgtcacccaagctggagtgcagcagtgtgatcataactcactgcatcctcaaacttctgggatcaagagattctcccacctcagcctccccagtagctgggaccacaggcacatgccaagatgcctggctagtttttaaaaattttttgtaaatagacatggagtctcgctatgttgcccaggctggtctcaaacctcctggcaagtgattctcccgccttggttgcccaaagaattacaggcgtaagcttcgacacctagcctcctctccccagttctaaatgttggaatgcccccttgctcagcctccaggctgctcctccatccacacttccaagtatttcatccattctagtggctttaattgccatctgtatgctgatgagtcccacatttatacaccttcagcttagacctctccacttcagactcacgtatctaagttactactaggtatctccacttggctgtcttaatgttgattcagacttaataaattcaaaacttgatgcttctttttggagacagcatctcactctgtcacccaggctggagtacagtggcgcaaacacagcccactgcagccttgaactcccagggtcaagtgatcttctcaccttagccccctgagtagctaggactgcaggtgcgtaccactgtgcctggctgatgtttttaatttttttttttttttaagagatggggtcttgctttgttgcccaggcaggtctcaaacacctgggctcaaacaatatcctcccaccccggccttccaaaatgctggtattaacaggcatgagtcaccatgcctgtccaaaacttgattcttgattcctgtgtttcctcactataaaacttgatcttccagaagtcttctctctcaccatatggcatttccatccctccttttgtttggggcaaaattctttgtcatcgtcaagtctcctccctccctccctccctccctccttccctccctccctcttccacattcagtcagattctgcagctctgctttcgcaatctatctaaaacctggttatttattgccacctttactggtaccacactggttcaagccaccatcatctcctgccccaattgagttatcccagcatagagtctcttctaaaacacaaggcaggctgtgtcattccttggcttaaaaacctctagttacattttacacaaaagccaaagttcttaaaatggtctccagggccttcctagaggttacctctctaggttcatttcctaccattctccctcttctgcaatctcctttagtcacactggcctccttgctgtagctcagaaattgcaagcatgtgctttacctcaaagccattgcacctgtggttgcctctgcctggagtgcttcccctcagatacccacatgcctgctctttcaagtccactgggtcccagccagtgaggccatcctgcactgcctcatatgtgtcctgtccatctcagtctgccttgttctccatagcactggtcactcttcagctatgactagagcaagctccatcagggcagaagaatttgctggtcattgctacatgcccagcaccttagtcatgtttgggccatgtgaaatgctcaataatttgtagaatgaacaagtagttttacaaacatactgtcagctcagacttgagttgtacactgacgtgctcctgcacccagttcatatgctgtggcgcttgtgagagtggctgttaattcacaatctcagactatttatcacggaagctaagaggaataggggcaccaacaacctgtctgactcaggttgttgggtcctggaattggtggtgtgaggaggaggaggctactgcatggcttactgggttccccgtcctgacagagtaaattgaagtgttctcagggatgttaggataaggtggctcagctgagctgacttatcagagtgtgcatgcctgattgcttaatttgtgcttcattggacttccataggtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgactgcttgtctctccccttcagtgtgccttctggggaagtaacaatacagcaggaaaatttccttcttttcacatgattaatttaaatgatcccataaaatgggtttgacagtgtttcttgaagccaagcttttgtgccagcaggatggacaatcaccatctaacagaatgactcactttcttaggcagtaaaagcaacaaatcaagctgatgaaagtcagacattgaaggtgacctaagaaataactataatgagaaagggatctaaaaaatattttatattttcatgctctcaagtggctcttaggtgaaaaatgttggctatataaaatgtctagtcctgtattggtcctcttgggatagacctgtatccattggtgctgcttctttgtggagatcctgtcagccctgttgggtattccagctgggtgcttgctcttgatcctcatttccagacatcctagaagacttattggggcatatttaaacctgtgtcctcccccctcctcaggtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggtgagcccagggtgatgccacaggcctgacagcctgtgtgggtgtattcctgtgttgggacgtgtgcagggatggtcagagatcatgatggtatctggctccacagtatctttcttaggtctctgcagttttttcagggaagttatagggatttctgagctacgaggctgtaagatccttgtttctgggagtgagttaggccctgttgcttcatgttgttttgcatacactgagccgctcctcagtgatagagcaaatcctccagtttttctgtgaccccctggtttgtgttttccccagtgctctgtgctcctgcctatttgccatgatttgtcttctgaggcttaaaaggcagatgctgtcagatgacagaaaattttgctttggggccaggcttggtggctcatgcctgtaatcccagcactttgggaggccaaggtgggaggatcgcttgagcccaggagttccagaccagcctgggcaatgtgttgaaactctgtttctacccaaaatgcaaaaactaaccaagcgtggtggcacatacctgtagtcccagctacttgggaggttgaggcaggaggatcacttgagcctggaaggtggaggttgcagtgatccaagatccattgcactccagcctggatgacagggcaagacctgtctcaggaaaaaaaaaaaagaaaagaaaatttggctttgtcacttgagaattagctttattaaattcagactgatagataatacattaatttaaaatactgtaatatcaagaaacaccagtgctactttgccatccactgagaaacacagcagcatcatgaagaacgtcttttggaaatagcatttgcaggccgggcgcggtggctgacgcctgtaatcccagcactttgggaggccaaggtgggcggatcacctgaggtcaggagttcaagaccagcctgaacaaaatggtgaaacacccatctctactaaaaatacaaaaaaactagccgggcgtggtggcacacacctataatcccagctactcaggaggctgaggcaggatcgcttgaacctgggaggcggaggttgcagtgagctgagatccgccactgcactccagcctgggcgacagagtgagactccgtctcaaaaaaaaaaaaaaaagaaaatagcacttgctgttagctcatttgtatgtatggggcatggggttgggggagtttgaaaggaaatctgcacactaggaggacttgttccggagctttgctgctccagcagtctgggcctcgctccagagatgctacagctccatgagtagccataatggacccagttatgaaacaactgcttgttaaaacctattgtctcctacttcctccaaacagtttccaagattttcatttcccccaaattcctttcctttaggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtggtgagtaggctgtggtattcctccatagctgcccaaggagacggcatgctgaggctgggtgccctttgtgcccagtgcatggtgattggtacaggttgttaaaggattggaaaggtccagagtagccctgttaagagaggctggagatgagcctccacgacagcgatggcagcctgcctgttttctgcttcgcttactttctgcagatgtcctgttgaggccgttggagaggaagagacttagcatgcactgcatggttgatcagatctctcagacacaggatcataagtcttcagaagggcttgaacccatgggcagaatgacatctgtagggcaatgccaagttattcctgtcagattttagtgcctgttctgccttagtaactacaaagtattagtccttccagacgtgggctatggctttgaaggttcagttctttttaaacaaatatttatacccatcctgtggcagatgctgccagtagaaatggagagaagggactggtttctagcactgttgaggagttagctctgatgggggtttgtggctggaaatgggggttccagagggggaggttctcaaggaggtgctttcctctctgggtggacttgactcaggcagctcaagtacaagtgtgagcctggctctcaagtggtcagcgtacattaaaggcgggcacatccagtgactttcagttcagagtgacttggcttttccttcatgctaatgatagtttctcatgttcccagagagtccttctaagaaaaggagggcatcccgaaagcactcagctttaacttagtggcaggcagggttggattgacaggcccactggagcagctgacatacagaattctcattccattttggtcacttccctctcactcactttctggaaccctgagggcctgtttttctactccagagtcactgcacacaacctgtgtatccctctcccagctgagcccaggcccacactgcacttcttcaccccagttcttgatggctgatgcatctgcagattcggcagtcctagcactcggccccacccagagtcctcagttctcccttcttcaccaggccttttcttcttttgggaggagaccaggttcattctgttcagctgtgtttgtttgccaacagacttcaatccccgactcggaaagcaatctggatcagaactgtttgtctcgctgcagcacagagattttctctgaagccagctgggagcaggtggataaacaggacacagaggtacaggctcagcccctgctctgagtgccatccatttaactgttttgtggttcttctccacccccattcccaccccatacccctggccaaggaagcacctcccagcacagctagccctgagcctctggcaccttagctcctgggaacccacatgaagcctaggatttctgagccagggagactcagcaagctggccctccctcttcattgcctctatgaactggagccttgccagctctcacagtgacccagggtgctgctgcctgctactttatctcaggggagattggagtcccctccagggaaacgatttggacgcctttcttgtactgttgacatcagatctgctgggctggtgccactggagctgatgtggtccttgtgactcttgctgcccccagcatggctctgctggctccagctggatggcccatctcctgtcagtaacctggtcccatctgttttgcagatgacccgttggcttcctgaccacctggccgcccactgctatgcgtgcgacagtgccttctggcttgccagcaggaagcaccactgcaggtaccattgaggggctgtggtagggtgggctgtgtgtggaggttgagggtcggcccacagagcctgcagagtagagggttgtgggtatctcagtgttctgtctgaggcagagccatggtctcatcttcctgtgcctctgaaattggtgtttgcaaaactgcatttggcatctttgttcaaattcagagtaatcactgttaaattctgaaatgtgcaaatggtagcattttgttgtttcccagattggtgaaacaacagccaccactgaaaccaccatttcttattctcagcataacatttcttcccattcaacatggctactatgagcaaaaccagttttcctgcgatggggagggaactattttcctattcctttcctgctccctgaccccacacttgttttcccttgtgccattggtgagcagctgtagcttgggaagtagtagagacagctgaggacagtcttccaatcattaaggttcctgacttctttttccttctgggttagggtagtgagtttactagggaccctttgccccagctagggtgttgactgtctggtggatgttcagtgttcttagaagaggaagtttatctgaatcatgccatagctcacccacacgagtgggtggattgaaaatggaacagtctctttgcctagtaatgatgcttctaggacatgtatctccccaccctgcaccccaagcccagatatctttggttggcttctcttctgagctctttctcccctccttgcagggacactgaccgtgttgatcaaacgtggtgagcatttgcaacaacctgcctgtgatgtctgcacatctacaataacttctccacactaactcttatcatttccccctctctgcacttactagggtgaagcctggggccttgggtgcacaggcagataggtgggcttgaggggattcaaagcagctgaggagaggccatcgagggtgggtcaggctgcagccatgtgctcccctcctgatcacagaggtcagccaggccgtcttgcttgtgacgagaagtagtgcttcttgtcttctggtcttgtaggggaaccagttgggttttcagagctatttattttgggtcagtgattcattgagatgccagaataatgctagtaatttccaggtcaaacagcatcactgcttcttttttccctttttttttttttttaagagaccaggactgaacagaggtgatctttccagagaattgttttagcttggaagacttcaaggaaagattccacttagtgtctttcagggtcctctgaaagaagtcagatagaaaagcatcagccaggtgcggtggcttacgcctataatcctagcactttgggaggccgaggatggcagatcacctgaggtcaggagttcaagaccagcccgaccaacattgtgtaactccatctttactaaaaatacaaaattagctgggcatggtggtgcacgcctgtaatcccagctccttgggaggctgaggcaggagaagagaatctcttgaacctgggaggcggaggttgcagtgagccaagatcgcaccattgcactccagcctgggcaataagagcaaaactcccatctcgaaaaagtaaagaaaagaaagaaaagcatcaaattcatgtcaggcttttgagctgaactccagcaggaatgttaaagaagtgtagatgttcagaaatttttctgtgtaactacaggtttttgctgactcacgctttttagaactagttacgaagtacagcattctagaagatgaattttgtgtttttcttttctgtctttccattgccccatgtcccaccttttccttttgtggtattcttttgttcccaactggtcttagtcttctctcctcctgtgcctaagtgatccttaatccagcagtgggtttgcattccgaacagcataaatgaaaagttagaaggctaagaagctgccctcccccagtctttggtgggctgtgtcaggctccttggagcttcttgttcttaggctcattaggattgatttgtacctcagggcccagcaaaagtagagttgtaaggtgggcagaaactcattctttgccaattccctttcctgttggctctgatgggcatccatctgggggtgcagaactgtgctgcacagatgcctcagaacccagctttcaggggaggaggagagggatgcctggggcctgagtgcattctggccttctggtagaactctggttttccctggagatgcatgggtcggggagtgagccataattgactgacacctatctaataagggggtgtgtgtgcacgtgtgttcatcctgtgttcttgtcctcccacctctcctctttcaccctctgagcatgcatcacaggctgcttgtccctggctttgcatgctgccagcagagcagtccaaaatggcagcagtctatctgccatgttgctgcctttgatcctctggagaagtggccgttgggcaaggctccttactccccagtgaggctgggtagttgtttctctcgtttgaggagcctggcctctgtgatcacaagctacacagagggcattgcctaggtgggtgtggccactgggttttcctggatcaggactaacccattgttaggaccatgtattcttacagatctctcttgagcagcattcttttgtatacctgagcagcattcttttgagtcagtggtgaggcagccaagaatccttggccccaaagtgaaaatgacatgtgactctgctaggtagggacaccctccctacccagcttgttcctgggctagagagatgaaagggtttgatctcaaggagctccagcacatgcaaattacacacggcaaagtttgtcttttgaagttggtttccctccgcatacctgctggccaaaactaacattgttctgtttcttctcatctcaaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcaggtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaattctttgccctgtggtttatcccctcttcgtcccttttccctctcacacagaagtgtttgagggcctgctgggaaactgacctttggcaaaggaaagctacagatagccttccgactctagaccttggcaaggagcctcaccatgatgttcaagcactgaacgcatttcctcagtgattttgctcctaaaatctcccaggctaaaagagggcaaagcagtcagggatctgacctggcagctattcctccttctctgaagagttcccatcagtagtcattacaactacctctcgcctcaaggctccatttttagctgctgctctgatttcagggcagccagtactctggccccttcagtcggggagtggaaggagatgtggggtgggggtgagaaaatgcttctgcctgttgttcttgaaggatagactatgggtgggcagagagaactgggggcagaaatggaattagatgtgattgggttatgcagtcaactagaggtctccttcccgccctctctccacacagagaggaacctctgctccttagctcttacagcaggactgtggcatctagtcacttcaatactagttcttgctcttcacagaggtagatttttctttaccctacagcactgttgggcatccctcccatcacatgggtctgtgggtgagatatgttatgctgttcctccctcgggaaggttggtattgaggggtgccttgctccagaggcgccagcccagcatctgtggtgagttggctaagatccagagtgacctgctcagagctccccagaggccttcactctttggggcagtctctctagggtcactttctgaatgtaccttctacctaaagtatacaaacacaaagagccagctgagctggttctagtgtgaaagccgtaagtgccacccagcaggcgtttgaaaacaagaaatcattcttctgtggaaggagaatgtgccatctcagctaccctcagtccgccagggagcccagtctgtgtattcatatgaagttgtgaaaaccatgagtgtgtgccatggccatcgtgtctacacacagccactattgttcctgtgggctagtctccagcaaattaaaacactggcatggcctaggaagggcgttgcgagctcctaaatggaaagcttctctgggggtagggagatgaagagccaagatgctggtgaagcaggtgcagtgaggatccaaggcaaggaattgccctgagggaggtggctgcatatggagaaaggcagttctctgtgggcaaggccagcttgcttcaggctgtagagggaatttggtctgaagcaacagggcatgaactgtgactttgagctgccaggttgtcttcatctcagaactttcctatcctggcactctcgttacctttcttctataccttggcctctgtaactgcagtccaaaacaagttacagctgccttaatccactgagattctctatgaggatgtacagaaaagttttcctgtaataattttgcttatatgctaactcttttcatgttagcaaagaatattctatgaattagaatgttactgtggtagatctaaaggagaatgaacagaaggtgctggaggacctgttaaacaatctctggctattaaaaaacatcaagatgagaattaaaggcatatcctgatatacttgcctgcttgcacatgaggctgggagatcccatgcctgttgaagttaactctagccctgacctctattgatcttttgggaatgagggctgatttgaaggtgctgttgcaggatttcatttagctgctgccagttcaagtgacctgtccccagggctgcagctgtatccacctgattgcagtaggtgagggctaacagcagaatttaaagtggaccctgggctgtggagcaaagtgactatccatttggacttttggataatgtggcaggagtcccagctgtttaatt

SEQ ID NO: 12861 - DNA, 69833 bp, Human
gatggacaacaatgactatgatattaaccgttggattttatggatttttattgaataaatggaatagattttgttaatttgtttattttcctccatgaagatgtttgaaatgtatctgaaaatataaaatattttcatcatataagttggaaaactagggaaagtttagggttaatttaatcccatgtaattcttttcaagtgcttagccttaaatattacctcttacttcagttaagataatagttttttaaccccttttttcaatatgttaaaacattttgaagcaaatcttccagacatagtgaaaaaacctgctctagatggttacttagtgtcacaattcatggagggaactatatagaattcccctatatggtgattttctgtggcactacctccagcttttatgccctctggctatatatgaaaaaatagacatttaatatagtaatgtttttagccacaaagaagagtgaaggcaattttgacgtgggagaagaataagttctctcccttagtgtttgatacggtgactatattgggctaagataatggttaggagagagagaagagaaaaggggagagagattgggttctaaatgcacgagaagaaagaaatgagggcagttcagaacaataacctgtgaattttttcaccacttacataccaagcaaattgcatttccttctacactgtctggttctattccaatgtgttttatttaaaagttttatctttcccaatgaaagtttaagttccttggaatctgggtccaagtatcttccacagaaacatacttctctcgctagtttatactctctgtaggcacgtacttggctttcttgctcactgctgaatgctggtgcgtagcaccatgactggcacagagtagatgttcaataagtatttgttgtatctgtgagagaatgtgttaaaataacaaaactcaaacataatagtgcagcgactatgccttgatgtgtgtgtgtttgggattcagcacatttgtagaggtaaagcagttggttttttaaaaaattagtgccattcaggatcacttgttaaatggatattgtttaaaggacttaattaattaatgctggggatactgttaagaaatcattctagaaactagaataaatattgccaaagtgaaacactttggttttgatacaaattattgccttagtttcaagatgtaaaacaaacaaaatctttgatgggattagtagaatttatttgagtttaattcaactttttgttttacatataaaaatgtgtgcctgtatgttatacatctgtacatatatttccacatatatctatacctattacgtatagctacatatagatacccatttatatgtttaatctcctaagtcttacatcttagtttgcaatcgtgggattattttccagatcatagaattgtttgttatttttactaggttgttttcatgattaaaattccgtgtctccccaggtttccatgtatcagcagtgccccagaaagtgtttcccttcctgagactctagggaagccttggaatgcaaataacttgaaaagagagcctggccaaaaaaagatttttgagccttggtagggttagtgaagcaggtttttagtacaaacacaactcaaagtatgtgtgttattaaaagtagctattttcatggaagtcttttggtactatttgttttggctagagaagtgaaaagctttcttttaaccatgtgaccattattttgcaagatcataacaaacaattctaatatctttaatctcactaaagagtcactaaagttatttgatgtaccttttgaaatagaaaaccaacaactaaatcttctctaacaccatgattttctaatctgtattaaagcgttccaggtatttttgtaatgcaatggatttcaattatgttgttcattttcagcacttacttcaaaagaatgatgctttacaattttgtagttaatttaacatatttttttgtttgcttgaaagggtagaagtaagacatatcaagatttaaaacataaatagcttggaacaccctgaagagcaacatgggagaaactgagaaaagaattgaaacccatagaataagatgtctttccaagttgaaggtatggaatttttgtatgtggatatatgtgcatgtacactagtttttaaaatacgacagtcctggtaaaattgctcctatctgcatgaagtgatctaatattaatgccatattgcctgttctattgataatttcttgctttaaagaagttggttttataactgagggtgtgtctacacaggattattgattcaggcaagttagtcctaaatggctttgagagacttaaatggaagacaggatcctaaaaatttccaggcacacatactgtggcaggatttatttttctggatcaaaggccatgctcactcttgcagggtttctaacccagagaaatgtgggagtcactctccgaaaatggctcattgcacagaaatgctttgttgatttgtatgcaattacccagcaaaacaaatgttttctttaagctttggcaacataacaataatttcctgtaagaaaaatggccattttgtcagctgttctgatttttttttctatttcagagaaaattctgttttctagcttcaaagtcatttatattcaaacaaatttgaatttatgataaaccaagggatctggacatttgtcctgattctatagctagtgcctgcaagtggtttcaaaactaagacactgtcactcattttctccctatcagaagtttgttttccatttatatgtgtgttggggaaatttaaacatgtatacaaaattggagaattatgatataaatctaaaaaaaatagacttgcctgaaatggtatgttaattaagaaaaactttttgtgcttcagttttctcatctgaaaagggtaatagcaacattcccaccttataggattcttttatgtttgaaacaatgactggaatattgtaaactttcaataaatattagctattaatattaaaagcatttgtggagaaaagtcaagtggtatttataaacaagaggtctttaatttttgattgctttggagtttagcaaggttagatattaatgtggatgttaagacaaaatgctgtaagcacaagtttatcaggtaaaagtgagaggcaattgcttaatagcaagttaggtttctctgtttctctgaacttagaaatatactcattaagcaaaattcattaggaagcatgaaagaactatttttaacaaatttgctttaaactttgttgttgaaataagttgaaagggcattattgctagaagctagtaggaccagctttataaatacagagattatttagcactagacatgagtcagaatagccactgatttctttcactctgcgaataaaaccaaactagttaggcaacccatgtgttttaggggaaaagcaatgaggtcatgatccatctaatttcttttcttaacatgtaaagtagaataaattatttttccaaatttgatttgtacttgatttagtaggacttgcttttaaatataaaatctgatttataaaactaggtgaaaatagtttgctcttaagaatacactctgagaaggtttatagtgggaagagagaatatccacaaatggtattcaatataaaaaatagctagagatatggccatactatgctgtagtcaatcagttttgattcatattaagaatgctattcaaatttctaggtccttttcacataaatttctatttaggtctcacaaaaataattgataaattttggcttagatgtattgtgtggtgtgaatgtgtcccatccaaattcccatgttgaaatcctaatttctaaggtgatggcagtaggaagtggggccttcgagaggtgattaggtcacaaaggtaaagcctttatgaatgggttcagtggctttataatagaggactaagagagattcactgcattttctgccatgtgaagacacagtgagaaagatggtagtttatgaatcagtatatacagcctctaagccacaaataaaattcaaccctcccaccccctgctcccagcactgaatggacctcctcttggtcaagagccttccaaagttagtctaaaaaacaagtttaggctgttatgggaaggaggtgttggacatgcctctttataccctcctctcttttggaattcaggaataaccaaccatcattaacatcaacacagaccttaagtctgataagaaacatttatatccattctctatgaagcctgcgtatctagaggctttatctgcatgataaaaccttggtctccacaagccctgattgtaaacaggaaataattttttattattgataataactcttccaaccaattgccaatcagaacattttaaaatctacctgtgacctgcaagttcctgctttgagttatcttgaccttcccaattgaaccaatgtaaatcttacatgtattgattgatgcattatgtcttcctaaaatatataagagcaagctgtactccaccttgaacacatgtttttaggacttctctgaggctatactgtaggcatgccttaactttggcaaaataaactttctaaattgattgagacctgtctcagatacttttgggttcacaaattagcagccatgaaaggattctgagtggaggtgcccctgacctttgatgaatctcctgtgggtacttggtaccagcctgagctatccttatggctcaaactgataggacaatttgctgaggcctgggagcccccacccactccagagaatccccaatcccctaaatttggttaagatctaaaatttatttttctctacaactcctattttttagttttacttgtgtccaacaaagaaggcaagttttcctgcttccatgacaatggagcgtgggcaactcctttctggagtttcagctaatttccaacagggaaggcaagtttgagctttttttttcctgcctgtaagatggtaaacagcagtcttgagccagggtctcattcctagataagtagctgagttgggtttttttttttatctcagcgattctccttaatgactaaaaattagaattgacagccggctagtcttaatttctccttagcattagagtgctcagtaatcatattgttggggttttttgttgttctggtgtttctcccatcagatttgaccaactgtacccaacttggccaaattcaaatgagaattccaaattatgagcagccagacctctgaagctgctaaaattcctcataactgaaaaaaagaaaacaaacaaattatgcgcttggtttctgttgcagcttcctgtcttaaaaacacaattgttctttcattttcttttcttccacactatttctccttcccccttcactgtctggtaccaaaaaaaatctagagaagccatcaaatgacttgaaccccttaaaacactcagaacaaaggcatcactcaccctttctttctctgtggagtttcaagagtcatgggcagattcttcttaaggtctaaagtgttcttattcaaaggtaaattatttttgtctaattcagaggttatttaaggattatatataaaatgaggtaaaaaggaccaggaaataagagatgtaaagaaagttataaagaggtatttttggtaagaaagcttaaaagaaaagtaattttatatgagaaagaatcttgcatgatgaatttttgtcctaagataaaatgactcgttcaagaaagagaaatatttatgtcaaaccagaaagtccaagcatgttgtaaatggtctgtgtaagttgtaataaggttagtaaaacaggaatttgttaaaatgttatgtgattcagttggctacaattaaaggaaattataatagtttttctaaaaattgaactttgatattaaaagtacactcatgcaacactaaagaactggttagaacaagatttattaaaaatgttgagttactcttaatgcaaggactttaaaatttttgaattctataatctttttctttttaaaattatttagattgatatctcagaacctgtgccctactgcttcagtttttttctcttttgagaaggcctggaatggtaactctctccttcaactttgtttggctcctgtaactttttacttttattttattttttttgaggcagggcctcactctgtcacccaggctggagtgcagtggcacaatctcagttcactgcaccctcaacctcccaggctcaagaaatcctcccctcagccttctgagtagctggaactacaagtgtgcaccacaaagccaagcttttttatttatttatttatttattttgtattatttatagagatggagtgtcacatgttgcccaggctggtctcgaacacctagactaaaatgatctgtctgccttagtctcccaaagtgctaggattacaggcatgagccatggtgtctggcctttttaagttaatagttgaaactaagaaacagaatttttgaaaataggcaaatgaaaaatattttggatctgcttttgtctgtatgtctgttatagctatatgtttatatgtgtcatgtagaagtaatatttcactaccaaattatattaaagacctctaatcacttggctaaaagaaaaataagtgcttttcagactgaaggaagctaccaaagatgccttttaattcatatgaccttagtagttttgggtaagactaatctggtaaatttaatctcaaaattacctccagtagtttaacatcttaaagtcatgttatgttaaattaaataactcctatttttttcaatgggaatctgggttactaagagttaaaatagtaggagagtaaatagtgtttttggtaaaatttataaaaatacaatgatgtagcttttgctaaagaatttttttttctaagagttattttaagtaaagataaaaatattatatagataaaactaaatggataaagagagaaattaaaagatgagtgaggagaaaccttgactccagggtggccatgtggttacctatggtagggagatgcagctgagctacattcaattacaaaagataaaattcattagaatttagagatggattatgctcccgaggagttagctctctaaatgcataaggagatgcaaactaataaaaaaaaaaaaagcaaaaatattcaatcccttggttattgttatctgtaattgctaaatgaatgtacaagaatgctgggttgatccttaaggctggatcaggcccagaggtgggtctgtcccagctcaagccactagactccaagctacccacagaaagaaaaattaaaccagagcaacaaaagttacctctgagagctgtggttaccaagaagatagtcaatatgtgggaagggcaaaaccaagtaactattaaaaccagagggtataatgcaaagtaattgttccattttgtagatcaatataatcagcttcttgagaaaccttaactactttaaggaaagaatcctttattttgaaggctacaaaatgaaagagcttgtttgggttgatgcaggattcacaaatcactattaaattgctgatgagtatatgtgatccaaatgtatacgaggttattcataagagaacaacctgcctaactgactggataattgctactgtaaggtctgtttactctggaaatgggacttcccaaccatccctataaaatgccaagtggagcaccccagataatgtagttgatatgcttcatatgcaagccatgtgaaactgtctttataactgggatattctcccattgaatatgactagtatccagttcagtgccctgtaacctctcccctcccctttgctcactgtcctggagtggcactggcctctgaagtaattcttttttggtcttgggactagttcaggggaaactgggtgggggaaatccctcctgccctaagtgcagttggactgtacagaatactccaaaggccaatggtagttcagcacagaaagagggaaggcctccaagtcagaaagagctccagagacctcatggtattgtagggcagggtggtgggccaaggttaggacactgcataaaacaggcaatcccaccacctctacctgctcacgccaggagaatccataactgcctagaggcctgagacccctacaagtagtaaggtgaataggcatctatccagcctagcagtaggattgatgtctgtccagcctggaagaggggcactaggtgactccctccccttctgttgtaaatactataattatcagataatttaagttattctcatttgtaactgcatttctggttcaggccagagtcatttggtatttaaaaaaaagactgagtcctttccccatttctcttctctttcccatagattcctccacctttcaaactgttttgtatctatttcaaaggaagatatccctgagactgggtaatttataaagaaaaaggggtttaatggactcacagttccacatggttggggaggcctcacaattacgacggaaggtaaaggaggagcaaaggcatatcttacacggtggcaggcaagagagcatgtgcaggggaactgccttttataaaaccattagagcttgtgagacttattcactatcatgagaaaaacacagaaaaactcacccccatgtttcaattacctcccacaagttccctcccatgacacatggggattatgggagctacaattaaagatgagattttggtggggacacagcccaaccatataattctgcccatggctgctgccaaatctcatgtccgcacatttcaaaaccaatcatgccttcgcaacagtcccccaaagtcttaactcatttcagtattaacccaaaagtcctaacttaggagccatcaaaaaaaatcaaaagcaagttagttacttcctagatacaatggggatacaggcattgagtaaataaacccattccaaatgtgaaaaattaaccaaaatgaagaagatggaggccccatgcaagtttgaaatccagtgagcagtcaaaccttaaagctccaaaatgatctcctttgactgcgtgtctcacatccaggtcacactgatgcaagaggtgggttcccatggacttgggaagatccacccctgggactttgcagggtacagtgcccctctcctggctgctttcatgggatggtgttgagtgttctgtggcttttccaagtgcatggttcaagttgttgatggatctaccattctgggatctggaggatggtggccctcttctcacagctccaccaggcagttccccagtggagactctgtgtgggggcttcaaccctacatttcccttccacactgccctagcagaggttctccatgagggtcctgcctctgcagcatacctctgcctggacatccaggtgtttccatacatcctctgaaatctaggcagaggttcccaaacctcaattctttacttttatgcacctgcaggcccaaccaaagcttgagacttgcaccctctgaagcagtggcctgagtgtacattggctccttctgggtcccatggctgggacccagagcaccaagtccaaagactggacaagaaaaccattttttttcctcctaggcctctgggcctgtgatgggaggggctactgtggagacttctgacatgtccgggagacattttccccattgtctgggtgattaacatttggcttctcattacttacgcaagtttctgcagccatcttgaatttctcctcagaaaatgggtttttccttttttatcacatcatcagtctccaaattttcctaactttcatgctttgcttcccttttaaacataagttccaatttcaaaccatatctttgtgaattaataaaactgaatgctcttaagagcacccaagtcacttcttgaaagctttagtttgaaatttcttccaccagataccttaaattatgtctcttaagttcaaagttccactgatctctagtgcaggggcaaaatgctgccagtctttttactaaagcatagcaagaatcacctttgctccagttcccaataagttcctcatctccatctgagaacacctcagtctggactttattgtccatatcattatcagcattttggtcaaagccattcaacaagtctctaggaagtttcaaactttcccacatcttcctgtcttccgagcccttcaagcctgtaggaagctccaaactttcctacattttcctattttcttctgagccctccacactgttctaacctctgcctgttacccagttccaaagtcatttccacatttttgggtatctttacagcagcactccactctctgtaccaatttactgcattagtccatttcatactgctgtgaaaaaatacctgagactgggtaatttataaagaaaaagaggtttaatgaactcacagttccacatggctggggaagcctcacagtcatgatggaagatgcaggaggagcaaaggcatgtcttacatggtggcaagagagcatgtgccagggaactgccctttataaaaccatcagatcttgtgagacttattcactatcacagaacagcatgggaaaacccacccctatgatccaattacttcccagtgggtccctctcacagcatgtggggattatgggagctactattcaagatgagattttggtggggacacagccaaaccatatcacatggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccgtgagtattctggttttatgacaatatagttatttgcataagtttagtaagagtcttttgttttataacaggacaattggagacactgattattttaccaagtctttgactagaataacatatttgcaggtaaatttccagcaaagccaacttaaaaagagcctatatggtcagtcaatttcttgctgcactttatgcaaataatcaggccaagtataataagcctaaaacttatttttacacacaaactggtcttactataatttctctttaatagaaaaggagggctagagagagagaaaaattgtttcaaaggaaaaatttaacacttgttactggatttcagccctgacttttgtttttgaatgcagattgaatcatgaattatttcttggctataataatcctctaaagagatagcggattatagtttttctttacatttttagttgaatccctaatgagatagcttccattttccattctgacacacaaatactcttttgattgtcaaaatattaatgttatttatctctccttggtttacttccaaggaaactggaatgatggtattctcaagactagagatgcaaatctctctcatttgtcatcccactgagcccgatctgtttttcactgcaaatgcccttctgttaagactatacaagcaccctccctctaggcctaaggactgttgtggaagaggtgggtgtgtgagattgtaagggctaggtttgaggaagtgaattagttcagatcattcaaaccaaggatgggtacacgatgcctaaacagctggtaaaacaaagttttttgccctctgagctattatgaggcatcttttcatccagcccaaccatgaagaatgtcatgctatttgtagaattaaaagaaaataactactgagaggataaagataccttgtgacaaagccttctggatataagactcccagttatgagctgtgcagatagatagatatgtatttttaaagtttattttcatttatttatttctttttttgagactcactcagggtcttactctgtcacccaggctggagtgtagtggtgccatcaaggcttactgcagccttgaccttctgggctcaggtgatcttcacacctcagcctcccaggtagctggcactacaggcatgcaccaccatacctggctagctttttgtctttttgtatttttttagagacagggttttgccatattgcccaggctggtctcaaactcctgggctcaagccatgaacacaccttggccttccaaaatcctgggaatatagatgtgagccacggtgcctggtcagtatatattaaaaaattatttttcagagcaatgcttatgttttgtgtagctaattgctataagtccataactaaaaccaagattatagtagctcaatgcatagaagttaaagataagtcagttttgtaacctggcctttggctttctgtttgttgactttttactgaaaaaaatttaaggggtaatgaatacttgtccatgtccattcctatctggcctagaacatttaatttgctataagtcttttgactctaagtaccttggccatagggggtcccactgagggacagggtggatctcaagcaggcagccatgccacccccacaatggtatgagacaaaataaaaatttggtagacattgctgttgcctctggcaaatcttaggtggaagagggagaatgtaaagcaaaaataaaattctgaggaccccaaccatctgaatggacccttcctctcagccaaaggcattccaaaattaacctgaaaagcaagtttaggccatgatgggaaggaggggtgggccagacatgcctcattgtaccctcttcccttttggaattcaggaaaaaaccaaccagaactaacatcaacacagactttaagtctgacaagaaacatttacatctgttgtttctgaagcctgctacctagaggctttatccgcatgatagaaccttggtccccacaagcccttattataacccagatattattttctattgataataactcttccaaccaattgccaatcagcacattttaaaactttaaaactacctatgactgggaaccccctgcttcgggttgtcctgcccttccagattaaaccaatgtaaatcttacatgtactgactgacgtattatgtctctctaaaatgtataaaagcaagctgtgccctgaccatcttgggcacatgttgtcaggacctcctgaggctgtgttatggccacatccttaaccctggcaaaataaactttctaaattgattgagaactgtctcagatacttttgggttcacaggcatcagccaacccaaatttgttagtgccttgctcttggactttccagtctttggaactatgagaattacatttctgttgtttataagccactcggcttagggtattttgttgtagcagcccagatggatgaaaacagtatatttaatcttatttgattttattttactttcagctctgatttcttcaagatgtttttgatacttattctgtcattaattcagtaaacttgtattgggtgcctgctatttgtcaggcacttagtaggcaccagggccacaggggtaaataacatatggctcctgtatctgacttgctctcagaataatgagagaggaacttatagacatctaaatccataaataaagtacactgtaatagaggttgtaatcaagttaggcacacagtagggtgggaagataaagaatgaatgaatggttagggcttacctggggagcacagaggcaaaagaggcctcacaatggaagtaataaaatacctgagtcttgagaatgaattatatattgaccaggtgaacaaagggaagaaaggcattaaaactggaggaatattatacaaaagcactgacctataaaatggcagggttaattaacacagctacatgtagaacactgtgtctaaggacaagcaacaggagatgatactgaaatacagatgaggctttgtttaccatcttaaaaatcagagatttttgtttatgggaattactgaaaagttttaagaagtaaaatttgctaactatgtattttattaatttatttgacaaaaaattatgatccaaattagtggaggtggcgtgtgaaagagaggttggaggtagacaaggctagaggagagtaaacaggatttcaattgtctgagctaaactgttcatacatatgagaggtttcatcatacgtgtggtagttaaaagcatggatgagcatgaacttcctaaagacagcatgcatagcaaaagggtagggagtacaagacagaggcctgaaagggttgaccaaagaagagagaaagaatcgagcagttagtcagagatataggtatgcatgggggagggaatttcaggaagaaaagagagatcaatagtatcaaatgactgagagtcacgaagtaagatggtaattcagacatagcttgtggatttgggatatttgggaatcaggaagttgtttatgaccttttatggaggtagtttcaagaaacaccagcctgtagcagactatagggtggatggaaggttaaacagtctagagtctagaccattcttctaaacagctttgtggtagctagagtagctaaccatcaaggctgagggaaggtgttttgttttgtttcattttgtttttttctcaaaaggcaagaaatgccttggatatattaataagctagtggggaaacaagcaataaagggtgtgaggttgaaaatagagagaaaagcctgggcatggtggctcatgcttttaattccagtactttgggaggccaaggtgggcggatcacctgaggtcaggagttcgagaccagcctggccaacatggtgaaaccccgtctgtactaaaaatacaaaagctaaccggtcatggtggtacacacttgtagccccagctacttgggagcctgaggtgggaaaattgcttgaacccaggaggtggaggttgcagtgagccaagattatgccactgcactccagcctgggtgacagagtaagactctgtctcaaacaaaacaaaacaacacaaaacaaaacaaaaaagagagagagagaaaagagcaataacggatgaattagaatctcgaaaatgggaagaatggattcaagagcaagattggagggattttatgtacaggaaagggacaccaatctttctaaagacataggcaaattagagaaggtagggatagaggtaagtttgcaggtgaagttgctgatatcatttgctgatcatgaagagagagaatgtggctgggttggagactgagaaacagaaaaggttgtgagttaacttgaaaggaatatgtgaggtagaaaataagttgtgtgattggctcaagactggaggtgtggaaggtggaaggtgtgagaattttaagaatttgagtgtgctaggtaaatagtaggtcaaatggtctcccaggttgcaagtgtcatcagaaactgtcttcaataggaccaagcaaaaatctctatggcatgtgactgaagaccaccattcaagttgatgtaaatctatctataatttgttcattttgaagcagtaattaatctacctaactatactattaccagtatacagtgctcctgttttaaaacctcttactaaaagctatctttttaaatttaattttaaaatatgaattttaacttttcatattttcagtaaaaccatagtagctcctggtgatcacagtggttctatctgtgaactcatccctgatgttgttatggattgcatcaacctcactgtttcctggaactataccaataataggaagtatgattgataaaacctatggaaatttatagtatatatattaggcaagcagtaaggataaacagaagccaatggtccaggtgagctgattctccaaggttcaggaaagcttcccaaaataaatggagtctcatttttgtgtggtcctccatttacactgcagctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaaggtaatctggggacctattgtcctgcagagagaacttaagtatatttgctaccgaaataatgtctttgtataattctgcattctttcttttcattacagtacatgtatgaattcttttgtactttagatatcattgtagctctgaagacatgtttaagttatcagctatgtattacttagaatgactgtttgtttctatgtatgtaccagtatgttatacaatattgaggctgcaactgcctacaaaattagtctcactttgagttttcagagagaaatcacagtatgacagacaaaaggagcagactacactttacagtttcttgcaaattcaaaggttacttaagttggagacaatcagtcttatggtggaaggcattttgtcaacagacggcaagtatacaatttaaaaataattttttctacgttttcttatatttttttcctagatgtttctgttggcaataacatgtgcatttgtatccaaaacactgtctggatcttatatgaattccatgctcacacaaatagagagacaattcaacatcccaacatctctagttggattcattaatggaagctttgagattggtaatgaattatttttgcatttcttctttttgtattttgtcttatctgtggagctagtctgaattttattctccttatttgctgttttaggtcatttaatctgaccgagttataagttttctaaaactaactgattagctaagcttagaatatgcttggaaataattcatttaaatattacctcatattaacacctaaatattgccacatatcctaccattgttctttttattctaatagtttcttagttatgtagcatgagtagcagagtatttacagtatttatatttaaatatcatttgataaccctaagggatactaagggttccatctttgtatttagaagatacaaaggtagaagaccgccgggcgaggtggctcatgcctgtactcccagcactttgggaggcggagatgggtggatcacgaggtcaggagatcgagaccatcctggctaacatggtgaaaccccgtctctgctagaaatacaaacaaattggccgggtatggtggcgggcgcctgtagtcccagctacttgggaggctgaagcaggagaatggtgtgaacccgagaggcggagcttgcagtgagctgagattgccactgcactccagcctgggtgagagtgagactccatctcaaaaaaaaaaaagaaaaggtagaagacctagaagatgtagaagatattgttggagatcaaggaaattgccttacaaatgaaaatgcaaatatttttctgctatttggtctgggaggttgacaatttttttttctaagtacagagagaagaaaagactgcttttatagctctctgaattcatttcagaggcagcctctagagaaaaataaagtctactcatagattctgatttttgtggatgactgggaatatgtgaccatagagagggagaatgggggaaaggaagatttcttccatgaaaaaagttatatagaaatataagtgtcactcctttctagttttataatagcttccactttcttcaaggtgataatttcctttaatataaatgtatttaaaaaatcaggattgaggagaagcaaaactgaaacaagtgattcttgatcttgtctactagtgttcaactcctttagatcttagcctgtatcacctgtgtgctgatcccagtgagagagttagaactaactccatgtatagcccacgaattgactcagctcataatctaacggaaggtagagatgcagataataatagtattaattgaatgaagtaagtttggtagcatagatatatacaaggtcttacagggacagaagaaacacagactcatttagggaagccagactctcggaggatagctaaaattttctaggagaagaaatgaggttaagcaagtgtgaagaaaattccagtagaaaaagcctaagaaggatgcagtgcaatagcctatgtgagaagcaacattcagcttgataatattggctagccaagataaagttggaaaggattaggaatgtgagcctgcagaaatgggcaggggtgagaaatgggttaatgagagctttgtgtgcctgctatggcatttactttttaattttctaggtgagggagtgtcactgaggattggaagggattattaacctttctgtgcccaggacccttttagcattctaacaccatatgatcccggagtaataattttaattgcataaaaaaaactatatgggtgcaaaggaagccaattatattgaagtagaattatcaaaatattaaaacaaatttttatatagtaatatttgtacttttaatcaacccattaaattaaaaagttactaattttaaagtaattattgtgtcaatgttttgaattgtttgcaacagccatattgtcatctgaacatatctgtaacttctattggtgacaattggtgacaaagttatatgttcacattgcagtcatgtgagtctgaagcactggggaactatctgggctggagctattgattagcaagtaagtaggcgtttgctaaaactagagagagaatttatgaggttattcagggagaggatatagggtgataattacaatggacaaagaatagatcttgagctgcacaaacatttaaggcacaggtagaagaaaaggagtctatgttaagagaaggaatggtcagagaaacaagagggggaactaggagaaaatggtattatgaaaaacaaaggagtagaaatttgaaaaaaaaaaaaagtatcagcagtgtgaaaagcattagaaatatccagttagacaaggatgaagaactattccctgggtttcataatatggagataactgatgatctttgccagggcactaacaaatttagacgctaggaagcagtgaaggtaggagcgacgataggggattagggaggggggaaaagcggaatctatgaatatggatgaatgttctgggaagtttggagagaaactagagaatatgtgtaggctaaagtctagttgagagagagaggcttaaaatacatatgagagattttaattactagagtaagtggctgaagaaaatggcagtgccctggtgatgtgtttagtgttgggtggtcagatgggcaccacaacttctcaaactgaaggaacgtggtaaggccatcaggtggaaaactcaaatgccttcatgtttgattgccccaaatttcttgataaagtagaatatattaacaatttctaccactagtgggtggtgataggtagcttgaggagaatgatgattagaaatagtgtgaaatttacaaaaggcaataaacatatcacttagcttatatttccccagtcagttttacaggcaacattctccatacctttgaaaaaaattacttaccttttcccatgctttctcattgcaattatttcctgacagagcaaggcagtttaaaacatgaactcactcttacgtgaagaaggaaagttcttcctttcttctcctttcaaaaaacagatatggatttcaaacaatggcctctggagacactacctgtaacacggatgggcttggtgatgagattttagaaaactagagaggtcaatgtggctgatatagttattgcggtggggcgctctccatataaaataatggacaaatggacatatcttctacacacaaggcagactagagaaaaatacaggtggaaagaaaacttttcaaaatatacaccacttagaaaattattaactccttgaggaaaaaaaattttgaaatttttataatcttgagtcattgcagaggcattctttatatatagtgggggcaaggtagatattatttactgaattaaaaatgtatggtttgcaaaaaacttactcgtatatttgtttttttcaaatctttattccacactcttcaaggatctgtccatcagatgggccttcccccattagtttctttattctaaagcttcgtcctaagacatgcggatacatttttcattgccatttttattcctcaaatccagactcactgaagactgagtagaagtgggggtctactaatttttacttcactgcattgtctgatctagggaaagaagtagaaaaaaaatagatccctgtcttggtcatgttgaccaaaatgaagatatttttaaacaatgagttacaaaacattcagctacctaaatttgacttttgcttctctttctgggcataggaaaacatgataatgttctgtggagtaggcattgagagagaggccagaggtcacatgcaggctgacaccttcttttgaacctcatttcccaagtctagatagtcacaaatagagccttccaaatttcccagaaccattctttagtccctttcaccggcttctcttcttctcccctctgtaaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaattaagactttgttcatactttttaaaatgattattctcaattttttcctaggaaatcttttgttgattatatttgtgagttattttggaaccaaactgcatagacctataatgattggcattggatgtgtggttatgggcttaggctgtttcttaaaatcactacctcatttcctcatgaaccagtaagtactccagtctgataattttgggtggtcaaatttcacttgcaggaaatgaagttgcactttcctctctaggagcaatgctttccaacagcatagggcactgtaatgggaaggggaagatgcacattctgttccatctgtctatttggtgctcttggctgcctcacttccacttaagcagtcagttttgtcaatttacacaatggggatttgggaccttttcttgtggagttgagtctggtgaaaagattctcaggaccagcccaaacttgggattattcccttctcaggaccatgtaaatacttctaattaataatgagattctgcttaattgcagatcaccaagagacagagcagtctgaaggctgatttttcttttaatttttaccaaagtaactatgtacaaagtcataaaaataaaaactattacaaaaaagcttacattgacaaaaaggtctcccttgtcacttattactgctttccagaggcaagtgcttataacttttagctctttcttgtatttgccaccaatttctttcttttttttctgtttttttttttttattatttattattatttttttgagacagtcttgctctgtcacctaggctggagtgcagtggtgtgatctcgggtcactgcaacctccacctcccaggttcaagcaactctcctgtctcaagcctcctgagtagctgggactacaggtaccatgcctggctaattttttgcatttttagtagagacggggtttcactgtgttagccaggatggtctcgatctcctaacctcgtgacccgcccgcctcggcctctgtttttatttttgttgagacagtctcactcactctgtcgcccaggctggagtgcagtggcgccatctcccggttcactgaaacctctgcctcctgggtcaagtgattctcctgcctcagcctcccgagtagctgggattataggtgcatgccactacactcagttaatttttgtatttttagtagagatggggtttccccaagttggccaggctggtctggaacccctgggttcaagcaatccgcccacctcggcctctcaaagtgcgggattacaggcatgagccacctggccaagccttgcctctgtatttctaactaaatgttattctattagttttgaatcctggcataccctgctttactgcatttcactttattgcactttgcagatattacatttctcacaaattgaaggtttattgcaaccctacgttgaagattagaatcatttttccaacagcatgtgctcactttgtgtctgggtcatatttgataattattgcaatatttcaaacttttgcattatttttgtatctgttatggcgatctgtgattagtgatcattgatattactaatgtaattgttttgatgtgccactaacttatgcccatttaagatggtgatttatttatttatgtatttctttttagagatacagtgacgcccaaggtggggtgtagtggtgcgatctcactcactgtagctttgacctccacaggctcaggtgatcctctcacttcagcctctccagtggctgaaactacaggcatgtgccactatgcctggctaatttttgtatatatatatatttttttggtagagacaggatttcaccatattgccctggctggtcctgaactcctgggttcaagcaatgcgcctgcctcagactctcaaaatgttgggattacaggtgtgagccaccgtgctggtcttaagatggtgaatgtaatcaacaaatgttgtgtgtgttctgactgctccactgaccagccattgccccattttttgccctttccttgggcccccttattcccctagatacaaaaatattgaaattaggccaattattataataaccctattgtggccttcaggtgttgaagtgaaagaaagagttgcacatttctcactttaaatcaaaagctagaaatcattaagctcagcgaggagggcaagttgaaattcagaataggcccaaagctaagccacttgcaccaaatagccaagctgtgaacacaaggaaaaagtgctatttcaaggaagacacaaatgattagaaagtgaaacagtgttattgctgagatggagaaagtttgagtagtctgaacagaagattaagccagccacaacattcccttgagccagaagagcaagactctctcttctattctacgaaagttaagagagattaggaagctgcagaaggaaatttttaagccaagagaggtgggttcatgaggtttaaggaaagaagctgtctttataacataaaagtgcaaggtgaagcagcaagtgctgatggagaagctgcagcaagttatccagaagatctagctaagttaattgatgaaggtggctacactaaataacagattttcaatgtggatgaaacagccttcttcttcttctccttcctcctcctcctcttcttcttcctcttcttcttctcctcctcttcttcttcctcttcttcttctcctcctccctcctcctcttcttctcctcctcctcctcttcctcctcctcctccttcttcttctccttctcattctccctctccttcttctttcttctttttgagatggagtctcatgctgttgctcaggctcgagtgcagtggcgtgatctcagctcactgcaacctttgactcctgggttgaagcaattctcctgcctcagcctcccaagtagctgggatcacaggcacctaccaccacgcccagttaatttttgtattttttgtagtgacggagtttcaccatgttggtcaggctggtctcaaacttcagacctcaggtgatctgtctgcctcggcctcccgaagtggaaacagccttcttttgaaagaagatgccatctcggactttcagagatagggaggagaagtcttttcaaaatattactgctaattgacaatgcatctagttgcccaggagctctgatggagatgtacatggagatgaatgttgttttcatgcctgctaacacaacatccattgtgtggccacaaatcaggagtaacttggactttcaagtcttattatgtaagacacacagtttgtaaggatattgctgttataaatagtgattcttctgatggatctaagtaacataaattgaaaaccttctcgaaagaattcactattctacattccactaggaaaaggagaggagggcaaaatctcaacattaacaggaattttgaaaagttgactcaaatcctcttagataaccctgaggggttcaagatttcagtgaacaaagtcacaagactttagtggaggaagtcactgcagatgtggaaagagaaagagaactagaatttaagatggaacctgaagatgtgacttaattgctgcaatctcataataaaacttgaataaatgaagactttctgtttatggacaagcaaataatgtggcttcctgtgatggaatctactactgatgaagagcctgtgaaaactgttgaaatgacaactaatgttttagaacattacacaaagttaggtgataaggcagcagtagggcttgcaaggattgactccaattttggaagaagttctactgtgggtaaaatgctatcaaacagcattatgtgcggctgggcgcggtggctcacgcctataatcctagcactttgaaaggccaaggcgggcggatcacgaggtcaggagatcaagaccatcctggctaacacggtgaaaccccgtctctactaaaaacacaaaaaaatgagccaggcgtggtggttggcacctgtagtcccagctactcaggaggctgaggcaggagaatggcgtgaacccgggaggcagagcttgcagtgcgccgagatcgtgccacttgcactccagcctgggcgacatagcgagactccgtctcaaaaacaaacaacaacaacacaacagcattatgtgctacagaaaaaacttttgtgaaaggaagagtcaattgccacaggaaacttcatcactgtcttattttaagaaatttccacagcccccacaaccttcagcagccgctaccctgatcagccagcagccatcagcgtggaggctaaagcctctaccagcagaagatgatgactcgctgaaggctcagatgattgttagcatcttttagcaataaaacattttcaattactgtgtgtacattgtgtttcagacataatgctattgcacacttaataggctacaatatagtgcaaacataacttttatatgcattagaaaattaaaaaaattcatgtgagttgctttattgtgttattcactttattgtggcaatctggaaccaaacgtgcaatgtctctgagatatgtctatacattagtgttacacaatatgtattgaattcctactataaaatcatttttactatttacatttgtataattatgtaaatcttttttaccactgaaccatgcgcttatcattctttacttatataactttttattttccctagatttaataattacctcgttatatcatatggttagctttctttgtattgttcacgaattcatcaccaaattctccactggtagggcaaatgtctcctcaatattcttatccatatcacagtgtattatttttgtcttggagattcctcacatatcactttcaattctccatctgcaatctgaacttggaattctctaggcctgctgcattgctatttccttggaattttctctcattattatccttgagaatttgctttttacctgtttcatacattcagttattcattttctgggatgtcatgtctcctgctttcctctttcctcttcacttgtttttgtgaaggaaataatctagtagctttccaagaaagtatacaagagaaatataaaatgtaagactttgtatatctgaaaatactcctattttactcccatatttgattgttactttggcttggataaaattctagattggaaatattttccctagggattttgaagacatttcccccaatgttttctagctctatctaacacttgtaatcaagtgttattattcagaatcctatgccgttctaatctctgtgatcagttttctttcagtggaaactattggaattttcttttaagctccaagtccaaaattcatgataattgtcttggtataaatctgtctcctccattgtgccaggagccttcaatctggacatttggaaaagttacttttgttatttctttgataatatctcccctataccttctttcataacactgttttctctttctagatctctattacttgaatattggacatcctgtattaaccttatgtttttctcatcttttatccctacttttttgtcctcttgtcttcttgttactttctgggagatttaactttattttccatgcctttgaatggctttctagcttatgctaccacatttttaattttcaagggctcttattctttgaatgtccctttttaaggaacatactattctttcaagaatgcattatctcttcccatctaaattttgttcatctttcttcttggtctctggctcctccaagtgtaccgtttttttatttgtttgtaactgtctttactgttacagacttctctcatatatctggtggttgtttgttatctattcacatttaagagggaggaataacaacaacaagaagccagctggaagttctgtaaatatgtgtaggacttggttaaaggaggacttctttgtagagtcattacgcagggactggctgtttcgcacatggctcagaattgcagataacctgttatcctagacaggaattcttcaatctgttccttgggaggtagaagcttagctaccagccaaatggaagttggaatctcactgtttaatatgtagatatgtagatttttttaacttaatacccccaatttttttgtattgcctttctatgctcagtgtgcctctccagactctggagtcaatgaacattttcagctggagtggcaggggatgtctctgggagttgaatgtttcttaaacaaactttaaaccaaaatgtttgcactcttattgttttggatcatactcacttttgcatttaagtatcttgcctgaatgttcctgggctttgcagcattgcttccttgcaggcacttagagttgcacttctcatatcttttatttcagtgaccactcagttacctgcttttccattttgaaaatcttgttgagctctcttttattgtaaaattccctattttttttatccttgtggaatcatgcctttccccattctgtttgaaaatctatttaccgtcattttgctgatgctttgggaatgaatagactttgagttactggatttttagtggataaattaacaaaacatattttctcttttaaagtatttttgaagggatcagagtttctaagcagagtctttccttttcttttatttcctagcctatccaaaacaatgtcaagtaatattcagccactgtatacatttctttctaccacctgccaaaggtgttatttccttgaggttgtcatgtctcataggattgtgagtatggagacagaagcctttgtctatagttcacagccaaactctttgggcatcaatgagcaattgttctaaggggaaggtattttgagcctttttattatatcctatagcacagaaattaagactatcagtggcatccaagcataacactctagcttttgtagaactcagaagggcaagttttcttctgactaccttatttaatagaaatacagaaaacaatccagcattatttctaacaaacagagacttcactgaacatactttgaacatactttttttcccatcttacggcatgtaatttactttctgaggaaaagcatgtggatcttgtggtaatttgcttaaattaaatggtcatagtttattaatccatttgttcttatgagaagagaaaaagtcattacattatgtgtcatggtgattgagattctcttaaggcctctcattatgatggacaaatattttggtttttttaggggtttatgaaacgcatggaggagttattgtacggtttctcagaaactggaggtttcgcttcttttgagcaaactttagagaatgccaagttgaaggcttgttttgttgttattccttccaaagcatttatcttcttaattatgcattattgaatgtcacattttttaaagtttgtgttccttatctcataataattatatccaggaaatgataacctaaaaatcaaagaaagttgatatttgataatctaaaggtagatcatccacaggcagattattgaaagctaagtataaaaagattgttcatttacagaaagtggcaagttttttgatgatattaacttatgataacttggatgccaaggatgaaaagccatttttactggatttggatattgtgttgtatgggaagcagaaggtaacaatctgcacattgcccacattgtcctcattactttcttaaaataaactcattttccctgtgtttatacagatatgaatatgaatctacagtttcagtttcaggcaacttgtcctcaaacagtttcttgtgtatggaaaatggaacccagattttaagaccaacgcaggatccatcaggttgtctacttcattgtattgatttttgttcagcgaacttataactaaacactttctgctgaggggcttgaatgagatattgattgagttagataaataaacaaagatatgttctctctccaggaacttccaaaggagttacaatgggcaataagaatagctaataataaagaatgttatttttcttatatttgaatgtatttattgagagttccttgtttatttattaacatgttatctaaaaatgagtcaaagggccgggtgcagtggctcacgcctgtaatcccagcactttgggaggctgagacggatggatcacctgaggtcaggagttcgagaccagcctggccaacatggtgaaaccccacctctattaaaaaatacaaaaattagccaagcatggtagcgggcacctgtaatcccagctactcaggaggccgaggctggaggatcgcttaaacccaggtggcagaggttgcagtgatccaagattgcgccattgcactccagcctgggcaacagagtgagactctgtctcaaaaaaaaaaagagtcaaagacatctatccaaggaccactgttaagttcatcccacagaggaaaacatcttataaggatggatttatgctgatgatttggtgtatatgattatgtaaataggaactagagacagaaacaaagttcaagagatttgtgttctatcactgatctttaatagcggggaaaacaggcaagtacgctatagttctgaattactctattccctttctattgacttaggaacttgtctttctgctctttttttttccccctctactggagatagtgctttaaaattctacacaatagcagtgcttctttcagcttctggtagccctaggcaccaatgtactggcttctgccccttctgtcccttctgctaagagacttgtataatcttctggttatacttggtctggagatgactctgatgactcaacatttttatggggacatttttattctggattcatgttcgtggaaattgcagtagtccacaagggtgggaatttcatgaccatcattgagtcaggaaaccaaaacagtttcaaaaatttgaaaaatgtctgtctcagaagaagccaaagaacccccatgggggaaacaaaggaaaacaatgacattaatagtggcctgtgttctcttcctgagcgggctattgccaaagactgacccaggtgctagtcggcttcattgtggatatagcaaaaccttcccattctggcacatctccaggaaggtggattgatgctttcaattttgccctagaataggcctagagtttgcctgtgatctctagacacaaatcactttgtgcatcacacaaacaaatctgaatacctagaaatagagactattattttccgactggaaataatggagagatagcactcacaagaaattcctggacccagctgtggtcaggacctcacagtctcacctggcaaatttataggaggtgagagtgcattgtccttcagatccctgaaaacgggactccacagagcttcctcacagcttaccagctattttggcttagaacatagatggcaaagagatttacagaatccttcagagatctccctatctttctcagtttctattccctttggtctagtctttgttactctactaagcagctgcggctccaaggattggagtggatttctgtattgaaagttatttggtggttacagtatacaacatgctctatagagaacctatgatgattacccaattaaatatttttagtttctatgaaataattagagctgtagagaattcacactttagcgaacttttgtttaaatcttataaatatagtaccaattctagagaaatatatttttgtctccccaaagttgggtaggaatggggaagcacttgtagcagctgaatgagtccaggagttgtggagaaactgaatctctttgatttttaatgtttgccaatttctgtggtgtaacactgctatgaaactaccaatgaggtgtcactgaacactgagttgggaggaggtgtgtatactcatctctcccaactcagtagggactggctccagcatatcacttacacttgtccatactcaagtccactgtcagaaaatgcactaggggtgccctgagaagtcactgctggaatagtaatataaatcattgacaaggggccatggtcatataactgtgaaatgcctacagaaaacatagaattaatattactgacactttatcgtcaaagcactaatgtcatgtcttttttttttaatgcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattggtaagtatggaaatctaccttagcttcttttcagggcaatatgttccttgaggttagaaattagttatatttttgtagtcttagtgatttccacaatgatgagtagagtatcttggcacagttggccttccataaaagtttgttgaatggagatgagatatgctaaatgacaatgagctacttggttaataaatctactttctactattggaaataccacaagtctagtgcccctggaggtgaccctttcatctgcttggcactacactacatccaatctgttaagagatttgcaaatgttttctctaaaatgttctgtgcattcaaaacctttctcgctattttcactacctctgtttttgttgaggttctcattactttgtctgtagtttctctttattattttctcttcagaattttattttctcagtttttaagaaacattcttgcaatataatttttctcaagcattgttttaatcatgtcttctctactatatttatgacacatataagctcctcatttattaaatctgatctgtccacttattactcatggctctgcatgacattcacttacttagtttctatacagtttctcttcttaatgatctctccatatagtcaggcttcttcatatttttcacaaatacgtcttcatctttttgtttatgtttcttgaaattaccattttaaaatccatgtaggtcacctggaacaatagccaacttaagacccaccttcttgtgctgccttccaatctctgaaatattcttaatttattatgcacgacttgcttatattttttgttattctatcaatagttggtcataaactcataacgtttagtatagggacattttgccattaatgtatgtaggcatatcttttaaaaactaaaaaagtcaaagagggtgagagaagatggaaatgattacacataatccagatggatgaaaatattgagggatcattaacccaagtgacttttcacacattttggcaactcattaattttgcaataatctttttcagtgattttctattcagtccttttaacttccttcacaaacttatattaaaagaatgcaaacactctcctacaataaattaacaaacaccttgctatgacatctgtttctttattcaacaaatactatggtgtattatatgtaaatgtagctgtgataatctctatacatattaaaatgaggatgatgtggtccatacaaggttagtaaataaagaactacataattattagtactatatatatgtagtgtgtatatatatgtatatacatatatagtgtgtgttcatgtgtgtatccataaccaaataactataaatcaaatagctctacaccaagaaaacagttccatatggctctggagtttagaagagaatataaaagctaggttaaaagttggaaaattgaccaggtgtggtggctcatgcctgtaatcccagcactttgggaggctgaggcggacaaatcatctgcagtcaggagttcgagaccagcctgatcaatatgatgaaaccccgtctctactaaaaacacaaaaattagccgagtgtggtggtatgcgcctgtaatcccagctactcaggaggctgaggcaggcagatcatctgagttcaggagttcgagaccagcctgtccaatatgataaaaccccatctctactaaaagtacaaaaattggccaggtgtggtggcatgtgcctataatcccagctactcagtaggctgagacaggagaatcacttgaacccgggaggtggatcacttgaacccgggaggtggaggttgcagtgagcactccagcctgagcaataagagtgaaactccatctcaaaaaaaaaaaaatggagaggtaataaatgaaatcaagagggagaaataaggttgctgtggaagaacatatatatactgagagatattaggataaaatactgggaaagacttttacttagtaaatagaataggagaaaggaaaatcaaagaaggaatagtcataagaacacaatgaaacaatacatgtatagtttaatgaaactctcaggaagaaatgtaaaaagaggagttggccagcaatgtcaaataacctagaaagctaggaagatgaagaccaaaaaaagacactaaattagtgacaaagagatcactggggctacctgagagtatttggaggagaatgtaaaaggatttgagtaaagtgagtgagaggtgaggaagtagaggcagagagtatagtgaaaggagagaaagcagggtggatttgagattttgtagaatcattggctacggggaaattgaacgcgcacaagagagggagtatttggtagagcaaaaccttagagaagatagaaggggttggaaccaagaagttaggtgtgtatagggcgggttctccaagaaccatggagaaggcagagataataggcaaagccaaattttgaagtgaacaggaagaaagttgaagaagctcgtgtctggattttcagagatcagggagggttcagcataggttctgaattgtagacaagtgatgagacagctgatgatgaaattttaatggataagaattcaagtgaagacagataggactgatggacatggaaaataaaactgtggaagtaaaggaaggagaacatgataaaatcaaagacttgtatcatataataataatgaggacatagccagaaggaagtttcaagttgcagatctgagagtgaaacttttttgaggaatgtgccatgagaaatccactataagatggtattgctttagaattcctcccaaaacatgcctgtgggatgaattaacaggaccttggttatatcacgacctagtcaatggcatgatcccagctgggactgcctgtgctgttacagcaaatctctacctgtgacccagcatgaaagggaatttggaggccagggaaagtggctttaaattatgaggcttctttttcaacatttacagaaacaaccatcatttatatgtacatcaagcttaacttcatataaattgtgtatctagtcaaaagtatccaaggcaaaaatattcaatcttcaggcttttcatagacctagaactctttatgtgggcatataactgtactataaccttatacttttatttatttttagggcttgtagaaacaggagctattattggtcctttgattggacttttgttggcatcattctgtgcaaatgtttatgttgacactggatttgtgaacacaggtaattcaataaaatctatttgtacagtgtctagactatacaaagcatctcaggtatgttatcatatataatcatggccttacttgaccttcaatttgataaatgatctctactttaaaagtgagaaactctagtggaggaatttaaataacttttaaaatattccaaaccagaaagcagtagtgcaaaataaaatgctaatctgacacagaatcacatgctatttctagtgcacttcaactatatttcttggttttacaaaatttaagcatgtaggtttgaatttatttcaattaagcaatcatttgttgatgatgaaatagaactttaagcaatcatttgttgatgatgaaatagaacttgtagctgtttagttaatacctgcttttaaatcccttacatgatagacagataaccagcctaatttattactagacaatattacaacaccacatattattagaaaaattttatcagtgtctgaattataagccaattttatagttggttgggacccgataattctaattttaataattttctatagttcatacagaaaatactgacttaagctaataacagtgtgtgtatttttttacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaaggcaaatatacatattctaaatactatgaaattgaccttttatttcatatagatatgtctgtattttagtctaacactatgatatgctatgctgtgttgagacaatttgtcatcaacagtcaccagtcaagaatacctaactagtccgattcttcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatatatctacacacatatatacacatatatatgtacacacacacatatatatatgagagagaggagagagagggtcatgtatatatatacacacacgtatatatatatatacacgtatatatatatacacacacgtatatatatatacacgtatatatatacacatatatgtgtgtgtatatgtgtgtgtgtatatatatacgtgtgtgtgtatatatatatatatatatacacacgtatatatatggtcccatttgctcaaaaaaccgattttacagagaacataggttgaattgaaacaaaatgaacaagcaaatttaaactaagaacaaaagtaggaaaaagtatactctaatcttaataggtagtatagttttgtaaccagtgtgttagtttaacgaagagcttcctggaagttaaatcagaaagaaaaaaaaaaacatgatcggtgacccacctctctatacttggtagagggaagaataataatttttaaacagaagcagttctccaaggaagaaattgtaaaaaaatttaaaaatgatcataagatacatgatacaggtaatattgagccacatagtggttttccagcaaatgaaagggtaaattgcatgtaacattttttttggtacagaacctcaataaaagctcaaagtataatttacagaaggtttttctgtgggaaactaaactaagatagcctaagtatttagtactcaagagcactgatgctcaaacttggctgcacattggaatcacctaggaaattttaaaaatgattgatgcctgaaagttctgtagtattcccaaaaggtcagatttaattagtgtggatgtgcagcctggctattggaacttaaaaatgtttatttgacggatggtgagggtctcagttttctgtcaaatggggataataatagtacttactatagaattgttgtgtgaaggtaaaagacattctagcacacattattattaatactgatactagtgttagtacttttatgttgtcattgttgtttctatcatcacccataagttacaatgtcaatttgcatagaatttttcttaacaattgtaaattctcttaaatcataattgagcataatttaatacatctttggtcattaggagccaactcagaatcttgcaaattctcagaatcattctgatgatattaaaaactcttcttaaaggattgttatggactgatagacctcttgcagtctgcaagatcagttccattttcaaaattaggaaagagcttagcttgttgcaagacatagaaaagaaacttgtgctactgaaactcatctattaggacagggatgtcaacaaacatgggtgacttaaaaatcttcagataactctctctcctgtcaggtaccctattcataaatataaattttacaattataactcatttacttgcattaatctgtgtgtcctcctcttctaaattgtttatttattgaaattttgttccagaatgaattgtgagcagtttattaagcaaaccaagattgtgcataagaaagtcaagacagagaacatgtggacaggaaaagtgaaaggaaattaaaagtgagaacttgagcctgaatggtagcagtgtgaccaagaacatttactagaagcaggccacacattactagaggcaggccacacattactagaagcaggccaaacattactagaggcaggccacacatttggctctgtgctttttctaacaggaatcatttttgattaaatcatttacatagtccttagaatgtaccaaatgaatcagcatctctgagggtgggacctggatgttggtattttaaaaaatatctccaggtagatcttgctgagaaccaatggcagaaccactgaaactgttgttctgaagaagcaaaaaaaaattccggatacttgagaacattcatatctcattaattcccacacatctttatttcaaatgttcagggagtgataaaataaatatttgtgtgaaatcttctttatcaactcgattttcctccagactttacagaacagaacaagcatctttcattctaatgagctgtagaaaaaagaatatattaatagaagaacaaaaggttagtaataaaatgctgtggacgtagacaatattttggtcactttgtagttttgcttactgatctttaagactcaacagtgacttattgagggcaaaactgttgtgttctgatccctacccagtcagctacatcactgacttccagaagccaccaaaacattgctatgacttcagctttcaaggggaaaaaagaattagcaaacaatacatattacaaaatagtaaaaaacataatttgttgaggaggtggatgtttcaggaaaagccagtcacaaaatgcaaagccaagttcgtttgacacagttgtcattctttcatttcagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatgtttgtttttctctgccttactagcacactttcccccccacgaacagtgtgatggcgggtgtagcaaactcctaagttgaagtgttttaggatattttttgactctggtggatttcttccttctaatctcaagaaagaaagaaagaaagagaaagaaagaaagaaagaaggaaggaaagaaggaaggaaagaaggaaagaaagaaagggtagggaagggaagaggtcagaaataccttgattttcttctctctgaagtcagaatgtgaattcataatatgaatgcaaatatttgggagtgcaaaaattacatattttcagataggattgtgcattttactaccaaattttactctttttggttccagttcaaggattctatgttcctcctaatttaattttttggtccccctagtggttttaggtgtctctgcagccacacacattcggcttttcctgcaaccacactaacctcagtggttttagcctaacttgggtttttcctgggatctttccactgtttttaaaagtcaatatcccaggctacttgtatccacactacctaaagtgcttgtgaaagcttcaaatacctggggttccccctcagacacactgaatcagactctagggcgtggggctctggaatggatttttaacaagctctctcaataatatgattcggggagccagatgctcacattgtatagatggaacctagggctatcttctcctttttctattcttttttttcacttattgggaagggttcagagaggaagagccagtagcagcaagacatgaaatgtaaatacacttgacagcaacaggctcagcaaagtgactctctaaagtaccttgaactgggtgtggtggctcatgcctttaattccagcactttgggatgctgaggagtgaggatcacttgaggccaggagttcaagaccagcctggacaacatagcaagactttgtctctgcaatttttgtttttaaattagccaggtgtggtgttgtgcacctgtagtcccagctacttagagggctgaggtgggagcatctcttaagcccaggaagctgaggctccagtcagctatgatcatatcactgcactccagcctgggcaataaagcaagattctgtctctaaaaaaagaaaagaaaaagcactttgagaggagtctaattcttcacaaccaaagtgaggataggtaactgaaaaattgtatatatatattctcactacacagaatagagggtaataaatgaataaattactggccaattttgacttgccacttctacctggatcctaagaaaagagatttttatcatgatctctgcctataagaaattcacaagctactgcaatgagttaaatgaatgataatataataacaagagtctcccaaaatatacttccccattatgggggcatttcaaaatctccctgtgggtaatgtgtaactaagtggggataaaattaaatcattcttcttcactatgagttggacctaaatagttacttatataaggcatattacataaaagtgataacatatttgttcctttggtaagtcattttgtaaataatattttatttgcatttataggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaagggtatgttgttttctaatgaatgtgagaatctttcaacaaatggttaatatgatattttttacaatggcaatgcacgatcagatcattttcttattggagttaatgatagtaatccatgcttttcctgtatctttcctccatctgtcaatcaagccaatctatccaagctctaggcttattaatgaggttgggaacatatcacagggtgagtgaatttatgattgtatgtgcatgtgggtgtgtgtgcatgattgtctttgtgatatccgagtagacattatcctatgaaagaaactacctacagtttcaggttgtattaaaatatgttatccatatatcttatactcccataactgagtaaaactaagagttgattatacagtcaaaatggcctttatatgtttccccaatgggcttaagtttggcataactaaatcataatacatgataaattaattaatacataattcatatatttcatttatattgctatgtctaaaatattgaatcatttcatattttgtattttaaaggttatctgggttttactgaaatgttttccatagtgatgtacattaaaagaattcacctgtagggcgtattttgacaatcaagctatcagttaaaatgaaataaagaacatcctaaaatgttttttcaaaattatcaaggtttattagattgaaataatttcaaatgtaaaatagtaatataattttacatatgctatttgatttgagactcatgagcttcatctaagataagcattattatctccactttacagattaaattgagattcagagaaatttaatgataaaagcagttcatttcaaatctcttcaactacatcaatatagaaatggattttaaaattggaataaattttaaagattgcctccatctccaatgatgctgattcccagacagaatgtgtagaaagtcgcactgtgatctagtctgaatgcagtctctaaactgctatgcaagtgctctttcaatcatattacaagcactggtcactttttatattagtagaatgcacttctttaattcaaatacctatgtttctggagctaaatgtattatctatattacaaatggaactttcagatttttatcttcatgctagtcctgtcttgctatttgctacctaatggatgaatcacagagattagttcatcttcatctttcgagatctaatagtatgtgaaaacatgactccacatggtaggtgctcaattaatgcttgtttattgcctatatattcttctgagataaatcattgaaggagtggctatgtggtcatcaaagcaggtctcttttataccaaagctatagtaaacaggtcacacattgatgactggaaaatttctctttctattcatgggaggagaggaaatctaactggggattgagatgaaaagaagaaaaaaaggattgaatcctcttttaatatctatggcattattttaaatcacttcagaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtaagacatcctatttgacagaacttttttgagttgcattggtacttcccaactatgaactgggcctatatttaataaaagtaaaattagtgtttcctcaaaaccatattactttttttgtatgtggaaaaataactctatgatggtcacttgattaccttttatttcccagatcttatgtgaaacctccatagcatctgaccagtgatctgaaatttccaagaagtttatattattactcaaataatttgggttgtaaatactctggactaaaaaaattttatcattgaaataaagttggtggttttgatttcaattgtccagctaattgctttgctatatatatatacatatatatatacacacatatatatatttctgtgtatatgtatggatgtgctttctgtgtttttcacattctgacagttctttgagaatttagaattaggaatgttctcttgcctctaagatatcacaatataatataacatcaattgtaatattaatataacgttggttggtgatcaaagtaaactataaattttgattcttattaagacctggaaacatgtaacaattcaaaaaaggttgacaattctttttttgaaagaaactatttcttttcttttcttttttttgagatggagtctcactctgtcgcctaagctggagtgcagtggcatgatctcggctcactgcaacctccacctcccaggtataaacgattctcctgcctcagcctcctgagtagctaggatgacaggcacatgccaccatgcccgggtaatttttgtatttttagtagagacgggatttcaccatgttggtcaggctggtctcgaactcctgaccttgtgatccgcctgccttggccccccaaagtgctgggattacaggcgtaagccactgcgccctgctgaaataaactattcctttgaagcaaagctttatttgtaagcatctaaatatttcagttgagcactctgaaacagattttgtttgtccaatgtagtgttgtatcaaaacactgttttaaaaagtgtattagctgggcgcggtgtctcacacctaggaatcccagcactttggaaggcagagaccggtggatcatctgaggtcaggagttcgagaccagttggccaacatggtgaaatccatctctgctaaaaatacaaaatgtagctgggaatggtggcaggcgcctgtagtcccagctaccccagaggctagggcaggagaatcacttgaacctgggaggcagaggttgtagtgagccgagatcgcaccactgcactccagcctgggcgacagggtgagtctctgtttcaaaaaaataaataaataaataaaataataaaaaagtgtgtctttagggtaacttattagttattacaaatttactattcatatttagaaaaatataccgtttttctgaaatcacccttccagttttgttatatggtgtaatcttgagagacatcataatggagatggagtaaagggaacaagcagtctccatcttgatccaactggctgtgtagaaaatgtttaaaatttgtgttcaagatttttacttcttagtataatatgttattttttggcaggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtacaaaattattttctttatttatatttttttggggtcatttattaaggtagcttgttctaagaaagtcactcaggactcagtatctaagaactcagtgctctaatgtaccatttattaagggttttgtattaagcattgttggatttcacaaaattttaaagttagcaatgcacatgttcatctgctggcatttcactcctattcctcgctacttttcttccttatttcttagagttaaatgagtggacctctcattttgtgacaaaagagacacatttatatcttagggtaggccgtataaaatggccattttgataggtaaagagtgggtgcctagcagccatttcctagggttcaacctataggacagcagtgcaaagctgtcagaagcccccatctcgctaaggtcacttgatctttctgagctccatttttctttaataataatgggcataataataaatacttggctctcttacaaggctactgtgagacatcaatgctgaaagactttctaaaactaggaaattgcagagccagttttcaaatttaggtatattaaataaatcttctttcaactacaccagtctttgtgcctagtaaacaatcctgaacataatttgcattttttctctctttttcttcttcttttggagctctaaagtagagttcagttaatcacaatgctcaagtcataacacattatcatcataggccagtgcaaggattctctcttattttacttcatttatttatttatttctattcaattccctacttccagtcaccatagctgctcacttaagtatgacagatagatgtcttaaatatgtatttcctttgtaaaatattagaattttttgtgtgcatctgtttttatattcacaacaatggtggtgtggtgttaagtcttgttccgattcataaggtagatgcatagataaattcaccagtcctatttagagtaatttttatatcatcactgcatgagagttagaattatctaactttgtgatgttgactaatccaatgggtgtaaaatactaatgatagctcattgatgtgtcaatatgtgatgtcctgatacactgagcttaagcatctcttcaaataactttgtagctaaaagttattcatgatgcttattcaatttattttacccactttactcattatatttcctgcatcctatgtttttcttgatgaatttgatgattactatgtaaattacagatattaatgtaatactgtttatatgatacaattatcttcacttagtctgtcttctttcttttaacttttacagtgccatttatgaaatgaaatcctaaattttgttgtactaaaatctaacaagtttcttaccttagtgtttgtgtatttggaagagaagtcacatttttaaaattgcttccacatttctaacttataaaaatattcccttaaattttattcccccctggctttcccgctttaccttttgcatagttttttaagccatctcaaatctatttttatatgtggtttaagggacatagatatccagtgttatttttctccgaataataaagttgttttccaaaatcatagtgtatataatacgtcctttttcctttgatttgtggtgccaccatctcaagtttttataattagtgagtctatttttcatccttattctgctccacagatttatttgcctgttcccataccagcgtcaccttgatttaattactttggccttgcaaatgttaatatctcatatggtaactttgcctcacccacctgccatcttcacttttcctttattctttctttctcaaacttattttgctgtctgtggatctttatatcttcataagaattttgactgagtttgtgtagattccatagattacttggagaaaatctgacatcaaatatttttgaacatgtaatatcctgtcatttgcttaaatattcctttgtatccttaaagttcttaaaaatttttcataaaggtgatgtgccattagattgcttcttaagtactatatataaatatataaattatatatgcacatatatacatatatatgtctctatatgcacacacacatatgtacatacagccacacagatacatacacacacgcatacatacacacacacacactgagaaaaacaaacggtttctctattcaaacagaacacttctgatagccagatgtgtgtattattttcctacactgttcaattctgcaacaccaactgggtgttctactgttccatgcaattctagtgctatctgcatagactttgcatcagatggcaaaagttaaacggttcagtcctacaagactgcccccactttagatgtcaatcacaaaatcacaagtccagacaccctgggctgcttttttttttttttaccctgggcttctgactgacaaacgatgcattaaggttgatgcctccattttctagaatggttcacagaactcagggaagaaacacttttcttacatttactggtttattatgaaggttattataaaagacacaaatggaaaccagggtggagttggggtgtgccactctcctggcatgtggatatgtttaccaactcagaagctcatcaaatctcctagttcaagagcttttagggagcttgatcttcagcacacacatcccactccattctcctggaggtctgagtgtggggctgagaattccaatcttctaataacttggtctttctggtgaccagtcccaacatcagtctgggaggccaccctgtcgtctcattactatagactcaggtgtgatcaaaacaatctccttaagaatgacaaaatacattcctatcactcaggatgttccaagggaattctaagaactccaaggacacgtgtcagaagctagggacaaagaccaaatatatttctagtgatgccatacacacacacacacacacacacacacacacacacacacacagaatggtaccattaccatcacaaatgtacaatatacatatatatccatctacatgtaaatatttgtgattgcaaatatatagagatatgaatatgtatatgattttaaactgatttatatttgtattgattttaaatatatttaaatttatatttgtattgcttgtaaataattgtgattatcaatgtgattgtacatggtattttgtatgtatatgtatatatgtgtatcatttccccatatacaaatataaattttatatctagattataattacatagcatataattaaaattatacataaaataaatcagaagtaaaaattagatttaaaaaattaatcatatataaatatagtttttttaattttaaatttttatgggtatatagtaggtgtatatatttatgggttatgtgagatattctgatacaggcatgcagtgtgtaataaccatattagggtagatggggtatccattccctcaagcatttatcctttgtgttacaagcaattcatttatactcttttagttattttaaaatgtacgagtaaattattttccactatagtcactctaatacactatcaaatagtaggtttaattcattctttccattttttcgtacctattaactatctctacttccccaccacacccaggctaccctttccagcctctggtaacaacccttctgctctctatctccatgagttcaattgctttcattttttcttttttttctcagatggagtctcattctgttgtccaggctggagtgcagtggcacaatcttggctcactgcaacctccgcctccctggctcaagcgatcctcctgcttcagcctcctgagtagcggggactacaggcatgcaccaccacacccactaatttttgtatttttagtagaaacagtgttttattatgttggcccggctggtcttgaagtcctgatctcagatgatccatctgctttggcctcccaaagtgctgggattacaggcatgagctatcgtgcccagcctgttctcatttttagctcccacaagtaagtgaggacatgcaaagtttgtcttttggtgcctgccctactttacttaacgttatgacctccagttccattcatgttgttgcaaatgaaagggtctcattctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttgaacatttgggttggttccaagtctttgctattgtgaatagagccgcaataaacatacgtgtgcatgtgtctttatagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcaatttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaagtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccgtgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcaaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcatctgcaaacagggacaatttgacttcctcttttcctaattgaataccttttatttccttctcctgcctgattgccctggccagaacttccgacactatattgaataggagtggtgagagagggcatccctgtcttgtgccagttttcaaagggaatgcttccagtttttgcccattcagtatgatattggctgtgggtctgtcatagacagctcttattattttgaaatacgtcccatcaatacctaatttattgagagtttttagcatgaaggattggtgcattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaaactattgattattgccacaatttcagctcctgttattggtctattcagagattcaacttcttccttgtttagtcttgggagagtgtatgtgtcaaggaatgtatccatttcttctagattttctagttttatttgtgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattaattttttgaagggttttttatgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagttttacttcccagtatgtggtcaattttggaataggtgtggtgtggtgctgaaaaaaatgtatattctgttgatttggggtggagggttctgtagatgtctattaggttcgcttggtgcagagctgagttcaattcctgggtatccttgttaactttctgtctcattgatctgtctaatgttgacagtggggtgttaaagtctcccatcagtattggcctgcgcccactgtctggcactccctagtgagataaacccggtacctcagatggaaatgcagaaatcacccgtcttctgcatcgctcacactgggagctgtggaccggagctgttcctatttggccatcttggctcctccccctcattcttttttttatggctgaatattactccatcctgtatatgtaccacattttctttatccattcatctattgctggacacttaggttgcttccaaatcttgactattgtgaatagtgctgcaataaacatgggagtgcagatatctcttcgatacactgacttcctttcttttgggtatatattaatacctagaagtgggattgctggatcatatggtagctctattttgagttttttgaggaacctccaaactgttctgcatagtagttgtacttatttacattcccaccaacagtgtaggagggttccctttactctacatactcaccagtatttgttattgcctgtttttgtataaaagtcattttagctggggtgagatgatatctcattgcagttttgatttgcattcctctcttgatcattgatgctgagcaccttttcataaaattgccatttgtatttattcttctgagaaatgtctcaaattttgctcatttgttaattggattattagattttttttctatagagttgtttgagctccttacatattctggttattaatcccttgtcagatgggtagcttgcaaataatttctctcattctgtgagttgtctcttcatcttgttgtttcctttgctgtgcagaagcttcttaacttgatgtgatcccatttatccatttttttttcattagttatctgtgcctgtggtgtattactcaagaaatctttgttcagtccaatgtcctggagagtttcctgaatgttttcttgcagtagtttgttagttggaggtcttagatttaagtctttcatcgattttgattgatttttgaatatggcaagaaatatgggtctagtttcactcttctgcttatggaaattccattttccctgcaccatttattgaagagactgtcttttccccaatgtacattcttggcatctttgtcaaaaatgagttcaccatagatgaatggattttttttcagagttctctattctgctccattggtctatgtgtctgtttttatgccagtaccatgctgttttggttactataggtctgtgatataaattgaagtcaagtaatgtgattcctccagttttgttctttttgctttggataactttggctatcctggatcttttgtggttccatattaggattaccttttctatttctgtggggaatgtcattggtttattgatagaaatagcatcaaatctgtagattgcagattcctttgtttggttttagcaatattgtttctttcaatttatgagcatataatatattttcatttatttgtatcctcttcaatttcttgcaccaatgttttacagtttttattgtagagatctttcacttctttagggtaattcttagtgattttattgcatttgtagctattgtaaatagaattacttttttttagactgtttgctgttggcatatacaaacactactgattttttatgttgattttgtatcctgcaactttactgaatttgtttatcattttgaatggctttttggtggagtctttaggcttttcaaaatagaagatcatatcatctatgaacaatgataatttgacttcttaatttcaagtttggatgctctttgtttatatttcttgtctgattgctctagctcagacttctagcagtatcttgaataacaatggtgaaagtgggcatccttgttatgtcccagattacagaataagggctttcagtttttccccactcagtatgatacttactataggtctctcatatatggcctttattatgttgagccatgttccttttatacccagttttttgagagtttttttttttaccataaagcgatgctgaatcttatcaaatgttttttccacattaattgaaatgatcatatggttttattcgtttgttcttttggtatgatgtatcatatagattgatttgcatatgttgaactattcttgcatctctgggataaatcccatttggtcatgatgaatgatcttcttaatgtgttgttgaatttggtttaatagtattttgttgaggatttttgcatcagtattcatcagtgatattagcctttagttttccttttttttttttttcttatgtgtctttttctggttttggtatcaggataatactggcctcatagaatgagtttggaaggcttctctcctcttctgtttttcagaatagtttgagtatattgatattatttcctttttaaatgtttggtagaattaggcagtgaagccattgggtcatttctttgctggagactttattacagcttcaatctcattactttttattgatctgttcaggttttggatttcttcatagtttaatcttgatgggttgtatgtgtctaggatttcatccatttcttctaggttttccaagttattggcatatagttgttcataatagccttgagtttaacatagtttaacaataatgtcttaaaatcctttggatgtctgtggtatcagttgtaatgttttctttttcatatatgattttatttatttgagtcttctctcttttttcctagttattttggctaaagggtcatcagttttgtttttcttttcaaataactatttcttttgttttgttgatcttttgtattgttttcttcatttcaatttcatttatttctactccgatctttattatttcttttcttctactaattttgtgtttggtttgctcttgcttttctaattctttaatatgcattattggttttttttcttttcttttttttttgagacggagtctcactctgtcgctcaagttagagtgcagtggcgcgatcttggctcactgcaacctctgcctcctggttttaagcaattcttctgcctcagcctcctgagaagttgggactacagtctcacaccaccacacccagctaatttttgtatttttagtagagacgggatttcaccatgttggccaagatggtcttgatctcctgaccttgtgatccacccacctcagcctcccaaagtgctgggattacaggtgtgagccaccacgcctggcccattgggttgtttatttgaagtttttcttcttttttgatgtaggcatttatagttataaacttccttcttagtactgctttcactgtatcccatgagttttggtatgttgtgtttctgttattatttgttttaagaaatttttaaattttcttcttaattttctcattgacccactggtcattcaggagcatattgctcaatttccacgtgtttgtatagttttcaaatttcctcttgttattgatttgtagttttatttccttatggtcagagaagatacttgatattatttcaattttttttggatgttttaagacttggtttgtgagctaacatatggtctatccttgagaatgatccatgtgctggattcatatttgtattctgtagccattggataaaatgttctgtaagtatttattaggttcatttggtttataatttggatgaaatccaatgtttctttgtttatttatttatttttttttttggtctggaagatctgtccaatgctgaaagtgaggtgtgaattcttcagctattattgtattaggctctatctctctctttagctataataatatttgctttatatatctgggtgcttcaatgttgggtgaatacatatttataacttttatgtcctcttgcttaattaatccttttatccttatataatgatcttcttcgtctcttcttacagtttttttcttaaaatctattttgtctgatataagtaatgctactcctgctcttttttggtttctattggcatggaatatctttttcatccctttattttctgtgtctgtctttatgagtgacatatgtttctagtagacaacagattattgggtatttttttaaatccattcagctactttatgtcattgtattggagagcttagtctatttacattaaataatcttattcgtaagaaaggtcttactgctgccattttgttatttgttttctggttttctcttcctttttttcttcctttcagtgaaggtgattatctctagtggtatgctttaatttcttgcttttttattttttgtgtatccattgtatgttttttgatttgaggttaccatgaggcttgcaaatgctatcttatagcccatttttttaggtgataatatgttaaaattgcttgcataaagaaactaataagcaaaaagaaaactaaaaaaaaaactctacattttaactttgtcctcctaatttttaacattttgttatttctatttccattttattttactgtctgtgtcttgaaaagttgttaatatttttgattggttcatcttttagtcttcctagttaagagtagtttatacatcacagttacagtgttataatattctgcatttttttgcttacttactatttccagtgatctttgtaccttcagatgaattctcattgctcatcaacatcctttcctttctgattgaagtactccctttagcatttcttatagcatgggctggtattgatgaaatccctcagtgtttgcttgtctgggaaaatctttatttcttctttatgtttggaggatattttcaccagatataaaggtaaaagtttttttccttcagcactttaagtatgtcatgccactctctcttggcctgtaaggtttccaccgaaaagtctgctgccagttgtattggcgctccattgtatgttagtcacttcgtttctcttgctgcttttagaattgtttatttatacatgaccttgcggggtttattgaattccttgaggtaatctttgggttaaatctgcttggtattctataaccttcttgcacttggaatcaatacctttctctaggtttgggaagttctctgctattatccctttgaataatctttctactcttatctctttctctaccttttctttaaggcaaatagctcttagatttgccctttagagactattttgtagatcgtgtaggtgcacttcacttttttttattctttttttcttttgtatcccttactgtgtattttcaaacagcctatcttcaagctcactaaatctctcttctgcttgataaattctgctattaagagattctgaggcattctttagtatgtcattgcatttttttaactgtagaatttctgcttgattctttttatttatgtcaacctctttgtaaaattcatctaatagtgttctgcattttttctctgtattatcttgaatttctttgagtttcctcaaaatagccattttgaattctccatctgaaaagtcacatatctctctttctccaggattggtccctgctgccttgtttagttcctttggtgaggtcatgttttcctgtatgttctttatgcttgtcaatgtttgttgatgtctgggcattgaagagttaggcatttattgtagtcttcacagtctgggtttgtttgtgccatccttcttgagcaggctttccaggtattcaaaaggacttgggcccgcaagcccaataatgctgtggttcatgtagactcacagagttaccactttggaggtcttggataagatccaaaagaattctctggattaccaggcagagattcttgttcttttgccttaatttcttccaaacaagtggagtctctctgtgctaagttgcccagaagtgggggtagggtgatgcacccctgtggccaccaccactgggactgtgctgggttagattggaatccagcacagcactagtctcacccaaggcccactgttacctctacctggctgccacctatgtttgttcaagacccaactctacaatcatccagtggtaatccagccatgtttttgtctttcccttcagagctgtgagttttcccagtccccaggaaggtccagagatgccatccaggagcctgggatgggtaaaaaatcatacaaatctaccttatgctctatgctagtgtggctgaggtggcactcagactatgagaaacacctttttactcttctctcccctttccaaagtcagaggagccccaccccatggccaccaccaccaccacaggcccacagggaatactgccaggccaccactgacgtttacttaaggcacaagagttctttagccagcctgtgtgaatgctgctaggccaggactcacccttcagggcagttagctctcctctggcccaggagggcaggttcagaaatgccatccaagacccaaggcccagaatctggaactgcaaaaacatgcttggtgctctacccctggggtccctacccacactgggccacagaatattaccagaccctggcctggtaggaatctggcctcacagcaggagggagcagcgagcattaccccctgagttctgcctcctgtcagatcagctgtagcattagattctcataggagcgtgaaccctattgtgaactgcacatgtgagggatctaggctgctcactccttatgggaatctaactaatgcctgatgatctgaggtggaatattttcatccaaaatcatccccaactcctgcctggtcagtggaaaaattgtgttccatgaaaccagtccctggtgcaaaatgtttgggaaccgctgctctaccccattgtggctgagctgttacctaagatgcaagacagaattccctttgcttcctgtgcctgtgcttttctcaaacagagagtctctcaccacagctgccacagctctgaatgtgctgagtctcatctcaatacagcacacctgagtctcacctggggcccataacatactacctgcgtatagctgttggttattcaggccccaagggctctttagccagcatgtgatgtatcctgccagtactgagtccttctcttcaagacagcaggttcccttctgatccagggtatgtctagaaatgccagccaggagctagggcctggaatgggcacctcatgacccttaccagtgccctatcctactgtggctgagctggtatcacagatgcaagacaaagtcctctttactcatttctcccctctcctcaagtagaaggaaggaatctcttttggagccacaagctgtgctgcctgggcttgggtgaagggtggcacaagcacttccttagcttccctggctggtgtctcagtagggaagtgactcccaagtccattggctctgagcccagctcagcactagaacttgcctaggagttgtagtccttgcaacctagactgcctttcaagtttatttagggagagcacgtttgcccatggtggcgaggcttgctggaactcaagttctaactgtggggctgggtgattactttctggtgatagctagtctaaatgctccctccatgggtaagaatcagctgagtttagcttggttttgctttccactgtgacagggcagcacaggatttaataaagtctcagaatcactgcattctccctctcccaagtgctcagattccttctccatgccatgtggccactgctgggggatgggagggctggtgttggcaattcaagaccatttttcctgctctcttcagtgcctctttctgtgatatgaagttaaaaccaggtattgtgagtgctcacctgatttttcattcttacaaaggttttttttggtttttttttgtatgtagatagttgttaaatttggtgttccttcaggagggatgattggtggagacttctatttagctccttgctctacccctcccttataaattattgcactattttggacagataggtctgtgtgtgtgtgtgtgtgtgtgtgtgtgtgtgtgtgtccatatttatctctatcatctctacgcataagtagagataggtatatatgtatatgtgtggtactgttctcttatattttctagttggttattgctggtttagaggaatgctgctgtttttaaaaatttactttttatacagcatcctttcttatttgttctcataatttgttgattttgttaggttttctatgtaggtttttcaatgtgcaaatatgacaagttttgtcttttcacttccaaaccttacacatctgagacttctaaaattctcttatagcataaattaaaacctccaagatttatttaactgtagttgtgatagtgagtattcttgttcttttctaatcttagtaagaactatataaaatttatttattgttattcttactgcagatttttagtgtatctagtttctgtgttattaaaaacaattttttttttttgagatggagtgtagctctatcacccaggctggagtgcagtggcgcaatttcagctcattgcaacctctgcctcccaggttcaagtgattctcctgcctcagcctcccaggtagctgggattacaggcacccaccaccacacccagctaattttttgtatttttagtagagacagggtttcaccatgttgaccaggctggtctcgagctcctgacctcaggtgatccgtctgccttggcctcccagtgtgctgggattacaggggtgagccactgcgcctgaccaataaaataggtattaataagaaaaagtgatgagtaaagtgccagtgaccagaaatgggctcctgtgtaggctgccagctggataataaagccctgaataaccaataagtgagcatgaaagtaaaattttgaatgttcattatgtgtgactagcttacaactggccttttcaagacaatatgatagttttaaatctttatttttcttttatttacaaacttatttacttttcaggtgtatgaaatctgaagagaagtcccttggtgtgggattacatacattttgcacaagagtatttggtaaaaatagttattttttcccacatcctatcagaacaatattattattattattttttattacactttaagttttagggtacatgtgcacaacgtgcaggtttgttacatatgtatacatgtgccatgttggtgtgctgcacccattaactcatcatttaacattaggtgaatctcctaatgctatccctccccccttcccccaccccacaacaggccgtggtgtgtgatgttccccttcctgtgtccatgtgcagaacaatattaaatactagataaacaaggtaatattatttcagaaaagcagtctagcaaatgtcccttctgtatgtaaaaagcacattataaatatgagaatgcagcacacaaagagatagagaatctcttttacttgaaaaggccctgtctgaccttaattacactattctttgtttgaagatttgaaaataaaatgaaagaaaatgctctgcccaaataaaatgtacatataactggcccaaaacatttaagaaaatatataaagttcagaatctttaattcaatgttttactctactaataattatgttgcatttgaccataagattacttatcttttaataatttagaaactttacagtaaaagtaactcatcatttctaaaaataaaatttagaccattagatttatgttttgataaactttgccgtacaaataaagaaaattgaaatatttccaaataaatcaagtatcttaattcttgttgatagatttttctttccctgtcaattgtagctggcattcctgcacctatatattttggcgctttaatggattccacatgtttacactggggaactttgaaatgtggtgagtcaggggcatgcaggatatatgattccaccaccttcaggtaaagataataatttgtttaaaattgttttataagcatagactgtgcataacgcagcaccattcacacgtaactttttctttgtcaagtgaaaagaatacttttgtggttatttccagcagagatactgatgttatatctccattccttatttgcatactagaattgtattttcccattatttctcaagtgcttggtaaatataagcatacatggcttccctaaccttggctttcaaagtgttgttcgttaaattcttagcagtcaacacaatattgaaggtaatggttgtacactgatacctatccaatttatattgctctctaaaggctctcattttatcctgcatgatttcatcatctcacgagtctgaagcctcacttcctctcaccaccagtctctggtctccaaaatcatatattttctccctctttacattttgctgaaacaatcttcttcatgtctcctaatgccttctctttggtaaatacaaatctaattttgaataaaactctttgttatttctattttcatgttctttttcattcggaaatttgagttttgtttaaatttgaattaacttctcttgatggggcaataataaagctacttcattcaatataaaacaatttaccattgtttaaagcattctaagatattggtcttgatcagcaaaaggacacatatcaagaagtatggggagagcagacgcaggagattcatctctgcatctattcccctttcccccagagctccccaggagtgatgctgagggaagctcagctacatgctatgtatgcggtggatttctaccacagttgaggaaccccaagggtcactattgagggttggcctcatcctgctacttggattcttgttgatagtctcctgaattaaatggtgcttaagacacattaaacggacttggctccattctctgttagtcagaccaattagactggtcaatgaaatggtgtatccatgagaaaaatctaccagaagccaagatattctagaaataagggtaaatattgttggtagacaattctccatggatccctacatttctgcttttcttgttagcagggacactgagagcattttttctggactatattttcaaggatgttggaacagtaaatgaccttggaagatataaatagtgtctctatttatatctcaaggacagagggcaggtagcttgttgtccatgatgataagaaaatgtctccctttggggcaaagtttgggcagatttttttgaagcccatttaaaagaaagattgggatttcctaaactcaggactttctaactgcagcccaaattcactgtgtgtacaatgtttacctgggttctccctctgtctcaccactttgggacttggagggtaaggaaaatcaacttgaacatgaagcttgtgctgactgctgtgttgtgagtaaaaaaagtcctttgtccctgacctatgagtcttgtatcttctgttagcatccttgaaactgtggcaggctagcctgttagcttacaaatgaagtaaaatcttagactcttttacagttcttgagaacaaacttctgattacctttacattttcctaaaaatgtgaaaatgattaattagatttattccaaccaatagaaggggagaaaatgcagtagtggtaattcataagaaaaaaccccacacaaataagttaaaaaataagcctaagtggttttgcaaattggttaaacttgctggttaaaagatagtaatttttatattggacttttcaaaatttgaactaaatgttgtttgtaagagatagatagatcaaaaatataaaatgattgaagataaggttttgaaaagatctaccagacacatactaaatcaacttctgtagttatattaatgatttcaacaaaatataagtaagttaaagggaaaaaattaatagggttaaccagagatattacttaataataaaaggaaaacactataaaaatatagaaaaattatgaagctatgtaaatctatcaacataacctcaaatatacaaaacaaaaatttataaaattataagaataaatctacagaatggaaaatttcaatatacttgtcccacaaatgaatattaaatacagacaaaaatgagtgataatatagaatatttcaacttcaaattgtacaagagtaattgaatatacagataaatgtatattctgtataaacatatataatctgtatgaatctataatacatctatatctatttctacatgaatacatggataattgttaaccaaaatacgagcacctatgccactaaaaagttaaaaaaaagtattgataccacataaatcctgttttctgttcacaatgcaatggagatgaaagtctataataaaaaattcccaaaccccaaatgtttgaaaagtggaaaagaatgcagtcttaaattactcatggttaaaagaataaattatagtaaacataaataattagaactgtatgtcaatgaaagcactgaataagaaaacttgtgggatgaagctaagccaaccagtaatcaaagggatttttagagctttaaatgtataaatatatatacacatatgtatatatttgcatatgtacaaatatatgtatataaatatgtatataatatatacatataagtacatatatacatatttatttacatatgtatataaatgtatatttacatatgtatagctatattacatatgtaaatatacatatgcaacatatattcacatgtatatacacataggtatatatgtttatatacacataggtatatatgtttatatacacatatgtatataaagatgtatatatttatacatttaaaacataatatgtataaaaatatatacatatatacatttacacataaaaggctgaaaattaatgaactcagaatttagaaaaagaacaatgaaatatgtacaaatgacatagaacgacctgataaatgactcaaaaatttacatattgatatatttcctatctcaaataagaataattgaaacaatatatttttaaaattcaaaagggacttttcttgattaaaagacaatataaatatcatcctaaacatctggtttttcagaaattaaacagaaacataaaggagtaaacaaagctgaattcacaggctctatgtctcaaaatgagcagtggtttctgatatcagcttccaaggaagaataaggtacttctaagtcaagcgactaaattcagattcaatgctttaatccaattaatgaggtaaaacaccttttacaggatttagtgttcctcaaaatgtgatattcactcagaacttcacaatgtgaccttatttgcaaatagagcatttacaagtagagtagttaagttaaatgtggttatactggattaccataggcttaaatccaatcactggtgtccatttttttctgaatcctagtactgtttcataataaaagaaaattttagaagtagaaagataaaaatagatgaagaaattaataaatagactatataccatagagggaataagaaagtaaagagctatgtttttgtaaaggtgcaaagatattactaataacaatactgtggaaaggcaaataaagagaggaggcacaaataaaacatcattaaggatgaaaaagctaatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggtaccaagttcagatatttttcaggaaagtctgaaaaaacctacaatgaaccaatgattcatttgtaaattatgcaagttattctcagaaacagaaaaagggaaaattttgtaattcatttcacaaagctagtactatcttaataatcacactggacaagttcagtacaagaaaaaaatttgtaggctaatcttatacatgcaaaaattctacataaaaattgataaattgaatctagtaatgtataaaaattacagtttattttaagcatgcaaggataggtcaatatcagaaaatctattggtgtaatagatgctattaacacaataaaggtagaaaactttgcatattcttccgactacaagcagaaaagttatttggttatattatgcacattcatgattaaaactttgagcaagctcacaatagaaaataacttccttaatctgatcaaggtcatctaaagaaactctcacaagagtatatattataattcatgatgattctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaaattaataagagagtttagcaaagttgcttatataagatcagcatgcaaaaccatcagctgctgtttttatcagaataaaatacaaagatatacaaatttagtttgcactaaccacactatgtaatatttaatatgttttaacttttaaaaaaatagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggggcagaggacataatgaggttagttcttacggattcaaggcagatagtgttggtgaaacagtgagtgtcaaaattaggcgaggtggtgactgggctccctgatgacctcttgtcgtggagcaaaactgaataagcaaaaacttactcaagctcctgaggcccattcatcatccctattgatagatttgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggatagacatggagaagagaaacaagagaacaggtagtgagaagtcgagagtcagtaattttcttacttaatattgtggggatcttacttaatacataaagttaatgaaactagaaatagtggtt

SEQ ID NO: 12862 - DNA, 16629 bp, Human
ttacaatgtagttagaggaacaagagcactgcccaaaaataaaagcactgtaaacattaaattacaatataaaagaaaccacaggacagtgtataaatatatttgagtggacactaaagattacaggaagtttttaaaaaaggtattactgaatcgcttgaacccaggaggtggagggcgcggtgagccgagatcatgccattgcattccagcctgggcaacaagagtgaaactccgtctcaaaaaaataaataaataataatttaaaaaaggtattactctggaacttagtagtagtaaatattcacaaaagatgttggaattgaaggatggatatttcctaatttggtagaggaaggcaatttcaggtatggagagaggcctgaacaaaggtggaatgcctttgagggcaggcaaatctggctggtgcagaccattatggaggtttgagcggacaagtaattggaaataatgttggaaaagtgggttgggactagtatggtacttaatggtttgaattttgtcctgagacaaaatttaatactaaatatagtattaaagcaagagagtgataatggaaaatgttggttttctaaaagcttaatacagagaagtatttaggtagatgaaggaaagaagagaatggaagcaaaacataacattttgagtttgaagttagggtgcactcagtaggaaatgcttaataggaagctagaggtacccgtatgtacctggagtgtggaaaggttaaaaaagacactaaagagatctagttttggtagacatctgcgtgatgattacagctgaaaccataataggtggattctttaaataatataagggtataaaagcagccaggctaaggaatggcctgtatccagcatctagggatgtcttcccctcaccccaagatggtgcccttctgattcaggcagcaacgggcatgcagcattagctctcgtgtcgttttacaataaaaggccacttttgacaaattttgcacgctccctggacattgggtgcatatctgcagaagagaaagaaacattagaactccagaaagaaaagccaagaaaagaacaaacggcgatcaagaattaactgccagtacacgtttccagaattcctctaacacggggccgataaatggataaacggctcgtgtcccacccttgtaacaggctaggctaggagatgccatctcttcctccagagtcctgcgccgaatcagctcccgacactttcagtaccagatatcgcacagggaaggtcctcatctctgaagatcactattcgaacttatttattatgctttctgcagagacttctcaatctgacagccctagtttggcgcggtgtaaaacgaccgcaggtacgtaaagaactcatcaagcattacaaaagtacagccctaccaccgcacgatatatggcgttcgtgcgtagagagattacacaagaggcagaggacccgtctgtagaaagaacttaaagttattctaaaattaaggggcgaaatcaagtttcacaggtctttgaaagtcggcaggactggggcgccgaaggcctgcacgacgtgagtacttgggaacaggacctggctgggcagggtcgggaagcgtcagggacgaaatcagaaccgcaggcccgccgaggagaagggggagccgctggcgagcgcgacgcacggctggccagcgaccctgcttcagcccgacctcaaacttgcttctgtacctcgggtagcgccagagccctttccacgcccagagcgaggagcagggcggcagcccagggcaccagggtcgtaagactacccgggccgtgaggcgccattttccgttcccttggtgctccgctgctcgcgcgacccggccccgcggccccgccccgcagcgcgtcaggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagtaaacatggcggcacggcgagcggggcgggcaaggggcgggcagggggcgggcagggggcggggcccccgcgggctcccggccagggctctcggccgggctctggctacccacgtgtggagaccgggcaggtgggcctggagagcgtgagccggtgccgagaggcaccggggagcggcgtctgagccggggcggggacaagggggcggggaggggcggagcgagccggcctccggcgtgggtctgagatcttaagtgcgagcggtaaggtggtggtctccgccgcgtagagggaagcgggaaaccgagaaagaacgagggtgagggtgatgagggaagggcaaacctcaaactccagcgggaggacacgagcctggatcgccccgggcacctagtcctcttcacctcaatgctgatagcgcatagcgtcccggagcctggcgaggaggtaggagcgggatagacgcttccctaactcattttctttgccttcccaggaaaagggagcgatgttgatctcaggaagcacaaagggaccttcctagctctgactgaaccacggaggtaagggagtgcgttgctgccccagggtgggccagcgccctgactgaagggcgccaggggatccctgctcccggcgcgacagtgttggttagggccagccagaaagctccttaaagccgacccaagtgatcatctcgagtagccgagccaggcttcccttccacattacccccatggtgtctgcctggaagttcctgaaaggtttacgtttagctggctggcaaattttctaaggtgttagtagctattagcattttaaggagggcccccaaagcctttcacaccttgaggaattataggccccaggacagattttgagggaatctttttggaacagttagtcctgcagtggtctcattgccttttgtaggagtcaatgcgatccactgcagtgtgtgaccaaagtgagttcaggtttttatttttatttttatttttattttgagacggagtctcgctctgtcgcccaggctggagtgcagtggcgcgatctcggctcactgcaagctccgcctcgcgggttcacgccattctcctgcctcaacctcccgagtagctgggactacaggcgcctgccaccacgcctggctaattttttgtattttttagtagagacggggtttcaccgtgttagccaggatggtctcgatctcctgacctcgtgatctgcccgcctcggcctcccaaagtgctgggattacaggcagtgatgtgggaccccttttaaaaacctgaacttggcctggcgcggtggccaggccaccgatccgccaaggcaggtggatcgtcatgtcaggagttttgagaccagcctggccaatatggtgaaatctcgtctctactaaaaatacaaaaaaaaaaaaaaaaaattagctgggcgcggtagcacatgcctgtagtcccagctactcaggaggctgaggcagaagaatcacttgaacccaggaggtggaggttgcagtgagccgagatcgtgtcactgcactccagcctgggcgacagagcgagactccgtctccaaaaaaaaaggggggggggtcccacaatctgctgtttgtgccttggcatgttatagttgtagtgaaacaacagctagctcttgcttttggccgccctctttctggagagatgcgagaccatagcgtttggatcaatgtagggtgtttagaaaactacagatctgttctcagaatctggtctgttgctaggtcaggtttttcctgtcttccctggggctctctcaggccatccaggggaattctccatacatcacgcaaatagaattttatcaggaagtcccatcagcagagtgtctttatttctgtacctccgtgtcccatactgggactttccttcctgtctctggccacctacctctctaaaccactaaccctatagttagttctttgttctgtgttctttgcacacaggagacctcttctttcctcttactccccagtagttcccatcatctctatcatagcagtaaaaacttgccaaagacgaatgagaaaactcagggtgttgcaatgtgcaaaggcccagggcatgtttaggttaaaccagagtttaagcctgttgggaatcttgtagaacatgtgatccaagagttgccaggtctgattttccctctttattggccccaagaggttcagagttcaggtttagtctgcatgaggccatatcttgccagccagccagtgtctgcccaagaacacactgtgggagagcggaaagacagcctaatctttctcctagtgggcaaaagcagaagacatagtttatgtcagtctgtctcttgattagttgaaatctaaactatgtcctgtgaatgactgactgcaacactctgctcctgtcctggttctgggaatagtgaggacagggcccttgctgaacacctgtcatagctgcagacagcactgtttctctctctcttgttttgtatcatgctgcataaccttgagcaagttatttaatctctcagttttcttgtgttaactggagagtattcgtgtcttaatctgagacatgctgttttgaaaatgttagcttcattatgtattattactaatgtttataaagcacctcacacactgctgggttacatagcaggtgttcagcaaatgttaactgtcgtcatgttaggctgtgtaactacatggcattctctggtgttttttcctcataccaataagtaccccagaggattgcctttgaagacaatatgatacgcttggagaacagacagggtggatggtgaatccctagacctgggttctaatttatgctctgacaatagtcggctctgtgcttttggaaaggtcacttgaaccatctgagccttagcgtgtttatctgtgaaatcgtcagtggtggggggttggttgtaatagtggtgtccaaagatttaagattttaaatattatgatcccttccctctttctctgaggattgtggtgtattcttgggggattaacatttcttgtgcaggagttagaaaatcaactttcaactttcccatgttttcagttccttctttccaactccctcccgcacagagtgccaagagtactttaggctgaaaggctaatccatctaggaatgctgttgaatatgagctccctcttccctgttctggagcctctagggctgagttggagtttgggggccatagggtgatagggccatttggaacacagccattggttccctgaaggggccagaacaaatgactgctgagcttcaccccacccccaattcctgatctctcacctcagctactcatagagccagatcctcagctctgcagctccaggcaactctgcctcagaacagggattgcttctccaggtaggtgtctgtccccagcaggatacgaccactctctttggctggtccctttgcctctcagctccgtggctgggttgcttctctccagaatggagaatcgtcattctgaaaccctgactccagcatggtgccctctcacctttcccctctcacttttgaatccagccgctcttcctgcgtctgctgttgactgtgatgttgcaggtagaggggctgagaggtgggtggcagcacttatctagtggtgttggggagaaccttaagaaaggggttggcctggggacgcctgaaatggagtctgtggctgccacagaggcagtctcactgatgatcagttagaagggtgacactggggatcacaggaggcgagggccgaggccaggggcagtaggggaagccctgctgccattagtctccatgctgtgtttcctgctgggctgtggcgccaggctgggctctgctggcttagtgtattgtagtgactgggtctgtgccttcaagtggggctgggaaattctgctaagaaacttaggctagagtttatttttcttttggtactcgggtggagacctaagaaggttgttgaatttcacagctgtgcatactcaaaggtcctggccaagttatattgtctcctggctgtcgcactctgatgcttctccctcacttatgtcccctaccaaacccataccagggcctccagaccttgaagggctaccactatgctggctggtccacttctgatggcatgcgatgtacaaggcccaagggtgaatggctaccaaggccagataggcctcactaagagctaattcctttgcagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgaggtgagcagggacagaagggagaagtgcgtgggacacgggttggggtggagaggagggacaggcacataggaaggacctgggaccctagacctcctccacctaatgagagggacagaaaactcattgtgtgtttataattctttctcagtgatgttaggtataggggcaggattggagaggagggtgctatgccgagtaggactcagagtgggtatgggttggatattccctcatgttcctgagcatcttgagggaatttgtctgtgagttgtcggggtgaagtcaggagaaaaatctttttttctgtatacccagtacctggagcttcgattcaataaaactgtgcgagtgtgtggaactgtgaccttcatctttcagatggtaagcagaatgaggatagaaaccgagcctagggcatgttgggggacctgaacgcaagcatgctgagggaattggagtctcccctgctctcagattggcaggattgaaattcctgctagaggttagcatctgtgaggaccccagaggcatcctgctgcccatgccttccaattccagcacagatactgtggtggcagcaagccagaatttgagaggagaaggaagagggaagtgagcctaggtgaggggaagccatgggcatattggcgctgaggcccatctttcttcctctctcttcccaccattctccggcccccatcacattttttccacatgcaacaggtgatctacatgggagttgtgctctatgctccgtcattggctctcaatgcaggtgaggagtcacacagcccctggctttcagccgtggtaggttaggaaagcacctttgggagaggcagatggaggagcgtatgtggaaaagaacctgaccttgaatggggaattaattcaccgcttgggcccttgggtgggtctctaccagaggaaggcttggtccacctcaattgacagctagtaacatgttaccatgccctatctgaactggttagtcaatatcttttggtggagctctgcaaacatttttctccgttgtggtgaatgatttatttcattgttaatgaccaatgctttatctctgtggcatgacgtgattgccctaccagggcttctcccctggggaacccttttccagggataagaatgtggcttctatgcttacagtgactggctttgatctgtggctgtccgtgctggccctgggcattgtctgtaccgtctatacagctctggtaagtgcagtaagccctggtgtggggaggggaagggatgaagtaaggaggggacatgggaagagaaggaaaagaagacataagctgagaatatagatgaggagaataggtgaaattctggggtggtaagatttatgataggatttagcagtggggatggtatatgaaggtagaggatgggatgggaatgaggtcaacagggtcacagcaattacatgcctaatggcaggagagtcccctcactggtagtatgttcttagggtggatggtttcaggagtgtccaagggagagaatatagtcatgggttcttagtttctgtttctggttgggtcagtaaagccccttcgtcatccctcttttatacatatcaccagagacagaaactaaaaactggcttcaggctgcaaaaagcctaaaacaaaacaaaacaaaacaaaatggagcaacaacaaaataaggcaggttggacaagctgggtttagaaggcctctgtggcaggtttgctgtgctttccttgcagggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagtaagtatacccctactcctggctggggtctgcagtgcctgggcgctgagcccatcctagaggctggtctcggctatagtaagcagaaggtaaactgggaagcctgaggtgtaacagcagacagtgggaaactggtcctgcagagatggagggtgattacaggtgcccggctagtgtttatagagagtcaggacattacctgggatgagtacctggaatgagcctggggtggaagaatggagcctccctctaactggctgtgctgtctctcgagtgcacccagcttcttgctttcagtgtcccccttggccctagcagtggtgtctctcctttcctgtccactgactcctgttgccaagagggcaggaaggctgtgtctctcaggctttgcacaatgactgggtggtgtctgttacaggctggatccagacccctttgtgcggcacaccttctggaccttggccttcgggggtgtcttcatgatgctctccttatacggggtgaaccaggctcaggtgcagcggtacctcagttcccgcacggagaaggctgctgtgctgtgagtgcagggacaggaagggagtggagcaaggtctaggggaaggggttccccagagataattggggtggggcaggatgccagagtgcatacacatccactgtggtcaggatgtgggtctcctttctggaggtcaggggcacacacctgagggtgtctgttaacgccggctctcctcctggcactgacctcttttgcagctcctgttatgcagtgttccccttccagcaggtgtccctctgcgtgggctgcctcattggcctggtcatgttcgcgtattaccaggagtatcccatgagcattcagcaggctcaggcagccccagaccaggtgagaaggcgctgttctgttcccatgagggcaggcctggccccacaacaggagtgtctaggtaggaaaggactgactgcagaaaggactcccaccctgggtgggagacggttgtaaaatcctttcccactctgagatgctaggaatctagcatgtgaggatcgcggtccctagcatcacctaaccacagtgctcatcctactggggtgaggacctacccttactgactccccattgggctccatgtgctctgctgggagctatcacatacctggtctcacctaagcctctaacagcctcatttcacagaggagaaaacagactcaatgaggtagccagtaagcagaagtcacactagtagccagaaacagagctgcgggcgaattgtgtcattccctctgtagagctcattttctctccacttaatgtgtagacacttgggtcagcagaagtgccccaggccctggcttcccttgtaatgcacccagtctcggtagactcgctggggcacatgtaaagggagcttccctgcagagccggccctgggaagacccctctctgaggactgctgtgtacctccgctctgcttgcagttcgtcctgtactttgtgatggatctcctgaagggcctgccaggcctgccagggctcttcattgcctgcctcttcagcggctctctcaggtacccactttaacgatttccctcaggcctggtgcacctgacccctatttggtacaaggtgatgggtggagcggggtgatagtgggtggggaatccctctaagtttctcactgtgcctgccccatctgtgtggatgacaagggatagctcatctttgtaggccacagcacaacagagatacccctgttttggttaagagttcttttatggtaccagaaattgatctactcgaatgaaacccatatccacattcaaaaaaggactgtgtccttgccttccaggcccgctctgaggtggcatcaagtccaactatgaggaggtttcttggtggtacctgtcatctccccgctttaggacaccatttcctccatagagtcccatagagctgacaattttgcctcgctcaactcctcatcctcttcctctttttcagcactatatcctctgcttttaattcattggcaactgttacgatggaagacctgattcgaccttggttccctgagttctctgaagcccgggccatcatgctttccagaggccttggtggggttatgcttcctcatctcttcagtctgggtctttctaagcttcatcctgaccattgtcatcagtttgctgtaaaacacccactttatccggggctcagcacttgcctaatgaagcacacaaccttccctgcatgcatggttgtttccatctcagggcatgtcctagggaggtctctgagtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggtaataactatagagggtaggaagcaattttaagggagagaaggaattgattgaaacaggaagttgagaagggcagctatattgaggggaatgaccggggggcaggcgtaagagattcccctttgatggaccgtctttactgtgaacagacttgcaagcagccagaggacgcagggtcattcctgggatgttgtaggctgagagagagctaaggatcagcctcagagaactcaaaacacatccctctccatcagccccctagcagcctttcctgccctctggagttctttttttttttttttttttttttttttgagacagagtctcattctgttgctcaggctggagtgcagtggcgcgatctcagttgactgcaacctccacctcccacattcaagtgattctcctgtctcagcctcctaagtagctgagggactacaggcatgtgccaccgtgtctggctaatttttgtatttgtagtagagacggggttttaccatgttggccaggctagtctggagctcctgacctcaggtgatcctcccgcctcggcctcccaaactgctggaattacaggcatgagccaccgctcggccacctctggagttctgattgttcccacagaagagacagatctgacaagtggggctccaaggtcatggctggtggctatgctttatggtgagtctgggcatctctgagtctgtgttctttttccttttcttctcaccctgtcctcctaggcagcaatcagcatctttggcatggttgggggaccgctgctgggactcttctgccttggaatgttctttccatgtgctaaccctcctgtgagtgatgcatctggatccacagtcatgtgtagcaggatggacctgggggttggcagggctgtcaccaggagagctgaggactgccgtgagggctggcaggactggccttgtgacaggcctgcactgtgtctcggcagggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagtaaggcagggcttgctatcttcttgttttctcaaagtcctcctttgagggctttcacaggggtcttgctaagggatgggccaccagaggccccagggaaatgttgggtattgggtcccaagaccctgggaccatgcgggcaagtagagattggtgcccaaggaatgccctgccaacgaattgctaattgttctcacctctgctcttcccaggcccacagggctgcagcggttctattccttgtcttacttatggtacagtgctcacaactccaccacagtgattgtggtgggcctgattgtcagtctactcactggtaagggtgtgggattgcggtgcagatgagcaccgaggggttaacagagggccctaagggactctagggagaaaggctcctgccctctgagctcttgggtgtccgtagctgtcaggcttttctgctgggatgtaggaggtgggtgggggctggggtctctgggggccaagggaggacatggggcccgctgctgtggatggttccacccagagactcagaagcacatttccattcagggagaatgcgaggccggtccctgaaccctgcaaccatttacccagtgttgccaaagctcctgtccctccttccgttgtcctgtcagaagcggctccactgcaggagctacggccaggtagtacctgctgtccaagtgacccctccctgcccttctccacagatgccactgactcttcaggttcccttctaccccttttctctccccctgccccgggtgcctctctcaggatcagctaagcctaggctgtcccacacggctgtctcaggttctacccacaggactgcactggcttggtgggcagaaggatctcagggctcagaggagctcagccccggcctgggccagtcagctcccctccccagcccaccctgtgctccctgctgtgctatgccctccctcttttccccctgctctccctcccgaacccagccttgctgggctcccttctggcggggaccttttttgtgtgaatcctgtcaagcacccgtcatccgtcttcaccagttccacccctttggctctgtgtttgcaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaatttgggctcctgtactgtcttcacctgctcttgtccaccctactgcatcctctggtgaggataaggagtcctatcctatgtacaggtcaccttcctgtgctgaggaggggggctgtggcttcaagtccctgctgtccctgtgtctgcaggggacagtgttgtgctcaccatggtagaagatgcacaccctctcctagggcttctcatcccctggggcttacttagtctgtcccttctccggccccactttccctttgccagaaccttttgctctcagatttttacttttggaactggaggaagaatgttcccatctgattttagaaacggaacattctagctggacttttatggtcttgtgaagaacactgtgctcacaccctcccacacctggcctctgcccctgcctggccctgttcagctgcccacatcagctctgcaccagctctccggggtctcttaacagagaccgggtcccaggcatatctgaattcagcctcaactgaggccttctcccagggcttctagagcacattccagctgttctctcatactccatgtagcttaggcctgggatgttctgtgtccctttttctacctctaccccagctcactcggtcacaccccagcccctttcacctctgccctggccagccctgtggaggaacagggcctggttgtgccagagccaagacactagctactcccaacctgcctaggcctcatttatattcatgacgacaatattgtctcctaatgggtcttaaacctgttgccctggatttttttttccattccacaaggctctggtcttgaacataaacattccttccagtatggacttcaggtgtctggtcatgatctattctcagtctgggaaggtactttgacaggccaaaggtgtgtccactgaatctaccatatttcagacatgcctgagtggtactccagggagaactggggagaatgatccccagggtttaatttgctgaattaggtagggtggaagtgagtctatgtaagaggacatggaaacattttacgaggggcccttggactcaggcctattttgttttgtcctgtgaattaaaacttcaatgatgggaagataagaagcctataattattatttagaaaagattcctttgggagaccgaggcaagacggttgcttgaggccaggagttccagaccagactgggcaacataaccagatcctgtctctacaaacacaaactagccagcatggtggcatgagcctgtagttccagccacttgggaggctgaggtgggaggattgcttgagcccaggaggctgaggttgcagtgagccaagattgtaccactgcactccagcctgggcaacagagcaagaccttgtctctaaaagaaaacagaacacaacaaaatcccttttccttcatagattgtttttggggaatgtaatcgaatctatcatgccagactcccaaattcaagccttatttgtttcctggttcaggtgtcctggtagagctgcttctaggacaaggtcttaccaatggaggcaatagaaactgagaatgtctgtaaaaactagaagtggacgatttatatctcaagccctacaagaaggagagactggtgattgtcaccaagaactgttgagggaatgggatcatctctggattcttagggcctgatctctgaacccattttctggccaagccagtgtctgtaggagagttgagagcaggatgcccctcactgctgcccttggtccagggctttacataaaaaataccacattggtcatatctgcaaacattgggattgtaaagtaagtaatgcccagaactgcactctgtaagtcctccaagaactgtgcatccttccattagaagtgaggacagtccccgaacatgccaggttgactctgccccgaggtctgccctcttctccttagtccctcctcctgggacccaagggcactgttccttggttaactaccttaccct

SEQ ID NO: 12863 - DNA, 18494 bp, Human
gatctgggctcactgccacctccgcctcccgggttcaagcaattctcctacctcagcctcccaagtagctggaattacaggcgcccaccaccatgcccggctaattttcatattgttagtagagacggggtttcaccatgttggccaggctgatctcgaactcctgatctcaagtgatccgcctgcctcagcctcccaaagtgttgggattacaggcgtgagccactgcgcctggcctgagccaccgtgcccgggtgtttaataatacttttaattcttaaatgtttggaacaaaaaaaagaagaaaatgagattatatgattcacatggtactgctctagtcctgcagcaaattccagtgccttctctgatcagggaatttttacaaaatcaaatgtgattgatacatcttcatccacactgacaggcacccacagaacatccactgagacctagacagtagtactgactgcaggccctaaccctgggatacaacacgaacatggtcttgtcctaaacagctgataggagaaagacagtattcactgtgttaatctcagtccaaattaattgtcttcatctagctcctgtcttacattcttcattgcttgtccctaaatcctagcacggccaagtcctttagttttaagcctacatgaaaggcatccagggagagccaggtggaaatgaaggtggtggggcttggcctttcttcccattcccaccttgagaatttgcacctttccttctctgtcaccaactagcagttgccatggtatataagggtatatcttattttatccttaatatgtttatttctgcttccaagatgcttctgtttttactaaaaccatagaagcttcccctcccaccacactcgcaccacacacaaaaagcagttggaaaaacatttcaatgattcctaaccacaacagcacttctgactaactacaaagaaggaagctttggagaaacatagagggaaactacagtcccagcgagaccgaaaccggaggggtgagatagccagtcacagtaaaagctggaaccagagcccagacttcctcaactccagcccagtccttttgccactggggaaacgctgtttacatgtcctcacctgcgacgaacaacatttgataactcacaaaattaacacctttcagggagagcggggcactggccaggtccctctgataatgaattgctgctctaagacataactgctgtggggaggaggttggtgtttggcggggaagggctgctagcctgcagtttcataaggacaataatacatcaaaaaggacaatcatagatcaaaggggatattttgggtcaacttgatatgtagtggaaagcagattgggaggggagccaagtactggatatgctccgtgcgtgagtgtgtctgtgtgtgtgtgtgtgtgtgtgtgtaaatcatgttgctctctgggtctgtttcccaatctgtagagtgtaaaagtctctgaggctccttgcagagacaagtgatggaacgaccttgacagaagagagcagagagaggaaagaagggggaggaagccaagcaaaggagagagaaatggtgtgatgggggaggagacgcggagttgggtagaaatgccttttaataagatattgggaaaaaagtattaaacctaaaactgcagctcttgaaggatcattttttcatctttgtgttaggatttacaagtacagtgcatagtaatttttggataattggagtgaatgaatgaaaagcgtgaaacgccttacaggagcgagaagatccacgagagaaagcgagcagggacgcagctctggtgcctggtcctgccgggtggtccccacgccgccagccgcgcgttccccaaccgggcgctcccggcgccctctcggtgagccgccctgaaaccgccagggggcgctccccggctgccggggctgaggcgggcggagctgctttaaatcgcggcgcccagcggttctgcgtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagtgagtgcacccccacctcacagcggccgtccagaggccccagtccccctgcagctcccttatgggctcattctgttgtgtgattccatggttatcagtcttcagttgatcaagtcttctgatcatgtgctctgtcataaggaaatgaagagaatcctggtttgaggaaagcgacgcccaggcataagctctagttttgcctctaactccctgggtgacacttctgccactctaggtgtggcttcatcctaaattcctatgctggtggttcgagttgagggagtgaaggccaaacttgaacttgagctcttagacctctcctaggcattccgagatttggggtaaattgaggattggtagagttcagacaagaaaatgggatgactgaaaaagtttgaagcctggtaacttctcaagtgtgcacgcttaaataaataatcctcaagtattagatataactttttaacctttaatatgattttttcatagtaaaagttacattcctactggaaatgtcctatctaagtgtcttctgcttatgcttgaggttgattcttttaatttataagatccagttagtgcagggaggccccttgcaagactctttggagaagctgcttgagattcccccgaagttttaattttcagacccaaggtcttctgtagaggctgacggtgtagtgctatcttggaaagagaaggttggtggcaggtggggaaaggctgacaagaaaggttctaaataacctgcgcaacataatacaaagaaaaaagtaaaggcactgaagggaaatgcagcaaaatagtcatagctgatgaaatcagaggtcagctgggagtggaaggcagtgagagagaaagaagaggtgggtcttccttaggtttccatcttccacaaagaaatttctgtgtaatggatgttcagtgaccccctgtaaaactggaaaggattgtatagagagacatatttctaaggatggtgggaagaaggataataggataattgttttactttgttttttaaattaaaggtttcgagttccttgtccgaaaagtcattaaattcccatttacttagataataatgattcacggctggagtatcttccttgagaaatcacattaattgtcttatatcatgtgtctgttatgccctttaactcacttgaagaaaagatcccttagtctttgcctagatgaacgtgactgcccactggcccccattgcatgctaagggtgaaaagtgttggcattgttcaagtttacttaacttgttttgtctacctcctatcaagggacaacttttaatagtgtatatcaaaagccatatagtttagagttattaaacctgttccaaatctgtttgaacaccttgaatacctgtggcatttgctcagtcaatgtgcatggttgttttgagtgttattatttcagcttttgaaggttctcatatcaggacttctttacaccaaaaccaatccataagtttagtaattatgtgttgctcattgccctcaggggttatatttgtacttataaaatgaaaaatttggtaataattattgaatttctccatggaaagataaatatatttaaggaaacggtgtcaggcattttaggtaccacgttaaggaattggcaggtggaggtttctaaggacaattccagagaggtctcactgtcagttttattcctctgatcaaaatagttccttttcaacatctttaaataggttttcttttaacttcctgaaatgaccaaatgaaatcagattgatctatgttgtaaatactcaaatggatcatccttacacatgataatgtgttaaaatgttttactttcattttttggttaatgtagttattacagtttttaaaactagggtgaaaggactaaatacctacccccccacacacactttagagatgtcttcctatttttttaaaactccagatcagaatccacttttattttacttaaagccatagtttatccaaggtgtggcttaggcctttctctcaaaacccattctcagaagagggacccttgactcacaggtgttctcctctcacctgccgtgactcacgggatgcttttggatagaacccaggaaaccttacttcatttctctgcctgagcagtggtgtttacgcccaccagctgtagagatctgggatggtgattcattggctggttttggtacagttttgttacatgtagagatgaaaagggttatgtgtgtatatttaagcagtatcactcagaaaaaagctgcatttcattaagtgtgtttaggtgaaaagcttagctgtgggtttcccgaaattgtaccttgccgtctttcccagtagagcacacttgtcttcccggccagatgcagggctttagcacgggaagtattaaaatctgttgtttccctgctttatgtagggtaggtcataaaaagcatatgaccttcataaagtatctgaaggaatacagtgtgctaatagtgtatacagtaaatacaaaatgagatagagcaaggcttcttcttttaggtagttcttgccaagcggtttatgaaaatgtaactgaggcacttcctggggaaacaaatgtcacattgtgtattgtagttttataatggctgatacaatttccatttcatccaaagtatgtgattttattgaccctggggattcttgtagctgaaagttggaatatacaaaaagtgccagatacagttgtagtagacttttcttgattcacctgtacctctcgccttgttttcatctaattctcaaacttttaggaagctcgcgccaattttatgtgcttgcttaaatgcttcttcttacttgactttaatagctagagctgtccaaagattgagttgctgtaggaggctgcatggtgggaggtgtgcaagcagagaataaataagcattttgaaggaatgttgtagggaagatccaagcaccagacaaatgggaggttaggctagactctctctcaatctcaccgaaccctgagattctgtaatttgtttataagctcctctagcctgtttaacttgctttgcatgaatccacatgtgtgtaggtgtgcttaatgagtattggtggctgtgagcttccccagcactctcaccatgatgtcaggctcaatcagagagacaaaatcactgacgtggacagtctttgaagcctaagtggagaggagggcacctatttatgcttctccagatgcgttgtgcctgctgaaccgagggtactcgaagggccattggtgttcagatatacttcataaattagttctgactcttagaataatggaagttgaagcaaaaatccaggcttgagatcagaaattctctgttcttactgtggtttggcactaagtagccaagtgtataatggtgagccacttgatctccctggtttcaagtagttaccccacttataaaatagggcagagtgggaggaatggggagatgaatctatgattcgtttatccattcaacagatgcaagctaggccctattcttgctgctaaggatggtgcagctaagatgagttctaagattccttccagtgccagaattctttgttattacttcagtgattgaaggggaagaggcaagtcacatagcttaggtttccttaattggagtgattaaggaaatataatggaggtaatatagaagcatcaacttaattctgagaaaatttcttgaagaaacacacaaacaagaaaggtagcaaaacttctgaggacatcctgaaaagtggtacatcctgcctcatccaggatcattttcactcctgattttgcttatgttctgagttcacatctggtgaccatcacctcatgcaccaataagagggaaatgctaatgattaggacttttatgaaactttgaacttccgtaaaagtaaaagatttaatatggagaaaagccaggggagtacacttctgtgactgtctgtgttgagctcatttaattgcaggggagaaggaagcacaatatttttgttctagtcacccaatcatcagttcatttattcacttaatacttattaagcaactacagatgcaaagggagaattggaatctgcagtcaacatttgaacaacacaggtttgaacagcaagtgtccacttataggtggatttctttcaaccaataccgatcaagaatacagtatctgagagtccaaagcctgcatgtagggagggttgactttctgtatacaaggcttccacaggatcaactgtaggacttgagcatgtgcagatttagttacctgtgggtggtcctggaaccaatcacccttatataccaagagatgactatattttgtttatgatatatagaacctaaggtaatatggctagaaaatagcataaacaatgtctggtattgatagtagattctactacttgtgtagcaagactttcaagctttagaaaaattacatatatgtctgtctttctacacatttgttgattaacctaagtgtagtagatcagtaacttccaactcacttcttgtcttataagtagagatctttgtaagtatttacttttaattctactttcaggtggaaaatgatgagaactccttagggggtctttaatctcaagattgtcagtctagctaaatataattaaaagactgccttctgtgtttactgctgaataatgatgagaaaaaatagtgtaatttttttaatgtttgctaaccaggttctccatagacaactttagtcagtggtcataatattgtagatttagctgcaaatttaagaggtgagaaaaggaatatgtttgttcctaggtttgttctaatcagaccaattcaaagttaatattgcaaggctatacaacatctatctcatccaaattgttgttttatagctttcaaacatcctttttaacttctctgctctgccactcatcattccattagggcaaaaagaaacaaaacttaagctttgaagctcattagatacatactttaaaaaatagatcaaaataagcaaaaagtacaatttgtattatctgcatgagtttctagttatcagtgacctaagctaagtctggcttttagtagcaagattttagcataccaggctctcaagggaggtatttctcagtattatttcaaaaattaagctaaacacaagagaataagtatttttacctatcatattggtacagatttttaaaggataaagacatgttctaatttaaatttattgaaatttgataaatccatgtgacttttcaagtactgtgcttggtgctttagatggaaataggaataaatatctgactcaaatcatccaggagttcatgattacatactttacaaatctgatttaaaacacttctatgatgtgaaggtattcatctgtttccggcttaaaactgtgcaatttagatttgatctgcacataaaacacttgtaacttgtaacacaatagttgcttactttgactggtaacctatcattacctacgccttgcttgtgagttttcgtgctgttttaattctcagctttttgtgcgtgactacatgtgtatattatttttgcattttcctcacatataactatacttaagaatttatccaaatatctccaatgaagcaaagcaagattttgggtttgatgcaaatctaatattggaacatacaaataaattgtataagtcaatagttgccaggatgtaagtgaaaatattactttgcaaaacgacattttaaaaaacaaagcaggatctcatttctatggtttatgcaatttttaaatattgtgttttccattttctccattactttttgtgtattatgcaaataatatattattctatagagaaatgaaacctgataggtttcttagcaatcatagaacagaatatcagtccccagccccttggaaagaacactttgtagatgaagtggcaagatagatttgacacgaatcaaatgtgttttctttgagaacttaatgggcaaaaacttagagattaaaaatgtgaatattaggtcattccaggtgggtgcagtaagggccctggagtagtttatgcacatgtgttccttgcctgggagatcaggggttttacacagtccgactcatgagattgatgcccagttagacttctcttgaagactactctgcgatctaagtgctcagacctgctgggcaagtgaccttctgtttttacttgaagaaaagatcagtgtgattattctataaactggtccagtttggggccccacaacttgaacaaagagaaaaacttggagcaagatcagagaaaacatctaaaatgattaataaaaggttgaaaaagagtatttatgaaaaaataaaatggaggaggctgtgaaatgtaagatgctatagatgcttgaagtgctgtcatagaaatatttattgattgtgtgatctctatgctgacagtaaaaatcatgtcgcccctttctcaagataatcatatgacttctgattatacttagaatagaatccatcttcttaccctaatttgcgaagttctgcatgacatatgccttctgcccaccttgctaaacttcgttttactttgcacatcctatcatcctgcgttaggatgaccagctctcccaatttgttcaggattgagagccttctaaggatgtaggactttaaactttaaagctaggactgttccaggcaaactgagatatgtggtttccctatcctccagacatggatcatctttgttactttcagcatctcctcttcaggcatatctctgcctgaaatattttcctgccaagtgtaatcttaggaccacatctgaaatctgtgttatgtatgggtttagttattttatttgttatttcccaataatgatagcctttgcaaaaaccatccatcagaaagaggacataccttaaccatggagcccttggtactttcctcttcataccacagtatggcttgtgattccaaggaaaaagttgtgtaataaccttacaagcagcttcagttccttcctggtaaacctgtggtccgtggaacatgtgttttgatccagcagttcctctgccacctggaatcttgagataagtgtgtgggtcagtgtgcatgtgtgcccatacatgcttatgaggaggtcagtgtgtgaggggaatcaggaagtctcttttttatttttaaatgaaatcaagtaaaacttaaccttggcttcaaaaatatctctcaaatactgtaaacaatacctttgatactttttagaaagagattatggccaggcgtagtggctcacgtctgtaatcccagaactttgggaggccgaggtgggcagaccacctgaactcaggaatttgagaccatcctgggcaacatggtgaaacccatctctactaaataccaaaaaaaaaaaaaaatttagccaggcatggtggttcgtgcctgcagtcccagctactcaggaggctgtgggatgagaatcgcttgagccccagaggcagaggttgcagtgagcccatatcgcaccactgcactccagcctgggcaacagagcaagactctatctcaaaaaaagaaaaataaagagattactataattttatcatagattgcctggttatagcaaagacagaaaatcagtaaatcaagatttaatgaagttttagaaatatttagcttcaattatgattggtgacctaagttctcaatcttgacaatattaacactaagcctaggcctgattagatattgagatacaaaacctttccaacatctcagccacttttaaagaccatcaaggagtcaattgttccaatccactggataaagatataatttacattttacttatataattgaaatattattccaaacaatactaagtttcttgctcaagatagcacagtttgttaaagctaaaaaatacttatatatgcaaaaaacacttgtcacatattatcactgtcaatgatatagtgatctttaattaaaggaggacataaatctagaatttaaacaaaatcttctaaccagcatagtttcagttcatatttaaaaatctgtgcctttatgccacaatgatggcatcaagtttttactctttaagaaacatagtgataatgtctcaaacttgaccctgtttatttgatcatgagttagtacaccaaaaataatgatgggaaattagaaaaaatggaatcctgagaaacactacattgaattattgtgtgtgctattttacaacatggcagcttaaatagttttaaaaaactagtgatgtctttgaatatgaatctactactatgtcccaaggtaacatctcaaaggttattttgtttagttttaagaaaatgacttctatattcttccccactcctcctattcacatcactggagatacaaatactgcttatccagccatgataatctataaaacatttattttttatcttccaattcatccagtttttctgaagcttattgattggggtgtaaagctggtgactaatatcaaagatatactgtaaaccattttgattacaaatagttaacatccaggatagtatatatgattgttacttaaaattaaaattatcttagcaaggatgaaaatcccttagtaaaaaataaatatgtattagttcagctaaccctattcaattagatcattaattaattttccagttgattttgaatttaatgttggaaacataaaatattggagtggagggatctctttttcatcatccagcctggcatttgtttttctggagaagatactgtatattgggttaccagcggaaacatcagtatgactggggtctctagattcctagtccagttttctctcttccatacaacagtgacatatacttggtcttcttccatttttctcttgttggtccaagcatatttttacatgttttaaaatgttttctgccaggcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtaatagaggctgtgcccccctttcaccttactaacctgttcctggtatgatttgaaatctattacgttggattcattatacttgatttcagtctctaaggcaaactgcaaacatagacctgaagtccagttgactttcatgttctcaaacacaaactaaatgaaaatgtgagagctctgctcacatctgacaggtctattggttgaagtttcaagtggcaactggtttgttagaaccagtctcttccagtgaagaaagttgttcactatttagcaaacgctaaggaggaagttcatgtaattcagataattcctatggtgtctccacagatactatgtggaaaagatggggagtagtgagagaaaacacaagaatatgtgaacccttcaggtctgtgagggatggaaggattgggattattggagaaaaataaggatagcattccagctgggcagatctaattcgagaataaacaggatgtgcctgtagatcaatgaaaagaaaggccaactggagtagaggtggcctgttggaatggtcagtttaaagcagttaggaaaaaaaaaatacagaaatacctttaaatttttttgataaaataatattatattttccatttaaaataaatacgtgttttttaggccaggtgtggtggttcacgcctgtaatcccagcacttttggaggctgaggagggcggatcacctgaggtcgtgagttcaagaccagcctggccaacatggtgaaaccccatctctactgaaaacacaaaaattagctgggtgtggtggtgcacgcctgtaatcccatatactccagaggctgaggcatgagaatcacctcaactcgggagccgagatcgcaccactgcactccagcctaagcaacagaagactgtctaaaaaaaaaagaaaaaagaaaagaaaagaaatatctgttttttaattcaagtgttgattgataagttacattatgtgtcatttgagaaaatcaaagtcagaaaacatggacagcattatttcaaagctttataataatgcctatttaaaaaattatagtgtatgtatacttacgtgtgtatatgtacatacatatgcaatctctctgtgtgtatatatatatctttatatctatacactgtgttatatatgttgataatctccatataaattatacagctataataatagactactatatgttctctatattaggtattagatgcatatattatatatgtagtatattatagtatattattttaaaaaaataacagatataattaatgatacaaatctactaatagaaaaaaactagaatagactttattttcttattttctttttgacagaagacttgtaggggcttttgcttcagtataatatgtcagtttaaccagtaattgaggaagagtatctgtggctttgctaaagatgtggttagtttaaaatgaccagtctctcagtttacccaaatacaaattgactcctctctgaaaaggcatggatagtgtcttattcccaataatttactcttatatcaaaggctgcgaatagtaatctttgtggccatcgtggcatgaagtgtatgaagtgcttggaagacgatgaggatgaaatgcattgcattcttccttcgcttgccttcttgtaactcccacatgtgactgcatcactcctattccagtttcagggacttctcttaggagtaagcatcacaagttcaagaccattcgcatggtctatttgagaagccaaaagcaatagtgttttctgtcatgtctagaggcaattacattggaccatgtttttggctggggagagacagtagcatagaaacatctaatctatctatattgatgaatacttagaattactacaaaaaagttatttaacttttttgataaaaaaatgaagtattttatacatcttataaatgattaagtgaatgattttgactaaatgatttctctgctatcattgaatataaaatgccatgggaaattgagattgggttgcataaattgatctgatgtggcaccctcaacaaatctcaggccaacctatacctatatcaggtattcccttggccaatggggcagtagtaatgcaggtattctggtccattctgagacatgtcctgatctcactctatctagctgcttgcattccttttgactctgcagaaatgtaaattttgagtttgatcaagaacatagaagagttttcatcttccccttttgcaagtaattctacctgtactaataatgacaatagttttatcaaatgtagtttagtatcctaatgtataacagcatatttaaaagagattttgtacaacatacacctgcctaattgtttccaaaaaagaattatttgtgccaagatatcataaaaaagtataaattttgtctaatgccaacctagtatttttttatattttaatagatacttggaataaatcatatctggacttctaatctccctaataccaaaataaaaatgtcaacactattgatgagatttaattcttgcaaaatatgttttggtttaacaggttgtgtatttaggctcagtgttccatggtgattaacagtcttttgttttgaatttctataggtctggctattttagttgccacagcatggtatggcaatagaatcgttcaagaattctatgaccctatgaccccagtcaatgccaggtaacgctattcaggcgtaaaatagtttgttttctgagaaaatgccctttttatattctacaaagtcctgctagtgccatcatttcccagatttgctttcaagaattttatgtcaaacctacaaacaatttaaatgatctctgacttatgtcaaaatgagtttgataattgctttaacaccctgtattgatgacaaaataccttccaaagtagaaaagtttcaagctctgtgcttttcaactgtataactgggctttcttttgtttgttttttcaaatattaataaagatgttaatatatttgaaatttcctttttgaagtgtattctgatgtttacaacacctacctaagattatttgtaactaatgcacagtttatgattgattgagaaaaattatactactataggggttaatgaataatacttcattcccaacagttcatttttacacgtaaagctattatgtatgtttttagtatgttcagataccaccttgaaattttttgttctttcacaactgtaaaattggctttacaaaggtcatctttcttaatactgcaggttgtgcaagttgagctgattcttagctctcgtgtaacaacattctttaatcagagacgaggctcttcatctcactgtcttcacatctttaatgcctaataactacattcagtcaggatgttaaaatataattattgtttgttgagtgcttagatgaatggatgaaaaacctcagtgtttggagagataagatgtgtttctttttatataatcacccacatatgggagaacacatactgcaatggttgtgttggagcccatcccataagatttacagtgtaagaatagaaactgctagaggtcagtaggctaaaatttcgccaaggtaataacaccagtaatgcacaggaaagcactttataaattgccagccattttgcaattgttatttacattattgcatgtgatcctaaaagcagtctattgaggcaggtgggattatcctgctttgagagtaggagaaactgaggctgagaggtgaagttgctatcccagaattgcagcagttgagagtctgcatcaggatttagacttggccttataacttatagaaccaacccttctctactcttccgtattgtccataatcactcacagataccccaccctaagtgtctgctttaatacatctgcctggatcagcttaatccagaatggttcatgggctgcttagaacttttctttacaaaaccataagatttggatttcagattgtataggtgcctgggaccaatggatcatctgttcaaagctctgattatctccattatgctctatcagtttctttatagaatatgattactacttagtgataaagcttcctttgctaagtttcagcctaggaaccatgatccaaaccctacttctaaaacatataaacatgctttacaagtatcctatatatggaaaagtccttggaattatttgtgtaattaacctggtattacatgtgttatttcctgatctactattgcaaattgtcaccaattgcaatataaacattctttggcgtgtatgttcagaaatcttaaagtacttcccaagggatattcaggggttattttcaatgaaaaaaatacaatgagtattgattttttttccttttattatattagaaaagttgccaataattcactgattaacaagcacatgggtttttccttttaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacata

SEQ ID NO: 12864 - DNA, 31875 bp, Human
agaagttcgagaccagcctggccaacatggtgaaactccatctctacaaaaaatacaaaaattagctgggcgtggtggcgggtggtgcctgtaatcccagctactcaggaggctgaggcaggagaattgcttgaatccaggaggtggaggttgcagtgagctgagatcacagcattgcactccagcctgggcaacaggtgaaactctgtctcaaaataaaataaaataaagaaagaagaggcctataccttcttccaagccttgacggctcagcacatacttctctgttttcatgctcaagcctaggtttagtaggcctgagtggcagtgggagattcaagtgctgggggagacctttggcctcacattcagattccaccttgagtcccatgatctcattgcaaggttagacttccattgtttaaggtaaataccattttgataactcagttacggcttttcatgtattattatgctaggagggaggctgaagagtgggagtggccctggctcctgaacacactattctctttcctgcctgaaggcctccgcatgtgccattcctgattcttggaatgtttgtcccttggcctttatcatccttcagagttcattatcaaagccacccctcacaaagcccttcctccgccaccccattcaaaagatctcttgttattttccatcccagcccctgattccttttctgtatagcactgtcaaagtgttttcaggccaggtgtggtggttcacgcctgtaatacaacacttttggaaggatgagacaggaggatcccttgaagccaggagtttgagaccagcctgggcaacatagcaagtcccctgtctccacaaaaaatttaaaaattagctggatgtggtggctcacatctgtagtcccagctacttgggaggctgaggtgggaggatcccttgagcccaggaggtcaaggctgcagtgagccaagatcactccattgcactccagcctgggcaacaagagcaaaacttccatctcaaaaaaaaaaaaaaaagaaataatctaaaagtgttttcaataataatgcatttatgttgattaccttgttggctatcctctactcgtgtgcctgccccactccattcccctttctagagtctgttcacgtaactcctcttccaggaagccctctttgactcccaggcttggtcaggtgtcttctctgggtttccccaggggcttccttcctctcaattctgatgctgcctgtgctaagtatttgtctccatatctgtcctgagaaccttggagccagggctcggggctgtttttgcatgggcctatcacctcctccaggaagccctccttggccctctctcaggctggatgggaaagctgtctgggctcccatcatgccctggttttctagcgacccagcctctgatccctaagcttggccttccccatcacagctttcatcactttgtgctaagcttccgctatcactactctgggccgttcctgtttggtgactcagggaccagtctggcatggccaccgctgggtccccagcattaagccctggagcatgagcccagtgaactttgaaattcaggaaggaattcacaggaaagctgcggcgaggcgggcagaaaaccacaggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacggtgagggccgggcgggtaggctggaggcggggcgcagggggcagaggctcgggggtcaacgggggtctgagcagggagaactggcgggggaggaaactgggggctacttgatggcgttcagcgggtgtggtggaaccagccctggaggattgagccttgaaatgaggtttgggagccttcgacagcgaagacgggcggaggagcgagggttaggagagtttccttcgggtggaggaagagtcaaggggtattgaccaagaaggcgtggcactgccccttcctgtggcaagaacggggtgaggagccgaattgaagaccagccttctcctggcggtggaaagttccatggccaaagctcagggagaggccaggcctgtgagatggtgggggttgggttgggtgacctggtggccgttttagactcggaagaagcccatctcacccctgcctctttggagattggacaagagcctcccctgaagtttttgtagttgagttgcagtaaagtaggtgcccgagaaggagggagcaagaaaggaaacaagctttggggaagaggaagctctgctaaggctcgagagagtattggcgttgagcagctggtgttggggtctttggattggcccttagaagtcggtggtgaataaggtgatttaaacttctacactcttaaggaagtgtggtctgaaaggtctctttgaacaagtgttgttataaccttaactgcttcagacaagcaccagcgtgttttgaaaagagctctcttgaaagcaagaattcattgattcagcaaaacttactgaggccctgctacgtgtcaggcactggcgctggttataacagttaactcagactagctgggttcctgcattcacagagctaatattccagtgggagaggcagagctagtgaaggtttaaaaagcacttgccatgagattaagttactgagaattaaatgaaccaggtgaagtacaccaacagggtgacgtaagatgttgggggcggctttagctcaggtggtcgggggacgtctccgtgaggagggtgacatctgagctctaacatgaagaatgaggcagtagccacacggagacctgggggaccagtgtccagttgcaggcaatagagtacaaaggccttgaagctggaacaagcttggttgggttcagggaaaagacagagccagcctggctggagcaggcgtgaaggaggggaggactggaggaggatgggaggtgggagaggttggctgcagccagatggcctagggctttatagacaggtgctggtgcttgaacccgggaggcggatgttgcagtgagccaagatcgcgccactgcattccagcttgggcaacaagagtgaaactcccatctcaaaaaaaaaaaaagaaggccgggtgatgtggctcatgcctgtaatcctagaactttgggaggccaaggcgggcagatcactggaggccaggagttcaacaccaccctaggcaacatgatgaaaccccgtctctaccaaaaatacaaaaattagctgggcatggtggtgcacacctgtagtcccggctactcgggaggctgaggcaggagaatcgcttgaagcccagaggcggaggctgtagtgagctgagatcaagccactgcacagcagcctgggcgacacagcaagactcagtctcaaaaaaaaaaaaagagcaggctaggtgtgtaccaagtcatcacctgtggtaacttctggggactggttaatttctctgtgccctaggcaggagaaaaaagtgaattggtggggagaggctcagctgtaggtgactgggagtcaggaatgcagacgttgatcattcttgcaattcgaaccagaatttggcagctctgctggactttttcagtttaagtaattacgttaggatgtacctcccagttacctggcctcttgctacctctggtgcttactctgagctgggacatggcctcttgctacctctggtgcttactctgagctgggatgtgccatttaacctttgaaacagccgggtgcggtggtgaagttacttgccttgcccgaggtcactcggtagtagtaattgacaaagccaggtctcactgcagaggccttctctgttcagagtggcctacctgactgctgctgccgactggacctactgacctttcagaagtactagtgtctgactgggtgaactcatgccctcactcatcgtaagttctgtttgtttgaaagcttgaacagcttaatcggaggcagaaggcagttttgacttttttttcctcgctccttcctgattgcttctgttttctccggaagcgagtcatccactgggagtgtggtgttgctgaagctccatgcagtggctcaggtgctgctggatgagtgtggtggtgagggaggagtgaacagagaatgtgtgagggagggaggatgggggttggtcaaggaatttattctgtatgaaaacatgagggggcggagggccgaggtagatggtagggccagcagattgttggagttgaggttctgaagggaatgaaccagacagataggatgcagtgggtagtgagtgagatgcatgagagggaggttctgaagaggtggcagttactgagacaggtctaggtgtgaccctgagaggaagcgggggggcgagggtgggaggagatcaggtggaggtcttgggacctagaggtcagaggaccatctacctggatatagaaatctccaagaatgatcataagagcagcgggagaggtggcaggcccggagctaaagttgggaaggaagaagtagttgtctgggttggcagataacgtgccaggcggggtagtgaatgatttactctaataatggaagtctcccagctggggattttggggagggtggagggagaacagtccagaagcagctcccaggagcaaggagacctccccacttggaagggccccaggaggtgtgccctcaggggagattccaattaggtaagagggtggcaacaatgttcagaggagattgaggacatggaagatttgctcaagaccagtcctgagtaccagagggcccaggagttgggggaggggagatggggacaaagcaggccccaccgtgtgagagtgagggttaactcaggggtcggggcttcttgtgagaagcatcatgtggtctatgattgatgtgttggtgacgctctgagtagtgagggcaggtgggaagggacaggtggacgggccggacaaagagtgtcctgactccaacctctgcagacagaggtggggggaaagctgagcttatgccaggtgagaaagctcccctatctagcgttagggacagttaccgtctggagtggaaagcacgcagagattataaactgtccactcccaggaagcttcacacagcctttatgtgacttgtactttttccagaattgggattttttaaacgtaaaaatgtagtttttggctttgcctgaaagacatgaagatgtaatggaaccaaaccagaacacaggcctgttttcctgcccagcagtccctggcaggagccgagtacctctttcaggcaggagatatgccattccctagcctgtagatcttactcagcttgcctcatctcagctactgcttgccctctgtctctgtaggcctttggcttgtgacccctaccttaaacatatgctccatttagtaaatggtaacacgtaacagttctttataaattgcacattacagtgtgagacagagagagagcatgcgcgcgcgcgtgtgtgtgtgtgtgtgtgtgtgttacggctggctgttggggaaatccttatatcaggtagctgcagatatgcaggatttttttcttttccttttccccacccaggtggtaaatcctggtatttggagggtcctgaaatgtgtaatgttgctcaacaccaggccagatcatatatttcctcagcagaatagaaacttgaaaggtcctttaggagtggccagttaggtgtagttcttgctgccaataactttgtgcctggccctgggcatcagaacttgtgttaatggttacttggcttaaggtcttttgtttttgtttttgtttgtttttgtttttttgggtttttttttgagacggagtctctctcatcgcccagtctggagtgcagtagcgcgatctcagctcactgcaatctccacctcccgggttcacatcattctcctgcttcagcctcctgagtagctgggactacaggcgcccgccaccacgcccggctaattttttgtatttttagtagagacagggtctcaccaccgtgttagccaggatggttcaaggtcctttgttgattcttcttgggaatttccactggaggcaagcagggcaacacttatttgagaacctctcctgcaccttttttttttttttttttttttgagacagagtcttgctgtgtcactcagactggagtgcagtggcgccatcttggctcattgcagcctctgcctcctgggttcaagtgattctcctgcctcatccgcctgagtagctggggttacaggtgtgcaccaccacacccagctaatttttgtatttttagttgagatgggatttcttttctttttttttttttttttttgagacggagtgtctcgctctgtcgcccaggccggagtgcagtggcgcgttctcggctcactgcaagctccgcctcctgggttcacaccattctcctgcctcagcctcccgagtactgggactacaggcacctgccgccacgcccggctaattttttgtatttttagtagagacggggtttcaccgtgttagccaggatggtcttgatctcctgaccttgtgatctgcccgcctcggcctcccaaagtgctgggattacaggcgtgagccaccgcgcccggcctgagatgggatttcaacatgtgggccaggctggtctcgaactcccgacctcaggtgatctgcccacctcagcctctcaaagtgctgggattacaggctcgagccacgtggcccagccctctcctgcacttccaagggattttcgaaatgcatggacctctcaggttaattatagtgtctgtagaaccttaactgctgtaagctttccagcagactccacagacgtgttattagttgccaccctttctttactttcctcctcacccccatggatagtcgtgaccctggtggtcagagataagatgacagaagagctaaagtaaagctggtgttggcgatcagctgggaattctctaaaacagcttctcacattattcttatcctccatagaaggagtgcttgtcctacttgcaggcaaggcagtttggttccagggtagttcgaaatcttattcactgatatagtcagcaaatgtttattgagcacccaccaattgccaggcactgactcactcaaattagagcactgaacaaaatagaccccctcccccatccgtggcagacgtgtcataatgagaggaagacagtacaataaatgaacagatgaatgtatgtctggtgatgagtgtcagggttggtgtgcttagcactgaaaatgggggcttctgaggttcaaatggttgcagttcctaaagaaggttgagggccttgccttcaggtcaccgcgggagactggcccctttccactggaaacattgctttgcccagtcagtatttgagagctcagcctgcaatggagaaatcacacttctcctctttcaccctgctccccaccctgtttctcattttacccatccccagccatttgcagaatgcatgcagagcttctgtttgccatgtctggaggctacaggggaggctgaataaggggtgataagcctgtggctcatgtgaggcgggagagagcccagcaggagtcacactgaaatgactccattagccccaggaggccttggcccaccggccatgactaatgtggacattagagtgtggattccgatgtcctgcaagatcctcctcacaagtgtcatttcatggtttttttctggcaacatctttttgaaaactccctgtaaagaagtgctgatgttgatgctgaggcccaggaactttggagtttatttacttttttttgttgttttattttccttggcaggtgaagtaggagctagagtttacttattttgaagtttatttgaaatatgctttttatgattagaagccattttagaaatgagggcgaggccgggcgcggtggctcatgcctgtaaccccagcactttgggaggccgaggcaggcgggtcacgagatcaggagatcgagaccatcctggctaacacggtgaaaacccgtttctactaaaaatacaaaaaaattagcctcgcgtggtggcgggcgcctatagtcccagctatctgggaggctaaggcaggagaatggcgtgaacccaggaagtggagcttgcagtgagctgagatcatgccactgcactccagcctgggcaacagagcaagactctctcaaaaaaaaaaaaaatgttatgctaagtgagaggagccacttacaagagaccaccacatgtttggccgggtacagtggctcatgcctgtaatcccagcactttgggaggccgaggtgggtggatcacgagatcaggagttcaagaccagcctggccaagatgttgaaaccccatctctactaaaaatacaaaaaaaaattagccgggtgcagtggcaggcgcctggaggctgaggcaggagaatcgcttgaactcggagggtggaggttgcagtgagccgagatcacgccactgcagtccagcctgggagacagagtgagactccatctcagaaaaaaaagagggcaagaattcacatgttgttttactcacacgtgttggagatggagctcagggtgattcctgactgggcccagggtccatggcctcagaagtcccttaatctgaagtccttcacttttatgtgatactgctgggcacaatggctcacgcttgtaatcccagcactttggggggctgaggcaggtggattgcttgactgaggagtttcaacatggtgaaacaaaaaatacaaaaaactagtcagcctgtagtcccagctatgtgggaggctgaggtgggagaattgcttgagcccaggaagtggaggttgcagtgagccgagatcgcaccattgcactccagcctgggcgacagagcgagaccccatctcaaaacaattttatatgtgatagtttgtccatgtgtatgccagggtctgtcatttagagtgtatggcatgttcttaaaggggtgggggaacaaaaagatactataatagtttgtgaccttttgaagggccgctctacatgaatagatatatagtatgtctgtggtgttaaaattttgtggggcgattaggaaaaacatttccaaaaagtcttagggggaaggtagtaatgaaaaaaggttgagaaacaccattccagagagagggtccaagagctttcctcagttctgaaaatggtccatgatttgcacaaggtaaagaatggctgaatgcgaattaacagcagacagtttcttagaagatttgaaactattgtttccttcccagctattcagatggactgctcgggttcttgttatggattgaggcgagggtagacttaatagtcttgtttcagagtggaatatggagtgatggtaggcatgagtagtgatgagttgcattgtgctgataggttatgaaatgtaaattttttattttttgatatggagtctctgtcgcccagactctggagtgcagtggtgcgatctcggctcactgcaacctccaccttctgggttcaagcgattctcctgcctcagcctcctgagtaactgggattacaagcatgcaccaccacgcccggctcatttttttgtatttttagtagagacggggtttcaccatgttggccaggctggtgttgaactcctgacctcaggtgatccacctgcctcagcctcccagagtgctggggttacaggcgtgagccaccgtgcccggcctgaaatgtaaacttttatatctaaatattttatatagaaaataccaagattttatatctgaaacaccaagattttatgagcctcataacttaagtaggatttgtaattgtaaatgttctttcctcataaatacctgaggtttttttttgaaaggttctgaattgtctcaataatgaaaacttccagacacccaagcctagaggagatgggtagttggtagctttctgtactggaaacagaaacactcaaatatatagaacctagccagctaaccaaagtaggtagatttatagatcatcttaaaataaggctgattacacagtaaatgtcacctttggaatctggcttggtagaattgaaataggcttcagtacctcctgtcattcagtacctgttttcttgaactcctgacttcaggtgatctgcctcggcctcccagagtgctgggcttacaggcatgagccactgtgcccggcctcagtacctctttttaagatgctctcattcattccctggtgaaaagatgcttgaagtgcaagtgcaagtaggtgtggaaagcatggagggtttgtgttgcttcatttgttttggtatttgttttttccaccagtccctccctctggctttctgcctcccagcccagcatatcctgatcttgtagccatgcaggactttgacccgtgtggtggtttgccattgtcttcctccaggtgaagataagacatcattggtttggcttgaggttgtacttttggccttccctgtatatcctcttcctccttatcctctccgtcagcatgcttggttggactctgtagtgaaatgtgtcattctctttattctgactgtccctatattagtcctgtcttcataaaaaatacaatcgtaaagatacaatatctactatttgttaaaagttttgtgctaggccaggtgcggtggctcacgcctgtaatcccagcacttcaggaggccgaggcgggtggatcatttgagcccaggacttcaatactagtctgggcaacatggtgaaacctcgtttctacaaaaaatgcaaaaattaaccgggtatggtggcacacgcctatagtcccagctacttggaggctgaggtgggtgggtcactgagcacaggtcaaggctactgtgagccaagattgtaccactgtactccagcctgggtgacagggcaagtccctgtctcaaaaaaaaaaaagaaagctgtgtgctaaatactattttaagcaattataatggattaaaaactcctttaatcttcacaacaatgttttttctttctttttttttgagatggagttctttgaaactcttggattaaatgactcttcagagctttctttgctttttgatactaaggagtggcatgtctggggatttttatagcaaataacttctccttggctactatccttagaattccaagtgtttttaatgaaaagaggagacttgtttttagtgatgttagttgtttttaggaaaggtgttctgcagtgtttttcgctaaggtggctcacgcctgtaatcccagcactttgggaggccgaggtaggcagatcacttgaggttaggagtttgaggccagcctggccagcacagcaaaaccctatctactgaaaatacacaaagtagccaggtgtggtagtacactcctggagtcctagctactcaggaggctgaggcaggagatgacttgaacccgggaggcagaggttgcagtgagcctagatcgcactattgcattccagcctggacgacagagtgagactgtcttaaaaaaaaaaaaaaacataaaatggagaggtagaccagcttacgggaggtgttgcacttccctctgccactggagagactctggatctgcagccagggagcttgtgaaggcttcttgtccacggaaatgagggcggcagttgtgactttctggatggtggcccagaggaagcaacactggcagagcctcttctgtgaagcagctctgagagcaattttgtgacattgaaagagcaaaggataaaacgttgaaagctgatccagatctagaaaagtgtttggcaattgctggaaaaggtgtagaaatgatgcttgctctgtatcgtaagttatatggtgagaagaccacaagcacggttcaaactccccttagaaattcttttgcacagaaattaacactttaatcctaaatgtttccaatgttttaacttacagtatgctaaataaacattctttctgtttgtttgttttgttttgttttgttactctgtgcatttatagccaatagagtttttctttccttatttttttgacacagggtcttgctctgtcgcccaggctagagtgcagtggtgcgatctcagctcactgcaacctccgcctcctgagttcaagtgattgtcccgcctcagcctcccgagtagctgggactacaggcgcgcgccactgtgccgggctaagttttatatttttagtagagatggggtttcgccatgatagccagggtggtcttgaaatcctgaccacaggtgtgagccactgtatctggccaaaaaaatttttttattttttgtagagacagggtctcactatgttgcccaggctggtcttgaactcgtgacctcaaatgatcctcctgcctcggcctcccaaagtgctgggattataggtatgagccaccatgcccagcttgacaaaaaaatttttttttttttttgagagatgaagtttcactcttgttgcccaggctggagtgcaatggatcagctcactgcaacctgtgcctcctgggttcaaacgattctcctgcctcagcctccagaatagctgggattacaggcatgcaccaccacgcccggctaattttgtatttttagtacagacggggtttctccatattggtcaggctggtctcgaactcctgacctcaagtgatccacctgcctcggcctcccaaagtgctgggattacaggtgtgagccaccacgcccagctgacaaaaatttttaaatgtcattgagcagtatcatttttcccactgattatgagattgctttgtgtgatcacacactgacgggcaggccaattgctgcttgtattcagtatttggccccttatagaaaacatttgcagacccttgttctagaaaaaacagatgggtgggaggaggaggaggagaagcatttcaggagtggctttgggctttcctgtcctgcacgtggtgaggcaagaagctcttgtgcctcagctcatagcactcatgggagtctgtcaataactagaaccctaggagttatttttgcttgttttaaaaataagcttgttttggggccaggcgtggtggctcacgcctgtaatcccagcacttcgggaggccgaggcgggtggacttacaaggtcaggagatcgaaaccactgtggctaacatggtgaaaccctgtctctactaaaaatacaaaaatcagccgcgtgtggtggcgggcgcctgtagtcccagctactcgggaggctgaggcaggggaatggcgtgaacccaggaggcggagctttcagtgagccaagatcgcaccactgcactccagcctgggcgacagagcgagactccatctcaaaaaaacaaacaaacaaagcttattttaatggatataaaaacatgaatgaaataagacaccaagttcaaggtggtagggggttaatttggaagaggcagagcaaatgtgattgaatgaggggtatgcaaagggtttctgctctatccatatgttttatttattaatttatttttggagaacaaagtctcgctttgttgcccaggctggagtgcagtggcgtgatctcggctcactgcaacctccacctcttgggttcaagcgattctcctgcctcagcctcccgaggagctgagactacaggcacgtgctaccacacccggctaatttttgtatttttcagtagagatggggtttcaccatattggccaggctggtctcgaactcctaaccccaggtgatctgcccagcaggcctactctatgttttagtccttgagaatgttagaatttgatgacactgagatgtggatataccagacatggggtattttctgtactcatcagcatatttgaaatatttcattaaagttcttactttgcaaagtagacacagctgcaattatgcatttttggaaaatgattaggtactatctcatctgttttgtttttttgtttttttgtttttgagatgaggtctctgtcacccaggcctgagtgcagtggcgcaatctcagctcactgcatcctctgcctcccggtacaggtgatcctcctaccttagcctctcaagtagctgggactgcaggtgcacaccaccacacccggctcattttttttgtatttttgagctcaagcaatttgctcgtctcagcctcccaaagtgctgggattacagatgtgagccactggcccagtactatcttgctaagcctataaaattagattagattggtagtacttgggacccctcagaattctataatgtccttcttagaaggtgacagcagatctatccagcagactgtagattgttgtcttagtcaccggctgattgtcttggttaaagctctagtgacttcagaaccagagaaacttgttttccaacacattcaaagaccagtttgctttgcaattttgcaatagctgacattcagaatgcctgcgaggattttgtaagtgaggttcatatttcggataatgtgtgacttttgccatttctgatgcttttccaaaagaaagttactcttccctaaaggcaggaattctacttttgcttagatattctgaagcttatgagttcatccaaatttggttcctttcagcattttcctgttggtccgtctccgttttgaaaacatacagaatgtacttaattttgccctaccatttgtgagcatacaaaatagcacttgagtcatatttttcatgattgcttcccaatactattctaagaccaacatagcattttgtcatttcataataatagaattcctcattaaggaataactttctaaaaatgtgtccagcccatttcccccccagccctggccgtttcctttggtatgttggtgtccgtgaccctgtcattgagtgtgactgaaaacagaggcctggcagagggcctggcctttgtgagccctcagattgtgataaagaccctgaggaatgttttggcttttaggcaacctcagttctgttttcctgctgcctgttgatgcagtggctttttcttcccatcagtctgaagggtcgtgttagtgcctgggctctcatcagaccacagggaactcatcctggcactgctggctgcctcactttaaccacctcaagtctcagcattctcgtttgtaaagcggagatattattacgtgattcacagttttattgtgaccattagaggtagggcacatgatatgccaggcatcatgcttggcgaaggcaataagtaatgcagccaggtgctgtggctcatgcctatgatcccagcactttcagaggcggaggcagcaggatcacttgagaccagcctgggcaacatggtgagaaccccatctttacaaaaaattaaagttagccaggcgtggtggtgggtgcctgtagttccagctactcaggaggctgagatggaaggattgcttgagctcaggaggtcgaggctgcagtgagctgtgatcatgccactgtactccagcctgggtgacagagtaagactgagtctcaaaataaataaatacaaggtttttgcagaacagtgaatgagaaaatgcactgttgttatttgtggtggaagtgaatactatatggcctgtgtttcctgaaggaacactgcctccattaaaacaaatgagcaaacaaaatcccttttcatgacttcagttctctcaggcctgagagtaaagtttacatcatagatgcttaaaaacaattcagttagtgaaagcatgtgacaagatgagacgatttgtcttcaacgaggagcttccttccatactcacaaaaagatgtgtgtcttaacatagtaaggacatggttaaatttagtcttatttggacctaacttcagccaattaatctgctacttagaactcttttactcaaatgaaatttgagtaaaaaaaaaaaaaattttttttttggccaggtgcggtggctcgtgcctgtaaacccagcactttgggaacccgaggcaggtggatcacctgaggtcaggagttcgagaccagcctcaccaacattgagaaaccgcgtctctcctaaaaatacgaaattagctggtgtgatggcgcagtcctataatcccagctactcaggaggctgaggcaggagaatcacttgaacctgggaggtggaggttgcagtgagccgagatcgcaccattgcattccagcctgggcaacaagagcaaaactccatcttaaaaaaaaattattataataattttcaagtatatacaaagcagtgacacattttgtaaacccccatgcaccatcacacagcttcaacaactaccaacatctgtctttcagacatgtttttagtccaagttttctcttaataaagagactttttctttttcttttttgtttgtttgagactgagcgttgctctgtcgcccaggctggagtgcgatggcaagatcttggctcactgcaacctccgccttgcgggctcaagtgattctcctgcctcagcttcctgagtagctgggactacaggtgcccaccaccatgcccagctaatttttgtatttttagtagagatggggtttcgccatgttggccaggctggtctcgaactcctgacctcaggtgatccgcccacctcaccctcccaaagtgctgggattacaggcgtgagccaccatgcctgaccataaagacatgtttctaaattctcctgggacaacagtgaagttctacctttccttcctactttaccgaaggaacctgaaaataaggctgctttctgaaacttaaactactaagtcagtgatatttagagcagatgtaagcagctgtctagacacagaatggcttcccaggctcgcaagacttgtcatgaagcccccagcacgtcaacagaaagcatccaagctagaagaggcactggctcacagcagcaccccagaaaggaagcgtctcagggacagatcgtgaccgtgctccggaagagctgtcctcagccgctactgtgagcatttggcctgcctgacagattctgttggtgagaatgttcttaggaatcatacagtaaactaactttattctgacttcaagcatcgtgttccattgatgcttgctttccaaggtgttttgctgattcacatcagcatgcaacctgcttgacagaatacagtgatgttctcactgtaaattcatcacctgctgctgtggtctcatgtatcatcccgtgcgctgttagctgaggccagtgctcctgtgtctcctcagcacgagggcactggcaagagtgcatgtctgggcctataaagatgttggccaggttctaggcagggttgaattcaccaaggtaactgccatccatccctcaataggcattttttctcctacacaccctcaggcacatgccacgtgtacctggcacccttacttacgaagttaccgaattcctgccatgatactgtgggtcaccctgcttcattctcaggtgtggtgtcgggtggttcctgcctgggcgccgggtgttgttgggccctccctcaggttattggtttttgttttgagatgtaattcacatgccatatgattcacccatttaaggtgtacaatattcccctgaagtttattgtggaaaaaggctgtgtctgacactgcttaggaagctaagacacaaagcagccagaggggctgccagggctcactgtggcagggcggcggagaggctgctggcgcctctgtagctgttgggtgctcttgccttgatgctgttttcagctttggattgtaattgggtcccacgtgggtcctcttcatctcgtcttgttggtggcagtgttgctcccagcgttggggtgggcagagtcacacaccagaggacctcctcctgctgttttctctggaccttgttgattatgtgttttgtgacctttggcatattgtacctgttccaggtgtacagccagctggttttggttgatgtgtaatggacaaaaggtgcccctatttaaaaaaaaaattttttttctgcttgtagtcccagctactcaggaggctgaggtgggaggatcacttgagcctaggaggcaaggcttcagtgagccatggtcctgccactgcactccagcttaggtgacagaggaagaccctatctcaaaaacaattatataggccgggcgcggtggctcatacctgtaatcccaacactttgggaggctgagatgggcggatcacctgaggtcagaagttcgagaccagcctggccaacatggtgacaccccatctctactaaaaatacaaaattagccaggtgtggtggtgcatgcctgtaatcccagctacttgggaggctgaggcaggagaacagcttgaacctgggaggtggaggttgcagttagcggagatcacgcctctgcactccagcctgggcaacaagagtgaaactctgtctcaaaaaaaaaaaaattatcataaaatcactcgttttaagtatatcatccaaggattttagcaccttctacagagctgtgcagctattgccacaatccaattttagaacattttcatcatcccctaaagatccttttacccatcactccccattcccacccccagtaccaagcagccactcatctacttcctgtgtctattgatttgccttttatggacatactgtacactttcattcatatgaagtgtctagataaggtaccctctaacgggtgacttttcatggttagcttttttcaaatgatagggaatttcctgcttcagaagatgctttttctgctgtgctacttacctgtgatctattgtgtgggtgggatttccttggaggcatgtatgtgtttgtttgttttgcagagtagcaaccttttttgtccgttgattagtgttctgtggaacatctggtttcatgcccatcactgtgacatatttggggagacacaacagaagatatatccctagtgggtgaaacaaacctaacaaacatgaaaacaactagcgaggagtcaatgacaacatctaagcaagcgtttggctgtgggatgcttttattggagacatgtttatcaagcatcctgtgccaggccctgtgcaggttggaatgcccttgtgctgagcaggcagaggtgggtgaaggccagggttagggaggggtgataaccgtgatacaggagcagacatggagccacacagccaggctgttttcttttcaggtcgccttcaatccttccagtggaaaggcttattttggtgcaggtgttgcttctagcaattgtttctctctccctttcaagagagcgtaccgaccttttgcaagaagtgtttctggctggaattttataacattggcttttgtttcccttttactaaagtagggccagatttgagggtgccttgaaacccaggcccatcttggtgtgcccaaataggagctgtaacaagccgtggtgcaggggtaggacctgtgttgtctttggagccatgggctgggctgcaggcactcgagttaagaagcttccttctgaggctcttccagtaatttgagtgtcctgtggcctgcctgggcagagagtggacaggaaagatcaggaaaagcacgtgtgaggactaccgagggtgctgatagcgcctctccttcccaacttcacttctctggctctgacctttcagccctaagctccccttggccctgtgggatggggcagcatccagaagggtcttggagtcaggttttgttttgtttttttttttttaagtcatgtttccattgggcgtagtggctcgtgcctgtgatcccagcactttgggaggccgaggcaggcggattgcttgatctcaggagttgaagaccctcctgggcaacatggtgaaactccatctgtactaaaagttcagaaaaaaaaagcccagcatggtggcgcacgcctgtagttccagttgcttaggagggtgaggcaaaagaatcgtttgaacctgggaggcagaggttgcagtgagctgagatcgagtcaccacactccagcctggcgatggagtgagactctctctccaaaataaataaataaagttatgtttctacactggatgtgcatgtcttcaataatggggacaggggacaaaacacacaactgaaatacagttcagtgggtgggttgctgtctttattgttgggtgatgtgtttatacaaggaaggaagcactgagtgggcctgttgacgatctgggcttgggaaacagctcacaggggaactgctggaactcaaggctctggttctcctgggggatccatgtacaggtctgtgcgtgtcctttgttgccaggattgccctgccaagctaaccgggttgtgcttcgcgtttcagacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacaggtgagatggcagtagttggagcttttgtttttttccttttttttttttttttttttttttttgagacggagtcttgctctgtcgcccaggctggagtgcagtggcgcgatcttggctcactgcaagctccgcctcccgggttcacgccattctcctgcttcagcctcctgagtagctgggactacgggcacccaccatcacgcccaactaattttttgtgtttttagtagagacatggtttcaccttgttagccaggatggtctcgatctcctgatcttgtgatctgcctgcctcagcctcccaaagtgctgggattacaggcatgagccactgcgcccagcccctgctttttttttagacagggtctcactgcagcctccacctcctgggctcaagcagaacctcccacctcagcctcctgagtagttgggactacaggcacatgccaccacaccttgctcattttgaaattttttatagaggcgggggtctccctatgttacccaggctggtcttggactcttggcctcaagtgatcctcccacctgggccttccaaagggctgagattacaggcgtgagccactgtgcccagccagattttgctctttagagacaatttattaactggaatgtggatactttcctctctttattagttcttgacagtggaatctgggtgacgttttaaaaagcagaagaaacaggcaccgtgtgaatgtcctggtggccgtacagtggtttcacagcagaccctcactcctcctcttcccagaaagggagcaaaacaacagggcagagctggggccagcgtgacccagcttcctttctcccactttactaagtgcaagtttcagagcagaccaaagaggaagtagccttgccttcttgagcagaggctttttgatccactccgacagggctgcccctcttgttccctgggtatttgggttattttattttattttgagacagagtcttgctctgtcgcccaagttggagtgcagtagagcaatctcggttcactgcaacctcagcctcctgagtagctgggattccaggtgtccaccactacgcctggctaatttttgtatttttagtagagatggggtttcgctatgttggccaagctggtcttgaacttctggcctcaggtgatctgcctgccttaacctcgcaaagtgctgggattacaggtgtaagccaccgcacctggccgctatttgggttatttttaattgtgggacaagtgacttgaatagctcacccagccaagttaccgatcaagttaaaacaaacatacgtcctggaatccatcctctttgcggccctcacctgcgaggagttctgtggaatcaaggtaattttgaccctgataacctcacagtttaaattaaaacctaaacctcccagcagcgtgccctggctcttagctgagtgagaaggacttcctgagagctggtggtgatgagacattggccctttggggctgctccatcccgagtgttccagagacccgagggtttggccatccaaatcctatgttaaagattttcacttttttctttttttctcgcttagtcgcctaccaggctggagtgcagtgatgtgatcttggctcactgcaacctccacctcctgggttcaagtgattctcgtgcctcagcctctcaagtagctgggactacaggcgtgcacctccacacctggctaatttttgtgtatttggtgaagatggagtttcaccatgttacccaggctggtctcaaacgcttgagctcaagcaatctgcctgcctcccaaagtgctaggattacaggcgtgagccactgtgcccagctaaacatttcactttaactgaaaaaacaaacaattacactggcctttaagtaaaaaataaataaaaatattttcagcggcactccccctaacatgtttttttgatgacttggtgttgtctctgtgagccaccgttgacccagttactgtatttctatcgtcagctgtgattcattatgaaggaggacttgggagaactatcttttgctaccttttctgagctatcccagtcaagagttgcctttagcaaatgtatctgtccatcctggctgtttgttacctcctcaggaagggagctgaagtgttgagaactcaggcagtagacagtgaacatagccaggggacatgagtggctgtgtgttcctgggagcaggcaggttagctgtctccctagagtccggccccgccttgcaggtccagaaagcacatattggcatctgactggctgcaatgtgtgtctctcgaggcgctcccatgtgagtctgtaaagagctaaacactgccagggctgctagtgcctggggtcctttgccggcatattctctcccaggcaggcaggctctgtgggaaggcaagtgagaatgagactgccagtgtattaattcatcatgagaaccaggaccgccccggggagcaggcactcgtgtccccgggcccacgcctttagtccgcataggcaagtctctagtccagttgccagaagactgcttgatgaagagagaggcagaacgcggggagctggtttgcaaggtgaccgtttaatagcatcaggctaggccaggcccgaggatgcggaggagccagggttccctccatcttggacgaggtgtgggagataagcgctgtgtaaaatgtatcatgtgggccgggtgcggcggctcacgcctgtaatccagcactttgggaggccgaggtgggcagaccaagaggtcaggagatcgagaccatcctggctaacacggtgaaactccgtctctactcaaaatacaaaaaaaaattagccgggcctggtggcgggcgcctgtggtcccagctactccagaggctgaggcaggagaatggtgtgaacccgggaggtggagcttgcagtgagctgagatcgcgccagagcactccagcctgggcgacagagcgagactccgtttcaaaacgaaaaatttgtcatgttaacctttaaaaaaagtgtcgtgttttgttttgtttttctccccccaaagagattaggtctttttatgttgcccaagctggtctcaaactcctggcctcaagtgatgccccccacccttcacccagtgtaagcactggtattacagttgaattagttagatgagttgatacagttaagcaattatttggccctggaagtcactgtgttttgattgtttgtttctttctttgagacggagtttcactcttgttgcccaggttggagtgcaatggtcaatggtgtgatctcggctcactacaacctctgcctcccaggttcaggcgattctcctgcctcagccacccgagtagctgggattacaggcatctgccatcacgcctggctaactttttgggtttttttgtttgttttttgagacggagtctcactctgttgcccaggctgagtgcagtggtgcgatttcggctcactgcaacctccgcctcccgagttcaagcaattctcctgcctcagcctccggagtagctgggactacaggcgcgtgccaccacacccggctaattttttgtatttttagtagagatgggttttcgcagtgtcggccaggatggtctcgatccctgacctcgcgatctgcccaccctggcctcccaaagtgctgggattacaggcgtaagccaccgcacccggccctaacttttgtatttttaataggttttgccatgttggccaggctggtctcaaactcctgacctcaggtgatccacctgccttggcctcccaaagtactggaattacagccatgagccaccacacccggccaagtcactgtctttttaaggtcactttgcacatctctgctctgattccctgcaagttaatcttaagtttcctcttcgggaggcaatcttggttccttatttccaagttgtggtctggcatgcacattgaaggtcccatgtaaaggagaagtggatgctgtggtgagaggcgcacagggccagctcattctttgtccctggcagtctctcgaaagctctttcactgtgctgtttctttgtccccttgcagagaatgccacgggtgacctggccaccagcaggaatgcagcggattcctctgtcccaagtggtaggttcttaaagagacccgcgatggagtgaggccaccggatgggtcattgtgaaaggacacttgtcatttgggaactgtcacaggcttccctctcatggttctgtttactcaaaattggcaaaccgggggctctgcctgggctgccggcttctggctccagcatccttatgggggagtttatactgtccagctgacacaggggccggggatcctgcagcacttcctggctggcccccatctcctcctggaggatgggatggaggtggctgctgcccatgaggctcaggcccctccttgctgtgcgggcctccagctgctctgctgaccccactccccgcccaccctcctgtctgcctgttctgtctcctctgcttcctttgctccctgttgccatcgctgtcccctgccccgtgggcatcctctgtcctctgccacccccgcctccccgccactgcagcttgtgatctcaagatgtgtgttagcttgctttgtagtgctggcggctgctgccccattcctcctttatggtttaaggactctgcatcgggcgcctggggtgagtggtcccgatgcactaccaggtagcaaatgcaccctcggggcagacctcaggccatggactctgggaggctgctgtggagggggtactgcaccgcacccctgctggaggatgggactcccccggcagctgctacccaccgagtgcactgtagctcagcagctgttgggccggctggcttgcagagtgctggggcgttagggtggtcactttccagctttgctaggcctggagtcctgtgcctgtcctggctttgctctgcctggctccctgtttatcctctgctagcccccccacacaccagctctggtttccatcttgttggagaggaacatgtccccctcactgtattagaaagtgtgaacaagaccgtgttccctataatattaggagctgtggcaggcttggtttctataggaaccctgaggtggcggcagggccaccacatccagcactctcagtgtgtgcgtagagcccattagggctggggtgacgtggcagagccggccatggaaggggctacacaccccttcttaaaggcgtgtccacactcctcagtgggcccttccagacccagacccagctaggcctgtgtcctgtgtccggcccagcctccctaacacagatgtttgtgtttcagctcccagaaggcaggattctgaagaccactccagcgatatgttcaactatgaaggtaaaactccaaagaggccaggtgcggtggctcacacctgtaatcccagcgctttgggaggctgaggtgggcggatcacgaggtcaggatatcaagaccatcctaacatggtgaaaccctgtctctactaaaaatacgaaaaattagctggacgtagtggcatgcacctgtagtcccagctactcaggagactgaggcaggagaattgctcaaagcctgggaggcggagggtgcaatgagccaagattgcgccactgcactccagcctgggcaacagagtgagactctgtctcaaaaaaaaaaaaaaaaaaaaaaaaaaaaactccgaagaaacttatatatggggcaaaacatgtattcttagttgggtattgagagacacttgcggattttcactgaggaagttgtagagcagggctctcccctccccaggtggtggcagccccctgaggttggggtcaaggtgacaggccccacgtggatgccgccagcagtgggaaggaggctgcgcctgtggagatgtgcgttagaggcgtagcctggcacgtggctctgcaatttacattgtccctgaacctctcgccagcggcttggctgtgggcaagtgactgttgccccgcctcagagttcccatgtataaaatgaagggtcccagataggtctcatagagactcagccactgcatgtaaaaggcctagaacagggcttggcagagagcagccttcaaagctccgaagccgtcacctggacccaaggagcagcgcgtcagagccgctgcactggtcttgggtgtaatttacaggcttctttaccagagagatgtttctccgtctgctggagccgcaagcctcctcaggcactttctggcttgcttcccctccttgcgggccctactaatttgtattccctgggctgtcttactcctagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgtaagtctgcagcccctcagcccaggaagccctgcccttgaggaccccggtccatctccccatccctaaaatatgaaggccttggaaatgctgttcttgggcccaccagggcagcaaggcctctaagccccagaaaagctggaagaaagcccctcagaaagagctccccatggaggccctggctgaggggatcccctgcggcagctctgtggaatgggggctgtgagctgacctcaggctgtgtgttctcttccaggccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagtcatgtttctgcgtgagaatggcgaggtggtggtttgtcccaccgttcagtgtacacagttggggctggagtgagtcagtcacaaggcaggccctgcccaggcggcgtgggtgactggggatgaggtcttcctgttgagcatttgaggactgctgcacacgggcctgaggctggcctgaggtgtggagggagcgctgctatgtggggcataagagttggtcacgggtgacaggacggaggaccacgggccagggtgtttcccaacacagtctggtctgagcgggaggccaggcctctggcctgtgtttctgagcttgagttgcaggtgataatgttggcacaaaagacctgccatgccagtctggcctctttctccacctgtttcccggtgaaggagccaggacctggcctgcgagtctgtcctgttctagcagtgaagcctggtttgccaggcacggggctgggaagcaagcagtctgggtctggagggtggccccaaaaaggccaactctgcagctccacagccacatgggggaggctgccacaggtcacactccttagccggatcccctcctgaagaaaagcatctgagctgaccagcgagactgcagtggggcagacactattaaatttgctggcacagctctgagtaccccctcgcttccaccctgacttcatcccgcagtagctctcagccctcccagcccctgcagggccacgtctttctctattgccggtcagcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactgagtgcccgtgaactttcgccaaaccacacttagcctcaccacctgtgaacactgatattttattactctatttcactttttaaaacttctggctacaaccctctgaactgatcttgatgtcccactatagactgtagcccacaccttgaagcactgccctcgagggcgcaggaggggcgcatgctgtccagggaggaccaagaccttccggggttggaggggcttaaccgagtccttgtggcgtccatgacgcttctcctctcgtggttctgtgctctctgcatcttgaaggggtggtgggagggcgctctaggtcaggccttgcaccgcctgccctgggcttttctgtcaagtctccaacacacccctgtgtgggaacggggacagagaactgcccggctgaatttggccttcaggcccaatcctgctgcctcctgtgggtgttcctttcctgacactagactctagaagcccctttcctccctcctctattccaacaaggaggtcctggggtacaggcatctgggcgccccatgaggtccggcaagcagctggactctacctgcctcagagacacaggaggagtggccaggtgcagtgccacaggccagactgctttcgactgcttggaaccaaagaacttccatgtctttcccttggcccttcctagaaatcccttagggcttaaaactctcttccagaagcaagttgggcaaatagctcatctgctcctgccccgcctccctcacagcagatgccgcaaagggatcctggtgtcctcccagctgatccccgcatgcctcagcccactctccagtggtcattgcagctggctcggggttggtgaacaagtggaatctacttaccacgtcccagacaaatcagacacacaggggtctgggcgagcctgtggtccagggaaagagggcctgggagttgggcagagcctctccacctgcagcgctctgtgtgtggcagtgggcgcggcccctaacccctgcaagcctgcagagtctgcacatgcacctctgcccagcaggagtctttctccaccaactccaatatggactgtctcctatctcagtcatgttgaaaaaaaaaaaattgtgcctttggacttttttaaaaacttgagaattggccgggcacagtggctcatgcctgtaatcccagcactttgggaggctgaggtgggcggatcacctgaggtcaggagttccagaccagcctggccaacatggtgaaaccccctctctactaaaaatacaaaaaattagccgggcgtggtggcgggtgcctgtaatcccagctactcgggaggctgaggcaggagaatcgcttgaacctgggaggcagaggttgcagtgagccgagatcacgccattgcactccagcctgggtgacagagcgagactcctttcaaaacaaaaaagcaacaaaaaaacttgagaatcacttaattctaccataataggaagttagatgaagggaattctctgaagcccagttgagcttctgtaggtttctaatacaatgagcctttatatgtttctagtgcagaagctgctgctctgtgacccacttctcctgcctaaacctgccccttctcacggcaagggaggcctcagcccctccgctcctggcagctcaactccatccgggcctctggactctttccagggcgactggtgggcctcaccacagcagacactcttcaggctgctgccgccgtggcccttgaagctcagctgtgtcatgtgttcaattcttggggcattttacggcctgacaaaggccctctttttgttggaaaggccacccaacagtgggtcagtggcctaggcattcagtggcc

SEQ ID NO: 12865 - DNA, 33529 bp, Human
attggttattttgtgtaggtatatgcatggaaggagtggctgccatgactggatggctttctggtttcactactctggtcaaagagaccagaatgtgagtctatgcactgtgtcatccacagaaaaatgctggctagctgaaaaatgttacctgaacttaacaatgttttgcaggatgtgacaaaaataatcaaccacattaaagtacattttcttaactcacatctgtttgtgcagctctgtgaggagatggacactgggcatgcatgtcttctcttatacacagaaatgagatggctttctaaaagtagatcactggctgaaatttttgaattatgagagctgctccagagatttattttagaaaatcagtcaccattggcggcacatttcagtgacacagaaagggttgcaaaacttgcttacttgtgtgatgtattcaactcgatctatgaactcaacttgtcgcttcaggagagaaggacaactgtgttcaaggaagcagataaattggttgcattgaaagccaaactggaattatgggggcaacgaatgaacattgagatttttgacatgtttcaaacattagcagagattttgaagaagactgagccagcagcttctttctctcagctgatgcatgatcacctatcttagctttcaaaagagttcgagcattactacccaaccacaaaagaaccctgaactgggaatgaatgtatccatgacccatttgtgagtaagtcaggtgaatcgattttgtccgtactagaagaggatcaattgcttgagatcacaaatgatggtggccttaaaagtatgtttgagacagcttcaaatcccatgttctggattaaactcaaggtgggatatcctgagattgccacaaaagcactgaagagtctgcttccatttccaacatgctatctttgtgaagcaggattttctgcagtgacagcaaccaaaacaagattacggagtagactggacataagcaacacacttctggtgtcactgtctcccaccgttcccagatgggaccttctaattgcaggaaaacaaggtcagggctcccactgattccacattatggtgagttgtataattattttattatatattacaatgtaataataatagaagtaaagtgcgcaatacacgtaatgtgcttgaatcatcctgaaaccgtctgccacccggccctggtccatggaaaaatcctcttccgtgaaactggtccctggtgccaaaaaggttggggaccactggtttatccagggtcatccaggttggagtggggtcaggagaaatggggaaatttaggtaaaagtatacaaagttacaaacacgtaggatgaacaaatgggaagacctaatgtacaacatgagggctatagttaatgatagtggtattcaggatttatgctaaataagtagattatagctgctcttgccccaaggggggaaatgtgtaattataggagttgatggatatgtcatacaaataacttaaatacacagaataaaaactattttagtttaaaaaggaacaatatttataaaaaaataaagtgagctcgaaaacattcaaataactgcttaaaaattaaaaagtaatatcacataatttaatagaaggaaagaaagagcaagacagcaagaaagaaaaggcaccataaagaaaaacaattttggcccctcctcatttgtagtcttaagctgcctctactccctcgccttgaaaagccacgggcttccgagggatggaggtcaaagccagagtaaagaaagttcccgggggaggccactccccagctgatgactttccagttccagttagtgtcggagtcccagttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagaggtgcgcgggcggctttctctgccgcctcctggggacttgggcgcgggaactgcgcggagcctgcgctggggccagggccggggtcaggtgtggagggcaacttgtggggaaccggcgcgagggcccgcaggttgtgtttgctgctctgggggtggaggatgtggggtgaaggttggggccagaaatgcaagaggcctctgaaagggaccctggaagtggagcaggtacacggcaaggggccccaggcggcccagcggcacccgggctcaccccagaaccattcgaatgacaaggggtgccctgcctgaaaacgccttgcggggctcagcttccccttagctacactgctttacaggtagagagcggccctgaatcctgggtagagtctgggctcaggagcatgtgccagcgtagtggggctattagaaggaatggttaatacagcctgcaagctgtcatttatcagtaagtattcaatgaagtccgccggagcccacatctatgctaggccctctacaataccagcttaggaaagatagtggcggtatctagcacggttcctaagaccattagctccagtcaggctccccgactttaaattcggcctctactgcttcacgtctgtggactgtcagccactttcttcttatatatgttctttccattgcctcatctctgaaattgtgtaactattaaatgagctacagagtattaatgtaaaattcttagagcagtgcctggcgctacagaaagtactcagtgaaagttagctcttattattttaaatatttgacaaagttcctgcttctccaagctgattctctggttcccaggtggtttcattcatgcactgttattcctggaagtcttggcatggccacttcccagttccaggaacaggcagtcgttgttttttctggcttatcacattgagatacatggttactacaagtgacacttaaacgtgtcaggcagtttgggggctcccttcttgaactttttctaagagcaaacctttgtcttaatgccaccctgtttacaacaatagtagggctttgaacaatgagaaaatgcggggaaatgaaaaagacatataaagggaaagagtggatttatgcaattggatagaaaagtggcatgtaaaatagctggtttatagatcaaactgcctttagatctgtaaaggagcttagagtacatacaggtggagagacatcagatgtgtgtgagcagacccttatgtacttctccatcttcatctctaagaatgtctccctcttttgctctgtaacctcactcgtcttcctttacttgaatgagggacgttcctccagctcaggaattctacctatggagttccctctatctatgatgccctccaacaccccacccaccatacctccatagactagttgatttgagacttccttcatctcctagtctgacttttcttaaaccccctaccaccatctaagttagtgccccataaccctttcttatagcaacattaattttatttatagcacttagagtatttttaataatatatttaattcttaattgtctgtctcccctagtgtctaggtattgtgctctagtgcctggtatagtgccttgcatgctctatgccttcaattaattcctttaaaaccacacaagctttatatttagtgaatatttatataggaagaatttctatgtgtatatatgtgtatctgtgtatatacacactgtattgcactgccctgaatagtgctaaattaaaaaaccaaaacactttttaatcagaacttaatagttgcactcttcaattttccatatgttcttttaagaagtgattagaaaaaaatgatgtctccatatgttgtctgctgctgtaaaagaatacctgagacttggtaatttataaaggacagaaatttatttcttacagttctggaggctaggaagtccaacataatcatgtgttgcttaaatacaggaatacattctgagaaatgcatcatgaggcaattttgtggttgtgagaacgtcatagaatttacttacacaatcctggatactatagccagcctactatttaggctggggtggtggggttgggggtgttgaggagagtcagattgagagctgagggaagtctcaaatcaactagtctatagacgtgtgggtgagtgggttggtggagggcattatagacagagggaacctcacaggtagaagtcctgggctggagggaacttggctcattcaagaaaaggaatgaccagtgaggtggcagatagcctactagacctagactgtgtggaataaggtgttgctcctaggctagaaacctgtatagcatgtactactgtaatgaatactgtatgcaagtataatacaatgtcaagtatttatgtatctaaacatagaaagggtacagtaaaaataatcttatgggaccaccatcatatatgtgatctgttgttgtggtgcatgactgtatggaggcaccagcatcttgtgagggtcttcttactgcatcatcccatggtggaaagtggaagggcaagacagcaagagagagtggaacttgatttccttacaagcctactctggcaataacaaacccactcccaagataacgacattaatctattcatgaaggtagagtgcttataaactaatcatattttattaggctccacctcccaacactgttgcattggaaattaagtttccaacacatgaacttagctcacacattctaaccatagcacctggcctagttaaagctaagtggcacaagagtaaattgaaattcaagccttttctgtcttacataagaaagataaccttaaaagagtcttttaacaaatttcactgaaggatgtcagtcttccttttttcagtgaattagagacatcggtgcaaagaatatgaattattaatcatcttaattcagctagttagcaagctgtatcacatttattaaaatcacttttatttctatgggtttagtttcaccatttattaggaggaaaggaagcaaatttgtgagggagctctgggttgtcaggaaaggcttttcagagtagtaaagcaatcaaatgagaataactgattcagtatttgtttcctttgtctctttggtttactttttagttttgtagaacacttgatcactaccatctcacttggtcctagttgatgtatcatctacatttttattcaaggtttaatataaaatgctataaaaggctatcctaaactggttttaagcatatttgttttgtttgttcagcataaaatacacaagaggatttttatggaatggctccttgttacaaggtactttgcatttataatcagccacagtcacctcagtttcatcccgtatcttacaagtatgatgtgctgtatactcaaagcctcaccacctgcttgccccacccatttgcttaaatgtatcaattttttctaagcttaacttttaccaaaactggagttcaacagatgaatatttttccttcttagatgttaactaaacatttttaaaggtacaaaatttatgtacaaacataacccaaatgacatggaagttacttgatttgtgacttacctctgtaatgttcccctggcctacttgaaattcctacctttcctctagtctagtatcttattctcagttattcggaggaagttagggacctagaattcttgttttcagagcagtagaattttgctaacataattcaaaacatttatccctatcttggggcttgaagagaatgtgaaatgctttatcttctgttttgagggaatgagggaaggagcttgttcttaggcaattaacaagtaaatttaaataaataatccaaatctggtgtgggtaaacaaattttagttttaggaactttcaaaattaagtatgcttcccctttgggttccagattttacagtaatactttttgaaagcagtaagataaaaatttcaggacctcaagagatgggtcaaaagagtttcactgtaatatgaattttgaagccagaactggaaatcccctgtgctgtgtcttcctcttcgtggtagtagaggttacagttatcaaatagtccagagaagcaatgggaacttatgatttctgatagaaaaattttaacagagatgtacttgtatgcaaataatatatgatgcctcagtttcctccaaagtcttagttaacagagttagaaaaaatcagattatatttgaagttctgtgttcatactggagtaattattattccaatggtacaatatacaacataactttattacattttttggtacagcataaagatgattttccctttctctgagtatttctgaaatttaaaatgaaataagtgtggtagaagccattatttatgaattatcatgctaaattaattaactcattaattcattcagggcacacccagttattccccaaactgagtgatgtatttctgggaatagacttattaagcttgagaaaacccaaaggatcattataacagcaaacaggaatgtaggcatccacatagtggatgactttagtgacctggcacacagtgccttatctacttggcacatgtacaggtacaaggaacacttaacattttgcaccagagcttattacataccactttcaatgcttgagatattatataaatgctaaaattctaaaacctatagtaaagcaaagacccagattttatactgcagtagttttgccagtaagtctcatcctcactaacttatcttttaagattaaaaataatgtaaccaagtgggaagaaaaagagcaaatatgaacaaattgtcattgttttagaatctgcttcttttcctttccggtatttctgtgcaaggagagaatgatctctgaccttgtgaaaggcaaataccatgtgtattcatggttgttattcatttggcaacgacttgaaactcatgacactccctgctgaagatcctccacctattcttaacagctgggctccccagctcctggatcaccaaccagtaccagtctgtggcctgttaggaactgggcttgtacagcaggagctgagcagctggagagtgagcaaagtttcatctgtattgacagctgctccccatcgctcacatacattaccacctgagctcaacctcctgtcagatcagcagtggcattagattctcataggagcaagaaccctattgtgaactgcatgtgtgagggatctaggttgcgcactccttatgagaatctaatgcctgatgatcggtcactgtctcccatcacccccacatgggactgtctagttgcgggaaaacaagctcagggctcccactgattctaccttataatgaattgtataatccttttgttatatattacaatgtaataataatagaaataaagtgcacaataaatgtaatgcgcttgaatcatcccaaaaccatcccctgcttcactggtccatgtcttccacaaaaccggtccctggtgccaaaaaggttggggaccactgtttaccaggatgcatagcatgggtttatgaattccctatctttgcagcacatcctttatttctggcttgcatgggacttgaaagcctaaaacaactaaatgctaagaaaaattatttttaaaatgatgacaaaaatattttctatttcagatgtatagatctgcaatccagaaactatgaatttttttcagttgagtagtctgtttgccaaaaaataaaaaaaaataaaaaataaaaacttgcctaagtttcttctcttacattttatttaggatttgcccttagacattatttagtgcttttctgaccctgtagggacggtgagaataattgaaacactagtttcttaaaatttctgttaaaattggttaaaggccatagaattttttttttaagctaagcatgttatagagaggtatcctataagaagcaaggggcaggtaaagactttagagatgtatagtccagtgtgttaattaaaggatactacctacttctaattcggtatgtattaatcttttctgatatatctgttaaagtactcttcgcatatttttaaaaaattggcattttaaagtatagtctttgatggtagaaatgtgagattgacaaaaatcatgtcctcttatgtatgaatttagtcttacacagttcttcatatgatggaatctaaaacaaatgtagtcttgaaaacttttagtctactttggttacatgtgtttattattgctcaccttatagattaacagcagaaaagtataaattttaatatttctacctttctggcttgaggtctacagcattaatttctgaccagttaatgcaaactgagattcctattgtcctaagaaaatctgggaagttagtaacacaaacacatcttttgatttatttcaggaccacataaacccattttgaattattcaaccattgctgaacttcttgagtatgtataattaagagttgactataattggaatgttcttaagactttaagttgattataaaattttgtgcttaaagttggcaataatcaaaacaaaacaaacaaacaaaaaaaaccctttattttaaaacacagtcttgctctgtcacccaggctggaatgcagtgatgacatcatacttcattagaccgtcaatattccaggctcaagcaatcctcccacctcaacctcccgagtagttgggactacaagcgcatgccaccatgcttggctaatttttttttagtagagacagtgtctgtccatgttgcccaggctgatctcaaacttctggactcaagtgatcctcctgcctcagcttcccaaaatactggcattataggcataagccaccatccctggccaaaaaataattctgaaacagcaaggaggaaggcggtttcttcttgggaagtcttgattttagttgagcatgtagagggatcacttgacttattaaccacttaggattgcacagtaagataatttaaagggtagccagcactggagtgggcctgggaaggggatgggcagtttgtgttagtgtgtgtgggtccaagataaaaatgttgggtagcagagttttgcctaatgcattgtcgctaaaagggatgaagggcatcgggatctacaggagatggaaaaagtagtgacaggatagtagtgggaaaaactaggatcggatcaaggcactggaaggcagaaatattgagtagaatgtttgctgcaatttatgtttctgtataaataccgagtacaaagtttcacttgggtggtcaaggtgctatggctgtgacaactcctgagagtgggttttctggttaaaaaaaaaaaaaaatctctgaatgcacggagtcgtctcaggccttctcaaatttgcaaagaacaggtccacaagacctacatttcccaagataattgcagtagtgtgacctgataattaacattttttgctttcctgctggaacattcctggggcccagagactgggccaagcatttccagtccaaagactgggaactgaaccaagcatttcctttagattgttcaagttgtgaaggttgatgttattagcttggttactacttggagtcttagctcatagtgtgtctttatggctttctgcctcactggaccctcttcccaaaaggctttagaatgtgttcaccatcatgagctgaccaacaatttctaaattcctactcagaaacacagcaaggggaatgcagtcaagcacaaagggcttaaatgaccagataaggctgggctggatgaataaagaggaatatcctatgaatgtgactgtgtagttttagagtatcccgattcaactgttatatttgacttgtggccttgtagacagtgtgttaatgtcagatcttctttttcagaactgttttaatcatggacaaacaaagtaagtaatttattttaaatgtttactttcctccttataatgttaatctgttggtaacttgttatttgtcataatgttttattcagtgtctgaaagtgtataatttgttttctgttgtttatgctccagaatacaatgtctagttcagtattttgactatagagaagatgtacaaaaatagcactatcactaggttcttcattaaaaatacgaaagccttttggaaagctaagaaatgctagatttattgggaaatatgttctgtaacatatatttaaaccacaacaatattctctttgtgtattttatatgtataaagattattcaagtcatactaattaacagataataagatttgagttcattgtaataaactcctcagatacacacctcaatgtatatttcatcacagacacatgtttgtattttaagtaaataccagtcattatgttctggctttttttctctcaagaaaattctaagtaagatggatatttatcaagcaagtaataaaagactgtcttattaagatatcaaggttctgaagaacagagggaaaattatgttcaaaattcccactacatagggaaaattaaattcaaaaattaaatcctgtttttctgaaacgcttttctttattctctctttcatctttgttgaggtaacaaaaaaatatttatctgtcactacagtgtcacccttattagatatatgaaataatctccaggactagactccttgcttttcccatgtgaagttttatgattttctttttacttacaaaactcaaagctttttaaatgtaaatttatatagaattatactggtttatttgccacagactttaagttgattccactcaatttacaaaaatgtatctggtgatggtcataggcaacttttaactcttcagttttgtatatataattgtatgtatgtatgaatgtatttgcataaatagaaataaaatgtgtatatgtgtgtgaataaatgtgtaaatatgtatatatacatacatgtagacataaaaaaaagtacctttaagacaatgtgatagacttgtacttcttataagccattttaagttgcatttcaaaaacgcagtaatcaaaccataattaacatgctctttgttctgcttgaacacctgcccattcactcattctccttgtatgaattccccctggaatgcctgaaatcagaatcattgctttggtaccaaaagcccagagattgtgagctcatgatttcttgagtctgtctgttcctgtatatgtgtgtgtgtgtgtgttctatgttatagtattcaaacaatgttgcttattaagaggtatcacaatgtgacatacctgtcaagggtagatctttacttcagacttgcaaaatattttcttgaaatctattctgagtctgatgctgtgtttccaacttaatttgggagtaggggctgcaggcagggccttattagctagagaactagggagttaggtcagtcacttgatgctgagaaatagaagagaatggatgggaaagaatgatggggagtttcagagatttgtgatgattcacaaatcacaaggtatgttgcaatgtttgtccagggaaaagtcctcatttgttttttgttgttgttttgtgttatttatttatttatttatttatttgagatggagtctcgctctgtcgcccaggctggagtgcagtggcacgatctcggctcactgcaacctccgcctcccgggtttaagtgattctcctgcctcagcctcctgagttgctgggactacaggcgcgtgccaccatgcctggctaatttttgtatttttagtagagatggggtttcattttgttggccaggctagtcttgaacgagtaggagagcggtttttttgcctgattttacacaatcaccatggactggattccgctgaagtcatcatgaagctatttatgaaggagaaaggccggggcagggggtgggggaaacaatccaatcttcctgataaaaccacacgattcacaagttgagtggtctttgaaagttcataatagagacacatacagaaaaatgtgttacagtgaaagtttgacctatatgttcttctatattgatgccatgtctccatgattctaaaacaaaagactttgaatttacagttagtaattcataaggaaacagataaggagataagtgtagtgtctactgcaccttaagctgtatgaaagcagagccattgtagccacagagcctaattcaagggtgacacaggacatgctcagtaaatatttagagactggctgcggtaggtaaccgaatgactagatagacatgaatattaatatttaggaggttgaaccatttgtgcatatattaagtttactcaagccttattagcaaataacaaagtttaatatgctagtgtattgtaattaaacatggcttttgtgggtcaaaaacagtcatatttggggaatttcatatggttcaacttcattggtgtagttccagagtaagcataacatatataaatactgaagtatattcattattttaaatatttaaaataatacttacagcaatgatgatagatatctttaaaatcatccataattctaccatcttcacatcccattaatttcatttatctctttcttcgtagtctgtatgtaattttaaagctatctttgttttattatcaacaaaacatggaactgaacattcatcagggatgtttcaaaaactggtaattcagccccagtaacttaactgtctcattttatctaaaggagaatttgtttgaaacaaatttgctagttgcaaattagctctgagaacaggcacagcttacgttaagtgaaaattttactttccctatttcaatacagcataagaacatacaagttacaattatctaagtacaatacattgtttctttctaatatatattttatttaatcagacatctatttacctctccttgaattgcagactcacagatgaatgcttctcacccggaaacaaacttgccagttgggtatcctcctcagtatccaccgacagcattccaaggtaaagcagttgctgaaagaagaaaaagtaaaattaattgagagacagagagagagagtgagagtgggagagagagagtaagagagagagagaattgtgcatttgtttttattttagtagttctttttttaaaattatattaatgaaattttggcagcctagttgttcttgattatttttatttggctatcattttgcacagaagtaatttttatttatagaggacagtaaaggtataaagaaagctagtaaaaacaacattaggtttacatttagcaaatgaaatacaagactgtacatcctaaaatacaaatgttaagtaaaatattttattgatcctccatctgttctgaaaattatgatcatttaatcacatttaggaaatttatttctgataaactgagtcatgtagtagcttggcatgtgttcagtgagagtcacatcaaaatagtaagactgcttaaaactgaaagtaatagaaattcagttacctgggaataattctcattttaattttataatgtatatgaaagctttatttttatatatatgctgattccaccctgtatttctaagaaaagtaattgagtcatttgactacatacataattgagtacattttttcttttcaaccaatgcctgaaagaattcagagattttcatttaggcaaatgcagttatcaaaactactagaactttaaaaatagcaaagtccatggcatgtccagatttacaagcagacaggctacccacatcttgaaagagcatcctgaggatttaggaccaaagggaatgtggtttggatagaaggatgtacccactgtgttttcttctctgagtaaacaaatgtgcttaggagctgaatgtcatgtttaattgcctagcaagaaacctccctgcgggtcccggatctcatccagatgtttgcaactgaaagaatatgagctagataagctcagactctcaagtggtggctcatggcaaccttgtctgcactgaagtatcatcacccagaagcacttaaaaatagtagtgcaaaggcactattccagaaaaattaaatcatagcttccagtggtgggactcaaggaatagtaatcttttaacaccccaagtgattctaaggtgaagccagggttgagaacatctgctctaaattcttatagggttggtgtttgaaaaatcattagtaagtctataatattcatccaaggcacttaagagaatgatttaatccaccctatcactaattaaaagtagatatacataaataatacagttcagatataatcagacttgagagtttgtttatatatatagatatatatggctctacagcttgattttgtttctcaagtccaagattacatatagcacaagtcttaagataacgatgctaagagtaaggataatttaaaattgagatcttaccatgctttagtcattgttttaaatgtggagttaatgtggactaacacttttaattcttagaatactcttatgaggtaaatactgtcagttatccccattatgtatgtgggaaagctgaggcataggaagtttgtatcaggcttcaagttctgcctactttaaaaaaaaaattcgtataggtaaatgtgctggtaaaccaggttctgccttctgtactaatagttatgtggtagtttaaacaagttgcagtacctcaaagcctcagagttcctatctataaataagggtgatattttcaatgtaggttgctttgtagagtaaatgagagtatatgtaaaacactgagcacaatgcttgcaaattataaatgacaagtatttgctaacatatttaaaatattttaaatcaattagtctttacataaatgatactagtattcaaatttcaggtaattctttatgcttaattcattgatttgaggagtaatccatcatactttcagagtctggggaaaattatgatgatgttaaaaatgtaagaaattaactcacatctccatatccccactggtctgcctatggtctggtttctgtgctgaccccagtgatctttaaaaatgtaaatctgctcatattacagagagtgtagagcccctattttattagtggcctattacttttaggataaaggctaacactaaactcaggatggccttttccatgctctctctttaacttcctcttgagcctggcttgctgttattcagctagactggctatttttcagatttttaaaggcctatgttagttactgtcccaggacgttgctctgaaatgttctttctgtgactctggcctcctgaactcctgtgcatccttcagatctcagcataaaggtgacccctcaaggcagctgttcctgctccttccctttttctcttcccatctcaatagcgacctttggcatctctagtcataaaaccgtggtctcttacttgaaagcatttatctccaattctaatgaatcaattaattacactggtattatagctccctagaataagtggggatataaagttgtctctctcattaaacaatgatgggcagggattgcatctgtgttttccattgtaaattctaatgcttttccactcctgaaaattttgtaagatatagataagaccatggaactcattcttctgcttaaattcctccagtacttgccaatcataattggaaccaaatccagactccttactaaggcctcctttgatgaacagcttcctgttgctttgctaacagcctttcctagtcgtcttctttcttatgacattcctctctcttttacgcctgtcaaattcattacaaagtcagaggtattctatttgcctttctttcctcctgaagcatttatcactaatcttcatataaagcttttctcttctcatcttttagaccttgatataaattatatttacccaaagtaactgcctcataccctgccctcgctcgcatacattctctccatcacatccatatgaattttttttgttttaaatgtgttttctttctcccagaagttgactgtaagctctctgacagcaggctgcctccttgagaattgtatcctcatattctacaacacagccagtcacattatgatcatttgtaaatattcattcatcataaaggaataaattataaaagctatatttatgatgcattattgtgaggtttattctgtttttctaagccttatttttgaagggcaaatgaattttatcataaatgatccatttaaaagaatttgtaaatttcctattctaagtattacattttgcataggctttaatgttaaaatattgagaaacacagtcctttgaaattgtattccactgctatggaattgctacactgtggaccatacaaacaggtatataaatcttcattgtaatcacacattcgcagagaatatgaagtacatttactgttattaaatttctgcctcttacaattttttgccatccttgtttctcaaattatattttccagagaccaaaggatgttaaattgtgaaatttaaatttctaacctaaatattataatagaattttattttaatgaagaaggacttaggaaagcaatacattatggattaaaacataaggcaaaggattaacccaagcaggcatctggaatgtactaaaagaaatgacgtgtactaaacgaatgggcgcggtggctcacgcctgtaatcccagcactttgggaagctgaggtgggcagatcacgaggtcaggagatcgagaccatcctggctaacacactgaaaccccgtctctactaaaaaatacaaaaaattagctgggcgtggtggtgggcgcctgtagttccagctacttaggaggctgaggcaggagaatggtgtgaacccaggaggtggagcttgcagtgagcagagatgatgccaccgcactccagcctgggcgacagagcaagactctgtctcaaaaaaaaaaaaaatggaaagaaagaaatgacgtgctttcaccttcaacagtggcactataatattttgggctggacaattcttcatttttagggagctgttctggctcttttaagatgtgtagcagcagccctggcctctacccaccagatgcagtattatcttcccctccagttgtgaccaaaaaaagtctgcagatcttgtcaaatatccctggcagagagggggcaaaactacccccagttctatacatatattataaggcatttgctagaatttcagaattatcatttttcacaagatactttggccctagaaatgctgactcaaagccattattttgggccttctaccaatgacgtgtttgtttcccttgaaggcttgccagaatctttatgtaggtgactctagatcatggttatttattttcattttctcagatattaaagcatattttccttctgagttttgaatggtaagggtaaggctattcaccgcatactatcatccaaatagaagtggatgtgcaaccacagatatttcattgaaaaatctcagaaagagaaaagcgtattaaacatcacagatacagatgtctacgctgaaatgtcaacttatagatagatggcataaccctaaaaaggttgacaattccatttttggtgcagttacaaatcatttcacttgtttgtatttcaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtattttctgctaacagattactctaattcttctaggtctggttcaattttaaagcaaaatacaaatgccttagaaaattgtattttctgttatcttaaatacaatctatgataatggccaatagcaaacatttaattagcactgtttcctgcctttgttgtatgcctgatacatgtattaactcatttaatccttattgaaagtctgtgatgtataggtgctacatttttcaaaagaagaaactgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataagtggccccaaacaaggggttaatattttatgtataatatgactcacctttttattgtaactaataaaactgcatttttatgatgctgcttttgttctttggaagacctaattttataaatgccattaataaaggagtaaaaagtcctggattttgttgcactaaattataattaatctcagcaataagaggtttaacatttaattggtgttagaaatcaggtaggtcaaatagaaacaagaaactctgtgtgtccagtctatacacatacaaatattcttgtgatattcaaccagttttcatttcataaatcatttctttcttgcactctctttagtaacttaatttcccacaatgtgcttaagtggcataatcataggaatttttggtcattattatattatgcaagaaatacatagaaatagatattttaaaaatcagagtctcataaaatacataaaggatgttatcacatatgacaaaggttgatattaagtatgcttaatacaaatctgaaacttgtaaaaaaaaatctctttgatggctaaaaaagttaccaatatttcttcagcctattctagaaggaagattgttttctaccttttgaattgtttttgacacataataattgtgcatatttatggagtacagtctggcattttaatgcacatgtactacgtgtaatgaaaaataaggataattagcatatctgtcacttttaatatttatcatttcttagtgttgagaacattccaaatcctctcttctagctatttgaaaatatacaataaattattgttaattatagtcagcctacatagctatagaacactagaatttattcctcctatctagctgtaattttgtattcattaaccaacttctctttatacctctcctccctacccttcacagtttctagtaaccactattctagtatctacttttttttttagatggagtctcatcctgtcacccaggctggagtgcaatggcacgatctcggctcactgcaacctccgcctcccgggttcaagctattctcttgcctcagcctcccaagtagctgggctacaggctcctgccaccacacccagctcatttttgtatttttagtagagacggtttcaccatactggccaggctggtcttgaactcctgaacttgtgatccgcctgccttggcctcccaaaatgctgggattacagtcgtgaaccactgcgcctggcctctactctctacttctaagaaatcaatttttttaagcttccatgtatgagtgagaacattcagtatttttctttctgtgcctggcttatttcacttaacataatgtcccttaggctcatccatgttgctgccaatgacaggatttcattcatttttatggctgatttttattccattgtgtgtattaagaatgaatttttctttattcatttatctattgatgaatacttaggttgattctatatattgactgttagtgctgcaataagcatgagattgcagatacctctgacatattgatttcctttcctttaaaatttttgttttgaaaattttgaaaaaatactgtttcaaaaaaaacagtagtgggattgctgaatcatatggtggctgtaattttaatttttgaggaaccgctacactgttctccataatggctgctctaatttactttcccaccaacagatttccccttctccacatttttaccattatttgttattttttgtctttttgataaaaattcttaactgtacaaagataatatctcattgtggtttggatttcatttccctggtgattagtgatgttgagcattttttcataaacttactggccattttgtatcaattttcttttcttttttttttctttctttttttttttttttttttttgagatggagtctcacgcttgttgcccaggctggagtgcagtagcgcgatctcggctcactgcaacatctgcctcctgggttcaggcgattctcctgcctgagcctcccaagtagctgggactacaggcacctgccaccacacccagctcattttttgtatttttagtagagacagggtttcaccatgtcagccaggatggtctcgatctcctgacctcgtgatctgcccactttggcctcccaaagtgctgggattacaggcatgagccacctcaattgtctaatttttaaaggtactccagtataaatcaattttatttgacctaaatttttccacattaataatgaacacaataaatattttattaattaaaaatattaacttcagttttacactaaaaagtaatataagctgttaaatattgataattggttacatgtactttaaaaatataaatacatgaattttaatttggttagcttataaaaaccttcatttgacatatacataccacttattttttttcctgctatagatagatcagatactgattcatcagcaaattgaacttctggaaggtatgtattcattgttttaatcctgtttctataaagagtagaagtttatgcagataaaggcacattgacctccacaaatataacactctcacttatataggacagttaaaccagttatttacaataataaatgttatcagcaattcatttctaaaatttaggaatcaaaaggtaaaatgctgttatgttgggcacctgccctcgggatattgacactaacttagaaggaaaataatcaaaacccttattttgctcctctcttcatacatcactttttttctgacttctaccacttaagctattttctccgtaattgtgatcagcttaagaatggcacagagccacattccaaagtaagttatcttttttatttggatgaggaagtttgggaaaattatcatttgtgcccacagtttctcttgggagttaagatgaaccctataaaacctttgtatacgaggtcagatgcaggccactgcagtgtgggaggatgctgaccaactagcctgcaggcttggcttcatagaagagcactcctgctcctgctgaatggcctgacatttccttgggtccagggctccttaggtgcaaaaataaacctaggaagccaattaatgttttataatggctgccaggggaagaagaccctggatagatttatgaaccatagtgttttccttctagataaaaaaggtttaataaaaaataaaactctccagtttttaggaatatgtctgctaaattcattttcacctgtctccaaagtttctttccactggtaaaaattagaagatgaattgtataagcagaataatggatttggctaaaatatacaattgtcatctattacattgaagttatttgtaaagcacattattatttataagttacttgattttttttttagtgtatctaaacaaagctttctctggaagacagctttgtattctgaattttttaatgttttatagtatatattagtaaggctataaaatccaaacagacatataaccaaacattacacagcacactatttatctttttttgtagatttataggctttataaatatttgttaaatatgtgttaattatgaaatagaaagttccaaatctaacagtttttaattatgcttatttttcaaaaaagaaatgtctccagttttttttttgtttctttttctccaaaattgaaagtctatgttattttttcatgagtggtataaaaaagatgaagattactcaggtttttagaatctgagcataaactaggcacttacttttttttctcaattcaaaacacagaagacaataaaaatataaacaatttgtttacatttttaaagtaaatgaaaagaaacttaaaggttatgtaaaccaatgttgttttacaaataagctggagatttttgagattaagctacttaatgtaacaattaattagataatgaatgtcctctcaaaatcagcttaacttttttctcatcaaacatttgactatttcagatgttgaaatcagacgttgttcctataaatgcagagtacagggtctgtctgtgtcccaccaaggacacttaaaggagttcatggtggtaagacttgtgaaggccgtctttatccgactcagagtctttccacataggcattatagagtgacttttcctccatatatttattttaatcactcattattttagccaggcttctgacatctatgaccccagttactgaggactatgtacaaatgggacagttattgctcctttctggctttaaatatggagaggtttccaatgtatggttagatatggaaagcccttgatacaaagtatgtgagtgtcagcattttgcagccatctgtttccctcatgaagatagattagcccagcaaaggtgcagagttcacttaggattcccatggtctagatattctgtgagttgaagccttggttgccgaacacgtttgtctaatacccacctcccacttctgaacaactactgttgagttgaataaggatgccctgggtccaatgtgacattctaattcatctttcatttttactccctcggtttttatgcgtgtacattgccttctttcaaaagcattgcaaaaaaataagacataagtaaggtttataagacagtctcaaaccaattgatttaatataaaatttcatagcacataaacagcaatcctcttatattcccctccacattacacataaactatcctgcattagtggacattttatctatacacctagcaccaccgtgcccacccacagcattgccccaactctcagcagaaaagtctctcttctgacagacatttatggaattaggaaaatataacttgtttccagtgtctcacataatgaagggatgggttgcccctccacacttgtgggtgtttcttgttaggcggaacgagagacttggaaaagaaaagacacagagacaaagtatagagaaagaaaaatgggcccaggggactggcattcagcatacggaggacccgcgccagcaccggcctctgagttcccttagtatttattgatcattatcgggcgtttcccggagagggggatgtggcaggacaataggataatagtggggagaaggtcagcatgtaaacacgtgaacaaatgtctctgcatcataaaaaggtaaagaaaaaggtgctgtgcttttgatgtgcatatacataaacatctcaatgccttaaagagcagtattgctgccagcacgtcccacctccagccctaaggcagttttcccctatctcagtagatggaatatacaattgggctttacacctagacgttccattgcccagggacgagcaggagacagataccttcctcttatctcaactgcaaagacgcgttccttcctcttttactaatccccctcagtgcagaccctttacgggtgtcggactggtggacggtcaggtctttcccttcccaggaggccatatttcagactatcacatggggagaaaccttggacaatacctggctttcctaggcagaggtccctgtggccttccacagtgttttgtgtccctgggtacttgagattagggagtggtgatgactcttaacaagcatgctgccttcaagcatttgtttaacaaagcacatcctgcacagcccttaatccatttaaccctaaattgacacagcacatgtttcagggagcacagggtggggggtagggttacagattaacagcatctcaaggcagaaaaatttttcttagtacagaacaaaatggagtctcttatgtctacttctttctacacagacatggtaacaatctgatctctcttttccccacggcataaggacttaatttctctatacattggtaatctctccttttttttgccatttttctctgtctggatcatctctaaacatcatttcttctcctccttatgccacttggggtatcatcaaaaactggcatagctagatattataatatctggataaattcaatatttttaacatagaggtgattatgatttcgtcttttatgtttttagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgaggtaagagatgtcataatgtttataagatttgctttcctaatataagaagaatgtaattttgcaggacattataaatgcattaaataagtgttgtgtgccaatgtctcaatagcaagatgattttctcatttatttaactttgggcagagtggtagttatcactctgattaaaggtcactgttggtcatgagaaatggaaaaaaaagaagcagacctatgtagtcaaataaaaataagcaaatcatccctcacttaaacgtggtggtttctatgtgatgacactgtatattatccattttaaacagaacgttaaccttgccatctaagtctgattgccaaagcatatggatccttcttaaatctgaaatatcatctgccaatgctcaaggccatgttcagaatgtctgacatctttgaattcctacaagaagcccaattatgcaaagatagttttgagaaaattagtataatatgtactacccagttatgcttctctgtggtctctccttttccctatattaaattaggtcactagaagctgcaacatattaatatttgtatatttactgtaatacattgtagaatttcattagagtagctcttcaacaacagatggtctacttttacaatccaaattttttcattgcaaatgtttaaaaatcagaaggttttataacttaatcttgatttcttgtttctcttggaaaatcagaaaattgggttaactgggcccacctttccaacaaaagggtaaaaatctactaaagatgtgtggggctgccccttgtaataatgacatgggaactctaccactgtctccaccccttactgaggtttttcaatatccagtgtcattcatttatgtgatctgcctgccttctttaatcacatggtattttattcctccgtcagactttagctatataaagatgaatcctttcccccattgacttcataatctaatgacagagatttgcagttctaaggaggatgtgatatagaaactttaaaaaggctcttataaggggattatataatgtgtgtatgtatatgtgtgcataatatgcatgtataaaaattttatgtaagggtatgcataatagcagttcttcatgtaagggatggaatctctgtcctacatccagagaagtgaaaagtaatttctcattcaaggaacaatattaacagaagtttggctggcatatattttatttttagtaaataaatgaaaacactggaaaaacattgtgtaatccttgtatttgatactaaaaaatttatgtttcatctggcagtctttcttgatggataccttaaagcatccattccatgtaataaattaacttttcttctatttatctagaatgatgatatcaaggtactctcatggaaagaattgagaaatagtcacttgaagaattttccatagagttgacaatggaaactttgacacctcaaagcagaaattatcagtatgagggaccactaaggaacatgaaatccaccagggtgtcactgggcatggaaacttgaagtaataaaagagataaaagcctgttccacagcaggggcaggagtcattctaaaacagagaataactcaagaggcatttcataggtgtactatgtggaactaattcatggatttgatatcaattgaggatgaaaaaaattttggagataaacttgatgtgttattattctgatattacattggccaagttaagaatcttggaggaaaaacacttgatttgtgtcctcttgaccattatgatagtctgctttttaaaaagtaaggtatcaaatactaatacacatctaggtcagggatcagcaaaatataatcaatgagctgtagttgattatataaaatatatatgggaagttaatgacttgaattaaggtcatgttggattttagttatgtataggaaaagaatggagagttttcagcaaacagatggtaattgaatctctaagaaggttatcttaatggtgagtaagagagagcctagtagaccttttatccaatataggtgataagagagtctgtctccttcaaggactcttggtagggggaaaaaatatggccacatgaaactgacataccaagtcagctctgtctatgagcttgaaatctgaattcctgccactgttgtgtttcaggaatctcaaaatatagaaactgatcctgagtagtgataaattttatatggtcaactatagcccacagattttttttcctgccctctcaactagattttcattagtattcaataaatatgtttttaaaaagcagacaatcctaatggtcaagagtatagacactggagccagatgcccaggtttgaaacccatcttcacaacacttatctatgtgactttaacaaattctttcacttctctttgctttagtttttttacatgaaaattgggtgtaataacagtaaataaataaatcattagtaagtaaataaaatagcttaccagcaactattaatatactcatgatacactttttatatttctttgctacatacctagatcctatatgctgtcattatatttcagtattttgcatttatatttgcattgtgagatgaatctatggttttctttttagaatgcttttaccaattagtattgcactcatggatttgaaagtttaacattatacaataccaatttattatttccaaatgttgacattttattatagtgattttctattccaaaatgtctacaatttagctaaaaattatctagtcctgctaatttattggttgaagatcattatttgcatttcttatccttgccataaaaaatgtattctctactttgttaaatttcttgctgtagtaatcaaaaagggcaaatgttaatatctttatctgtatagtgttgagtttacggtggctagtaagttgtcagctgcatttttcatttttttaaatttcagaattaaaaaataaaacataagagttttcattactagcttcaaatgcttcaatgacagctattagcagaaaaatactaacatgtacaagaaaggatttgtattagtttatttcaccacagtagtatttcattacacataatccctaaaactcagcagcttgcaataagtgtttatactcatgcttatgggtgtgtaggtcaactgtgtttcagtggatgtatttaagcactgacttaggcgcatgttaacctcaatctgctccaggtagatttgttctatggctgtagcagcagcagctacctgagtcatgcttttctagtggcttgtcactgaagatcataagccaggccaaagcacttagccaagtttaaggacactactcatgtcatatctgctaacacccgttgttcaaacaagtaacatggccaagcctaattatgaaggaacaggaagtatactggccctacagaaggagagggaatgaaatgaatatttgatgaacagtattatgctatcagcttcatattagatgtttatttctagtattttacaaactatccacttgtactcaaataaaatgagtcaagtatttttagattccccacatttatttagctgaaaaggacactcctctgttaatacaactatatgtgtacatagttttgtgaatttcagctacattcagtccccacctgccctcctagaggagttgccttagtctgagcaaagtccattcaaccctatatgatggccctgggctttcctcaggcagaattgtaaaattaggaaacttctacttcggagctcatttgttcatacactcttcatcttttattcacaccccactagttatccactctcaacctcaacccttggcgtggggcatttcatcaagttacttattggtatttgcctttactccaaactgctaatcttttctaggtgcttagcatttcatgtttggcaactcacagtgggtggtaataagccttttcatcatatttaatctttcagtctgtgtaaactgtgcttctcctaaagcagaagtctaataggagttttgttcattaacttcctgatggcttctagaaatgtcatcaaagaaacatttcatatttatatccttttttgcttaaattttcttttgggtcaattcaaataatttattaatgtctatattaatataaaatagaaattgttaaatatttcaggaaaactttctgaaatataatttctccgtacaatgaaacagtttttttcatatatctataaatagatacaggagcctccagttatctaatgagggttacatatggtgcataattttaataccatatttgtttcatcttacttcaaatttgaaagtacttttgctataagtttcctaaaagtatttaatacttttttttttcaatttagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgtaagtctgttcttattaatcttgattatagatgctttctctaggttcattctgaaatgattcagtaaagtgtatatttcaaaatgacattttaaaatttatagattttaaatcaggattcccatttaatcctagctctgaaattctatttgatcctgacactctggggtcacaggtgactagtttctacctgaagagtctatgaatattcacatggcaagagggggactaaggagatgtactaaggagagattttagtctccccttaaatcaggcatctcctagatgctttgaggaagaagttgaaagtaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacctagggactttaaaaactccaaggactagtccatacctcagttcaactaaatcagaaacttcgaagttcatatagtgttccaggtgattccagtatgcagccaaagatgagaattatggggatagagaaaaagtaacatttagagaaaatgactggaagattaattaaattcatacaggtatcaataaatgaatagaattatagaatttattattaaaatggaaagccaaaggcagaacttatataattatagagcttttgtatatttacttattacatttaatttttttaacagatttgttactgtgtttcactagatcccttagtatttctgcatctgataattgatctctgttttgttgttgaaaattcatttgtatacttttgtttttatctaggacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtatatttgatttttgtttttaaacgaaatgtgttcagatggtattttgagcactcattcagttaaatgatggtacatttgaagcaggatatttccctgaccccttcacaggactcgagacaggggtgccttgtttactcagcctgccattctcaactcctcctgggagggagtgcacaggcaaacaaggcaggaactggagtgtacaagcactggaactggctggccgctttggcatgggcaggaacaaactgtgcaggccctgtggtagcatccaggtggggttgcctgcgattcctgaagccccagaagatgtgttaacagtgctcttttagctctgctgtctgtggacggcttaagtgttaacagctcagtgggccctttgccttgtcatgtgggacagctgccctccaccagcaagggcaaatggcgaatgtgagagccttttatatcggcactcatggctcccaggctcttgtccggtgtccaggaaaaatgtggtcacaaaaacaaactgaaggatggtaaatgagggggattttattgctgatgaaagtggctctcagtgagaaagggagctgaaaaggggacagtggggtaggtgatcttcccctgaagtctggccctgtccagctggattcttctctgaagttacactgtcaagctgtccctctgaagtcaagctgcttctctccaatgtccagccatagtctccactcctctctgactgagtcttgggtctttataggcacaggattgcaggcagggcgggccatgggcagtttaggaaaaggcaacattcaagtaggaaaacagggatataaattctcactttgggccggggtttcaggcatttcagcttgagggtagggttttcactggggactcacccttttctacctagaatttctctgcctcctgtctccatcatatttaactgacttttcctttcaaatctcctttaaaaatgagcaaaggtacatgacactttgtagtaaaatctgtaccagtgttggaaactaggatttccacctgtcagaagcttataagaatttagttaatctcttttgtaatgaagattgagttgaaagatgacatgaacaacccacaatattcttcatgcaatggaaaagtatgcttaagcaataagggcatgtggaagagtccctctttcatattcagcacaattcttgtaacagcagctctcctcatggtgttagtgccctagacctcaatagctccaaatggcaagcggtgagaacattagtatgcaggagatcttcaggaaaagtcaagtctagatgatctcccacaagtctaaacaattcaccagatgccaagttccagtgatgaggtgtacccatggaactcagagcatgtgcttggtacagatggcatgccaagaaaagtggaggtacttgcatagctgaatcccaatggcattgttatgccagttacagaagagggtgggcataggatttccaaactggccataatgtgccaaaactaacccaaaataaggcttagagtactgacattatctctgtgacagctaaattttactttcattatttctctctctctcaacaggattctggatctttggttaagcaaaatgaaactaaactgatctaaacatttctttcttcaactctgcaaagaagatctgagcaaaaccccacatatcttctgcagaacctatttaaatactagacaaatatcttctcattacataattacatacagaaaataatcacacatgaaaaattcgatatttaattaagaaaataccaggaattgtttttcaaagtttaatttgtaatctcaatgagatttgaggaaatgttgcatatttttttatttctaccatgtgagttataacagtgaatggaaagtcactgcgtgtccctgactagggaaaatattcaggaggaaaagctgcaatggatggcgcatggaggtatatttttgatcttgggaaggaagttctaggtaggtggtc

SEQ ID NO: 12866 - DNA, 8301 bp, Human
gataatagatttcaaggcagcatctccagtgtgcttcctgcgtcttgtgatgattcctaaattctgtccacttttactcgtttgtatataccccattcaaaaacagccaacatcagcctcgaaactatgttgtttaaactcaagagcagttttgttccatgcttatattgttgtccataccttcagcaggaccaagccataaataaatacttgctggtttgtgttgactgaatgatttaagataaataaacaacctcaaatgcctactgaggccagataatgtaaatgggaaaagcaaacagcggggagtgtggtgaacaggagcaccctaggttcctctaaagggtgtggcttcgaccacacttcaaacctagtttgcacttttggaaaatggatcccacgttgtcagagattctggttttccaagagatgctggaatctgggtttttcatgcaatccctcaatgtttaaaatgttggtaatcaattcaaatttttacaatacattttgaaggccaatactgtaaaccaaactaagcacttctagggagcccatgcaacgaatttgcaatcttttcattaaacagcacagctaatatgaaaacacgctttttttttctttttcttttttgagacagagtcttattccgtcacccaggctggaatgcagtggcgcgatctcggctcactgcaacctccgcctcccaggttcaagcgattctcgtgcctcagccgcccaagcaactgggacgacaggcgtgcaccaccaaggccggctaatcttttgtatttcagtagagacggggtttcaccatattggcaaggctggtctcgaactcctggcctcaaacgaaccacccgcctcggcctcccaaagagctgggattacaggcgtgagccaccgcgttcggcgaaaacacacattttctaagaaactgattgctgggaaggctacagtgggtaagagctcttgctctctgtgggcctgcctggttcggaatcagggcagtgctctctgcctaagtgaacttgggcaattttctacaaacctcagtttctgcacccgtaaagtagcaacggttgttctgaggacggaatgagaaaatgcatgtcaaagtccttagcatgaagcggctctcagtaaccgttaaccactcctaattactcctcttcataatagtagaattactcatggcctcgccaaacattatgcaaataatttcacgttcccaggtagctcagccctcccacaaaagatttgaacgttttccatatgataacgatccactcgtttttgctaaacatccacaatgggcgatatcgacctatctggaaggacacacacaaatcccttcccaactcaaacacgatgttctttctggctggcaccagggcttctgtttgcagtgacttcctgggacccggagctttctcacagggcctctggcatctcctctgcggtgattaaggttcttctcatttcccttccctgttactgcccatactcttcaagttcgaaaagtttccttttccaatctcttttctgggcttgtttacccaagtctctaattgccaaggcctctggtctctccccacccacaactttcctcctggttaaacccttcccctcccgccactcccagctcccgccactcccagctcccgccaccactgccgctgacgacgtccagcgtttgcagatggtcaaagccgacccccttctcctcccacctcgttttgtaaggaagtaatttcggggccgagcgctctgcgccccccgccgcgggtcggcgccgccgcgggtcgggagcgtgtccgggcaggtcgcgctcagcggggtacttccccgcccgcgtcccgcgtccgctcccataacgccgtctgcggggcggggacaggggcggggacaggggcgggccgggcgtctagtttccctacgtcaccagggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggtaccgacccgctggggccagcgaagacccaggccgggcggggtcggggccggggtcgaggtctcggctggggcgggctcagctcgccggggctcaagcacagactgcacgggggtcaaggtcgggccaggtctgtgccctggcgcgagccttaggggcgcctccagaaagttcttcggggtttttccccaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtgtaggcggctgtctctaggagaaagtcattgtcgcggcagaaggggcaggagagagccccggggaccgcctggactcccagcgcttccagagacggccccacaagggcccctgtgttcaggagcctagaaaatcttgtaacatttaaataatcgatattgtgggaggtggggataggagaataggagttagtccgctcctttttttcattcattcattcgcactccccaccccgatacatacagctccatcgtaagttttcaggccagcgccccggccccatgctttttctaaatctaaacagagaacccagtcactgcccagagcccgaagtctgtgtgggccatactgctgttgcatcagacgattatacgccccccccaccttttaagttactttcattttatagagctcctggggcgtgcgaaggaagtggtgcattgcaaatgtgaccatgcctaagttggtaacaggctgctgtctctggcgcttgtgtgggatggaaaaagctttgtctaccttttgtgatgtcttaggattctgaccttgtttctttctgaaggatcttacttatgcatagcactttctggtccgacttaattcccaagaacaggaagcagcacaaagtccctcttaaacttgatttgattgatactaatacatttataggtgtgtaatgcaatttttaaaaaattaaggaaatgaccgggaagtattttctgccttgttttctacatttttggtgaaagggataacttttccacttagaattcagggcttccagtgtcggacgctgaatggtatttggtttttcttttagaactgtatattaatatatctcaatctctgtagacaacatgtctatgtaaatacttcccaacatatttgatcttgtagcccataaagaataacaccttaagggatttattaggtctcttggtgtaggagttaggaaagatttcactcacttcttgtagagagaaattggttgaaatataggtttaagattttgctttactatatattgacagctttgatttattttgagcctaaatacggtattttcagggtcgatttataaaatagaccagattttaatttgtaatcatgattttttaatgtttgtaatcatgaagtgtacccgaaagacctcaagctgctctttgaaatattcaagaaaattgaaattatagtcagtatagatacgatattatagtcagtatagtgttaactgcacttactgaaaaaaagtgtacttggaaattataagcatcatttttcttaatattcagttagaataactcaattccaaaaagtagtaaacatgtgaattaaacattgcttattttctgctcctctcatttccataaaggcaatggattggtacataatggggttataggaagaagtgggtttacattaaaatagaaatgtttaaattattttagagaatgtggacttaattttagaataagattttatgagtcttttatgaaaaaatatcagcgttttttaacgagaaaaagaatacctctagatttgcctatataatgagagtataacctaagctgtaaattattgccatttgaaaatcaaatcctacttgaaagccacacagaacttgacttctgtttcccagccaaccttaaatgaagagaaaaagatgacatcatctaaggctggtgacttatgctactctttgtagcattgcttttaaaataaacaaagtggttttacaatgttctcacatcccaaagaatgataatgctactctttgtggtatttgacatatttgaaagtaaggtaacacttgcctcatccaggatgcgttttttaaaaactcaaagtaaatgtctttattcttaccttaacgattgctttcggtgagtcacaatgtgtgtaagtgtgtgtgtgtgtcacatttggaaaacaggtgcacataaagccaaagttaagagaaatgcttcctgggatactcaatttgtcactagtgtgggcgtattaggttttgctggttacagtctgtaatatcatcaatgttcatgtccatgttttgctttccttctcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttcttttctgtgtgttaattttgtcttcatcttgtaagctactaattactaagtgttcattatcaagccaaagtattttaactgatttccatcagcagacatcctctgaccttctgaccacactgtctcctcccagtagttggagtagaaaatataggggagtttgcatgatttctgctctcaagggacttacactttaattgggaggggaaatagtgaaaaataggaaatgaatgcccaacataggtcctttttttttttttttctgagacagagtcttgctctgtcgcccaggctggagtgcattggcacaattttggctcactgcaacctctgcctcctgggtctatgtgattctcgtgctaaagcctcccccacacgccaccacactgggtaatttttgtgtttttagtagagacggggatttcaccatgttggccaggctggtcttgaactcctggcctcaagtcatctgcccgcctcggcctcccaaagtgctgggattacagcctatacagattcatgatctaattagaggtgttttgtgagctggcatccttgactgctcctgggtctgtctggcaagaggagctgcagtgcagtttcctttttggtgacctcacgcttcttcctctgcttccagccgtagagtagcaaagattgcttcatctgaggttagtcatgtgcaaaagtaggtgtaactcaatggccttcctgtttgagtgtgagaactaaaagatacccctagtttttagcttcaatctggtagccacatcttcaccccacctctgccaagggaaagagtcagctgacaccttagaatgtaaattgccttcctaacatgggaaacgtgagggaagaaggaggagttactagaggaaaagaagaaccagagagctggaggatgcagggttatgggcaagatacataacaatctggagggagaggcttttctctgggaaagtggggtggaggtgggagcttggcttcagaaagggtggggacaaactacatgatttgatttgagaatcactggaagagtaactcctgtctctgagcctgctcgcatagccagaattgttttgctaaaagtgcaccttattagttctcgccaccactagaaaacaaggaaaaaaagtgtacctcaggctcttcttttatataaagagtagcacatgaaggcttaggcacagattcacaatcttcagatattagagctatatattttttgagaaccatattttaatgttaaaaaatgtccaatatgttcaggcaattctaattatatctgttgactgacaaaaactgctagcttttaaatttgcatttatattataaaagaaaatgtatctatccgtgaataagttgttcttcactttaaagaactgtgtgctgtgatttgggttttggaatccattgcaataactctacaaactcctccctgccccacttcctctcaatcacggagcagaaaccacctaaagggtcaaaaatcctgtaaatctcattgtcaatcgtcaaaggggacgatccatcaggaagagaacaaacaccttaaaaatagaatagtgactggaagtgctgcggtacaaggagtatcccactttagaatcttgaaggtggactttcaaggcaaaatcatgaatgagctgtgtgaccttgggcaagacaacctctctgagccacagttaatctctgaaattgagacttagatcatctttaaggtcccctgaagtttgaatcataaaatgggatggcaaaggagtctgaaggtctcccaccatagttccaagtctgtcggcccccactcctgagctcatttcagacactaagaggaaagttaagggtttgcaaaaagaagcaggggagtgggattttaaaagaccccccccccccaaatttctgttttctggattcttcccccaaacattgattctaaatcttagaggaggttgagtgggaacctcttggacttgtattttcttagaaaggggagtttgct

SEQ ID NO: 12867 - DNA, 41589 bp, Human
  misc_feature (1)...(41589): n = A,T,C or G
cactcattttttcctgagctgtggctcattcagctagggtccaagagcggaggacttttggtatgaaaaataaaccaaaggacactgggattgggctggatttgaatgagcaggtccaggggactctgggcaagtccctccttgcctcagtttccctgcaggaaggtaaccagtccagtcggatggtcctggaggatgatctagaggctgtttgtgggatggatgcagcttgggagacagtgacaagggtgcggtggaggctcagggtgttgcaacacctaaaagagcctctaggcctgagcctggatgcaccctccgccctctggccccgtagtgtgtgtctgagacagagtgagacaccagcaacatatgcttggatcagggacggaagggactgaaattaggctagcatccgggctgctcaccggggaggactgaggggtagatatagccagggtggggaagggggctagaggggaggatatagccagggtggggaagggggctggagggaaggatacagccagggtggggaagggggctggaggggagggagaccatggggctgccacctgccagttctgaggcctttctagcttgatgcctccgcgtgtttctctggccacacacaattccccagggaccgtctgataaaccaaaggagtgtgaccaactggacagggtcggaggagtggctctggcctaagcgtgcgacgggtgtgtcaatcggagaataactgggagagtgagctagggtctggatgctcctggtctctctcccctaccggcctgtctctgggtctaagggtgggggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtccgcgccgccgccgccgcggctggggtcggtgggtccttgctagagccttcgggccaaggtcgctgagttacagccgccagccggtagaggcagccccgcgcccaccctctgggccgagcgggctgcgggcaggcacccggggaggaggactcgcgaggcggggcctgggccggtagcgggccccgggcgggcaacggtgcccgggaggttggctgtggggcgggggcggggcatcgatggggcggagtctccttgaggagggacaggaggggcggggacggaggggcggggcgtcgcccggtagcgggtcgcagtaggctggctgcgagtcgggggcgggaccacggcgggcggggacagaggggcagggccgagggcgagtcattgagacctgtggaggaggaaggaggaggtcaccgtccagctgtctctcccctgtccccacatgtcttctaagctgttggaggtagtggtgtgcacctttccaactccgtctggtgtccttgagcctaactcttagagtgataggaaaacacaaccatgttgaccggggaatgtcctctaatattccttgggttagggtcagtaccacccacaaagatgacaggtggtactccgggacaggagactgtcccggaaaaacatggctgagcacaacccaaacttgacgccccgcacaatcgtggcagtcgcggcgcccgacgttcgggcggccgtgagcggtcctagcgcttggcggccgttggcgcgcatgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccaggtaaggccggcggggccaggccgggccggggtcgggtagggtgggggcggtgccaggtgtgggaggctcaggagggcgagagtcatgacacggaggaactggaggggcaaaagctgaggggccccgaggagggactgagttgaatggccttaggggagaggtgggtggtggggcgccgctggggagggaaccaggggctgcaaaggggtggtgattggggcgcaactctgggttttgtgggagtccaggctgcccgaatgctgggtgggcagcgccgtggtcataagggggccttttgcatctctgggcagcgcgtgcttaagtaagctgttgactcggtggggaagctgccagggaggggggcgaaagtgattccggaggctgccgtctttattagtcgctgcttaggggatggggtggtgctccgtgggcctgcgcccgcctcgcctccagtttcggcctccgcgtcctgctcacccctcatcctcctactctctggttccagtgcctgagaatttattgagggaaactgcccgtggtgtctaaatccctaattttaaaaggctggttgtgcaaggaggttagtctctccggcatctccttcggtaactcttatttaccttgtagcctctttttagttcatcttaaataactgggatggaggtgctacggaaggatcttagagaccctttttgtgcagaaggagaaggctgtttgccgacctaccttgaactaagaaggactggccatagataacttttacattcccgacagaggcaaataggttggccgaccaaacacagctaatgttttgaaagcatttgatattcttgctatcctgtctccaatgttggggtccctgggaaggtctcaggagggagaaatgttgaaaatcagaaaaggcatcccctccatgccccacaaaagaggtgaacaaagagctgggttccgtttcttaggacattcaaaaccagacatttattttgtacaaaacctctgggtgtgtgcccttagaacaaggatgtccaggccaggcgcggtggctcatgcccgtaatcccagcactttgggaggccgaggcgggctgatcacctgaggtcgggagttcgagaccagcctgaccaacatggagaaactccgtctcttctaaaaatacaaaattagccgggcgtggtgacacacgcccgtaatcccaactactagggaggatgaggcaggagaatcgcttgaacctgggaagcagaggttgcggtgagctgagatcgcggcattgcactccagcctggacaacaagagtgaaactccgtcacccccccaaaaaaaaaaccggggtgtccactcttttggcttctctaagccacattggaagcagaattgtcttgggtcacacataaaatacactaacactaacgatggctgatgagctaaaaaaaaagtcacaaaaaaaaaaatctcataatggttttgtgtttcttttttttgagacagtgtctcactctgtcccccaggctgaagtgcagtggcatggtctcggctgactgcaccctctgcctcccgggttcaagcgattctcctgcctcagcctcctgagtagctgggactacaggtgcgccaccatgcctggctaatttttgtatttttaatagggacagggtttcaccatattggccaggctggtctcgaactcctgacctcgtgatcctcctgcctcggccttccaaagtgctgggattacaggcatgagccaccgtgcctggcctatgttttaagaaagtttacaaatttgtgtccggctacattcaaagctgtcctgggctgtgggttggacaagctagccttagaagttctggtgatgactccgggcacagtggctcacacctgtaatcccagcactttgggaggccgacacaggcggatcacttgaggtcaggagttcgagaccagccatggccaacatggcaaaaccccgtctgtattcaaaatacaaaaattagctgggtgtggtggcacacgtctgtaatcgcagctactcgggaggctgaggcaggagaatcacttgaacccaggaggcggaggttgcagtgagccgagattgctccactgcactccagccactgcaccccagcctgggcgagagagctagactccatctcaaaaaagaaaaagttctggtaaggacatcaggagataggagatataaggcaaccactgttatcagtgagatgaatgtgtccctgaagatgagtgggggtggggagtgggaggagagagaacctgtgccctgaaagagagctgtgctcagggaggttatccgtggctggaaacagccaggtccctggttgtggtccttttttgaaatttgaaacaaaacttttgggaacagctggaaagaacttcttctttttagtttttttttgagacagagtttcactttgtctcccaggccagggtgcagtggtgcaatctcagctcactgcaacctccgcctcctgagttcatgcgattctcgtgcctcagcctcccgagttgctgaggcgcccaccactgtgccgggctaattttttgtatttttagtagagatgggatttcgccgtgtgggccaggctggtctcgaactcctggcctcaagtaattcacccgccttggccacccagagtgctgggattacaggcgtgagccaccgcgcccggcgagaagttcttaatgtaatgatgaaaactttggattttggagtcatacatatctggctctgcctggcaagtcacagctctgtgagcctcagttacttctctcttttttaaaatttctttttttttccctaagaaaaagcctcagttatttcttaaaataactataggctactatactttcttcatagaattgtagtatgtgttttataagatgtgtgcaaagcatgggacatagtaggcgatcagtaaatgctgattgcccttatctttttcaaagtttcaaagttgtacaggttgaacatgtagacaagtttcaaatggccaatgataatgctatatattatagtctttgttggggggcttaggaaggaacatttctaaaattctgaatgttgattttatactgtgaggttgttgggaatccactgtcccttggaacctatgtctctataacctgaggctggagagactgtgggcgtgacctcatttatcaccatcctgcctttgaaggcttgtttctttgatttgggattgtgtgttctggcaacttgtgtgtgtttcatcagtaatttgttatagtgcttcctggtaaggtagccttttcccaaacatggactggcctgaaggctctcttcctgtgaaatatcccggttaaataatgtcaggagtgccatccctttttttatttttattttttgagacagagtctcactctgtcacccaggctggagtgcagtagcatgatcttggctcagtgcaacctccgaggagagctgtccctttgcagagaatggtgatctcacacgtataaaagggctgtatgttcccaaagattatttccaagttgattatttggaatgtgggacacattttcccataaaagcaatgtggttgggttactagtctgacctacaaagctttttatttggcatcttagttgaagtgccaatttactaatagcagttttgggttctgggaacagagcttgcaggacaggtgggaggaggaagagagcttctgatctctttctggggccttggtttgagttaggcagagatttgtctttctctaaactcaggttctctatccttctccttaggtctccaagtcccctggcacttttcttttcttcagttcctctccagacaggctctatttctccaaatgttatatgttccagaaacttcttaggtccctgtccctttttctccatgtagctgatgtcagccaggttttaggaggaaggcagggggacaaatttataccaggttgtgagtgattgatgatagtcctttactcttccactttagggagagtttgcatttttttttttttgagatggagtttcactcttgttgcccaggctggagtacagtggcgtgatcttggctcactgtaacctctgcctcctgggttcaagtgattctcctgcctcagcctcccgagtagctgggattacaggtgcccaccaccacgcctggctaatttttttgtatttttagtagatatggggcttcaccatgttggccaggcttggtctcaaactcctgacctcaggtgatccaccagcctccgtctcccaaagtgctgcgattacaggcctgagccaccgcgcctggccaactgcctcctgggttcaagtgattcttctgcctcagcttcgcgagtagctgggactacaggtgtgcgctaccatgcccggctaattttttttttttgagacgagtctcgctctgtcgcctggtctggagtgcagtggcgcgacctcggctcactgcaacctctgcctcctgggttcaagcgattctgcctgcctcagcctcctgagtagctgggattacaggcactcgccaccacgcctgactaatttattttttatttgaggcggagtctcgctctgttgcccaggctggagtgcagtggcgcgatctcggctcactgcaagctctgcctcctgggttcacgccattctctcacctcagcctcccaagtagctgggattacaggcatgcgtcacctcgcccagctaattttttttgtatttttagtagagacagggtttctttttttttttttttttttttgagacggagtctcgctctgttgaccaggctggagtgcagtggcacgatcttggctcactgcaagctccgagttccatgttctcgccattctcctgcctcagcctcccaagtagctgggactaaagcacccgccaccatgcccggctaattttttgtatttttagtagagacggggtttcaccgtgttagccaggatggtctcgatctcctgaccttgtgatccgcccgcctcggcctcccaaagtgctgggattacaggcgtgagccactgtgcccggccacacccggctaatttttgttatttttagtagagacagggtttcgccatgttgaccaggctggtcttgaactcctgagcccaggtgatctgcccacctctgcctaccaaagtgctgggattacggacatgagccacttcacctggctaatttttaaattgtttgtagagatgggggtctccctgtgttgcctgggctggtcttgaattcctgggctcaagcgatcctgccgcctgggcctcccaaagtgctgggattacaagtgttagccactgtgcctggtctagattttcttctttctacaagttatgaaaatttccattatgtgggcatataattaattacacatcatcttatcaactgatatttgggttgtttctaatttttttttgttttcaagacagggtcttgctctgtcacccaggctggagtgcagctcacttcagcctcagcctcctgggctcaagtgatcctcccgcctcagcccccgaatagctaggactacaggtgtgcaccactacacctggctaatttttgtattttttgtagagatggggtttggccatgtggtccaggctggtttcaaactcctggactcaagcaatctgcctgcctcggcctcccgaagttttgggattataggcgggaggcactgtgcctggcctagattttattcattttataagctatgaaaatttttattatgtgggcctatcttttttttctcttttttaaatttgagacggagtcttgctgtgttgcccaggctggagtgcagtggcgtgatcttggctcactgcaacctctgcctcctgggttcaagcggttcttctgcctcagcctcccgagtagctgggattacaggtgtgcgccaccatgcctggctaattttttgtatttttagtagaggtggaatttcgctatgttggccaggctggtcttgaactcctggcctcaagtgatccacccgcctcggattcccaaagtgttgggattacaggtgtgagccaccacacccagcctctttttttttttaagacagtctcactctgtcacccaggctggagtgcagtggaacggtccagctcactgcaagctctgcctccccagttcaagcgattctcctgcttcagcctcccaagtagctgggattacaggtgtgtgccgtcatgtcaggctaatttttgtattttttagtagagatggggtttcaatatgtttcccaggcctggtctggaactcctgacctcaaatgatccacctacctcagcctcccaaagttctgggattacaggtgtgagtcaccatgccggacctgggcatatcattatttacccattgtcttatcaactgatatttgagttgtttcttttttttttttttcccccgagatggagtcttgctctgtcaaccagagctggagcgcaatggcacgatctcagctcactgtaacctctgcctcctgggttcaggcaattctcctgcctcagcctcctgagtagctaggattacaggtgtgcgccaccacacttggctaatttttgtatttttagtagagatggggtttcaccttgttggccaggctggtttcgaactcctgatctcgtgatctgcctgtcttggcctcccaaagtgctgggattacaggtgtgagccaccacgcccagcctatttgggttgtttctaattaataaaaaatttttttatttgagtcagagtttcactcttgttgcctaggctggagtgcgatggcacgatcttggctcactgcaacctctgcctcctggttcaagcaattctccttcctcagcctcccaagtagctgggattataggcatgcgccaccacacctgaataattttatatttttagtagaaatggggtttcactatgttggtcaggcgcatctccaactcctgacctcaggtgtgatccacccactttggcctcccaaagtgctgggattgtaggcatgagccaccgcgccccgcctaaaatttttttttttttaaagtagagatggggtctcgctgtgttgcccaggttggtgtcaaactcctggactcaagtgatcctcccacctggggctcccaaagtgctgagattacaggtgtgagccactatgcccagcttttttttttttttttgatgcattaaacacctttgtgtttccgtgagcacatctgaaagatagattcctgtaagtagacctgttgactcattgtgtatatgcagttttttattccaaaagattgtccccttaggaggtccttcccacccacagagcgggagaattcttgtttcctcttcctggaatcttgttttgtttttattgagacagagtctcgttctgttgtccaggctggagtgcagtggtatgatctcagctcactgcaacccccacctcctggactcaggtgatcctcctgcttcagcctcccaagtagctgggactacaggtatgcaaccacacccagctaatttttaaattttttttgtaaagatggcgttttgccaagttggccagcctggtcttgaacccctggcctcaagtgatctgcctgccttggcctcccaaattgctgggattaggtatgagccaccacacctagccagatgtttttaatttgccaaccttatccagaaagagaaatcacatataatttacgtgtccgtgcttattcaggaggttggcaatttattccaaatgtttactgcaattaggttttttttttttttttgagacgaagtctcgctctgttgcctgggttggagtgcagtggtgcaatctcggctcaccacaagctccgcctcccaggttcacgccattcttctgcctcagcctcccaagtagctgggaccgcaggcgcccgccaccacgcctggctaatttttttgtacttttttagtagagatgggatttcaccatgttagccaggatggtctcgatctccttaccttgtgatctgcctgccttggcctcccaaagtgctgggattacaggcgtgagccaccgcacctgacctgtttttttttcttctgtgaattgcctgtgtatgtctgaaacatcaacttggttttatttttctaacggttctgctctggtggggagagggaagggagggcatggttattgaagggattgtcagtattgcccttctctttcctccccagagtgagggagggcaggaggctgtgggtttggcttaacaagcccttactctgtcctggaagtatgtgtctggtttattctaaggctcaggtgttggagtcctggtttaaaagtgagagagaggccgggcgctttggctcatacctgtaatcccaacactttggaggccaaggcgggtggatcacctgaggtcaggagtttgcgatcagcctggccaacatggtgaaaccccgtctctactaaaaatgcaaaaattagctaggcatggtgacatacgtctgtaatcccagctactcagaacactgaggcaggagaatcgcttgaacccgggaggcagaggttgcagtgagctgagatcgcgccactgcactccagcctgggcgacagagcgagactctgtctcaaagaaaaaaaaaaaaattagctgggtgtggtggcacgtgcctgtaatctcagctactcaggagactgaggcaggagaatcgcttgaaccctggaggtggaggttgcattgagccaagatcgtgtcactggactccagcctgggcaacaagagcaaaactccgtctcaaaaaaaaaaaaaaaggtgaaagggagtgtgtgtgttgtaggggaggattctatttacctgtttgttttttcatttttttttgtcaagattcttcagaggaggcccctccagccactcagaacttcatcattccaaaaaaggagatccacacagttccagacatgggcaaatggaagcgttctcaggtaccatttggaactgtggtgagaaacttgggcttttcaaagacagtggttttcctagcatgacgggcggtaagttcctggcccttcttgctcttggagcctgacttttcagaagctagggagaaaggtgacaggggagctggctgtctcttcccttcagaggcagtactcagagatgctttatcaggaaggttgcctactttttcaggctgctgccagggtagcccgggagagttccgctcctggttctcttaagccattgccccttgagtgttgctgtattggctgaacatgagtgtttgaaatgatggagcgagtcactttgattcttggctgcaagtaacagcaagtgtggcagccagtgcctcaaggggagaagaggctatctcatggaaactttggccagggatatggctaagcctgcaaatacctgggagctgggacccagagcactgggcacagactggctttctctgctgctcagctgaaatgatgggcagaagataactacttgtacctcccaggcttgtggtacaggctgtggaaagacagactgagcaaaagaaagccaatttcaatttctcagggaaggcctctggcccagttctcgtcaggctcctgctcccggcctggtgagctgggctggagagtgttgctcatgcagaaggctgggcacaggggtccttgcatgctgggcagattctccaggagacccacaccctacagcttctatgccttgtcctcactggggcttggggccatctaaacctgtctgattcctttttcacaagcctgccctctcagtatttggaaatagttatcatgtcttttctgaatcttcaccaggatcaacagtcccttcagcctagggggcagcttggtcccttcagctgctcaaaggatatggtttcagtcctttcatcatcttggttgctttacctcggggcatctcaatgtcagcactatggacattgaggggcagataattcttcattgtaggaggccgtcctgtgccatgtaggacgtttactaatatctctggcttctacccactagatgttggcagcatgcctttccccagctgtcacaactaacattgtctccagatcttgtcagatcttctctgagccagattgctctagttgagaacctgcttctttgtctgaatccaaatgtgacacttcctttgctgcttctcatccatgtgttccagtgtagctgcagtcaggacaggggctcagacttgccctggtctgagagagttgctttggagaggcctggcctgctgggggtcatcccatggctggcaggaggatcttggtataggaatacttccttctagatatcagggcttgtctcagggcttactgtggacaccccggcttggataaggagaaaggaagaaagagagaggaaaaagggatgaagaagaaacaaaaccaatcaggagtcacttgttcccagcaactgcctctctaggggcctgcacctcaatgctatttttttttttgagacagggtctcaccctggcccccaggctggagttcagtgatatgatcatggctctctgcagcctccacctcttgggctcaagcagtcctcccacctcagccacctgagtagctgggaccacaggcacgtaccaccacacctggcaaactttttaattttttgtagagatggggtctcactatgttgcccaggctggtctcaagctcctgggttcaagtgatcctcctgcatcagcctcccaaagtgctaggattacagacttgagccacaatacctgaccctcagtgctttcttatccctgtgttgggtgtaactgcagcccagcagggaagaagagtgtctagttgaaagctgggaatggttgtgtggggagacctgtctgtggcaggcatctgcactccaactagacagcctggcccgcctttggtcgctgattgctgggggtgagacacttggtggtactccttgaattcctggtggtagagcatcatggacaagcatgtgcccactcagctttgaagttaggctactgggtcctagctccatgtctaatgatatcttggtcttgggagaccttgggcggatcacttctcttgaaatcttggtttcctcatctgtaagatggcgccagcagtgtctaccttatagggctattgtgtaaaaaaactgctggcagcaatagtgagtacttggttcactctggctggagatcagcgtgttgctgtggtcactgtcttgccagcttttctggagggtaggggtcggtatttggcattacgtttctgcttctcctgctattgggttgggagtcagggtcaggagaagtagaaagctcggagctctttggtaacctggtggagctcggggcaggtggggcgggggggtctgccacccctctccccatccccattctcctctctgtttggtaggcatacgctgactacatcggattcatccttaccctcaacgaaggtgtgaaggggaagaagctgaccttcgagtacagagtctccgaggtaggcccaaggaggagctgctgcagcagcctttccaaaaatagctccagagtcactgggtgcggtggctcacctctgtaatctcagcaccttgggaggccgaggcaggcggctcacgaggtcaggagatcgagaccatcctggccaacatgtgaaaccccatctctagtaaaaatacaaaaaattagccgggtgtggtgacgggcgcctgtagtcccagctactcaggaggctgaggcaggagaatggtgtgaacccaggaggcagagcttgcagtgagctgagatcgcgccactgcactccagcctgggcgacagagcgagactctgtctcaaaaaaaaaaaatagctccagagtccttgtgggctcagtgcccaccacggggccagagcagaaaataagatcgcccaaannnnnnnnnnnnnnnnnnnnggccagagcagaaaataagatcgcccaaatacatgtgcacttcacattttcatatctatatttctaatttttgaaatctgtgaatagatggatatttataaaattgagatcaaggtaaatatgctgttttgtagttagtatttttgctaattggttttttctttcttttttttttattttgagacgtagttttgctcttgttgcccaggctggagtgcagtggcgcgatcttggctcaccaaaacctctgcctcctgggttcaagcgattctcctgcctcagcctcctgagtagctgggattacaggcgtgtgccaccacacctggataattttttatttttagtagagacggggtttctccatgttggtcaggctggtctcaaactcctgacttgaggtgatctgcctgcctcggcctcccaaagtgctgggattacaggcatgagccactgcgcctggcctggtgtttttatataacttgaaattaaaacagattacaaaacagtaaatgtgctcactggagagatcagtaatagacatgtgtatgacattcacagcagagctgatctctccctgtgtttctcatacccagcttccagggcagcccctcctgacagtggtcacccaggaaagcaagagcttctcttctcctgcagtgagctgtgccctcatttatttatcttattttattttttttttaaatatagagacagggtctcactatgttgcccaggttggtcttgaactcctgggctcaagcagtcctcctgccttggtctctcgaagtgctggggtgacagatgtgagccaccaagcttggcccctcatttatttaaacagcccatcttcagacttttaggttgtcttggtaaacattgctcctcgcatatcattgcatccccgcacatagatctgtgggccttgtttccgaaggattcattcttagacgtggaaatgtggagtcaaagggcacatgcattttttttttgcgtttgggttcacactgcctggtgggtgctttttggacgttgtttcagagatagttttgtttgtgtagagagggcaagagctgaggggaggcagatactgattggcaggtgtggccttactggctgtttgcttttgctggatgctgtctcccagggctaggacctaggcctccaggagcctcttgggttcatgtcccaccttgagtctcttatctcagacaccagggcctgaagggcctccctttactttggcctacccagctctctagccacagccttggacctgttgggtaagatgtagccctgccctggcccagtttttccacctgccccaagattaacactgtgtgcctcaccctcatacccggcccctggcagagctgcctattgctgggcctgtctggctattaggtgacctaggtcctgttctgtccacttcaggagaaccaggcctgtgcttctggtagacagccttcccttgggagccaggcccattagtggctttttgggttccttttgggctcactcagtcctttgggactgaggctctgggtgcaggatggctggggaaagagggggttcctcctggagcctgtggtgagggatgctcagctgtgctcagtgggccaggaatgtcgtggaggaaggctaattaaaggggaaggttgtaattaccccagcaaatccttagctgccaagtcccctaattgcccgtggctttgatggtagccatccacaccaagcaggtattgtcttttttttttttgagtttttcttgttacccaggctggagtgcaatggcatgatcttggctcactgcagcctccacctcccaggctcaagcgattctcctgcctcagcctcccgagtagctgggattacaggcgcccaccaccacacccggctaatttttgtatttttagtagagacggggtttcaccatgttgggcaggctggtctcaaactcctgacctcaggtgctttgtcctcccaaagtgctgggattgcaggcgtgagctgctgcgcccggcccaggtattgtcttagctcaagggctgtactttggcaggattgcagtgtggttacatgcttgggttctggagtccagctggctagtttcataacttgtgaatcatttttgaccctctgtttcctcatctgtagagtggtaagagtcagcagactagtcatggccccctggggaaaattcactgagatcccacgagtagtggttgtcttttgcatagcgcctaacacatactaaataaatacttcgattgttattagctattgttaccattaggcattagtcagttctaattttcaatagtgttgttgcatagaaagctagcttttggctgggcgcggtggctcatgactgtaatcctagcaccttgggaggccaaggcgggtgaatcatgaggtcaggagttcaagaccagcctggccaacatggtggaaccccgtctctactaaagatacaaaaagttagctgggcgtggcggcaggcacctgtagtcccagctacttcggaggtggagtcaggagaatcctttgaaacccgggaggcggaggttgcagtgagccaagatggtgccactgcactccagcccaggcgacagtgcgagacttcgtctcaaaaagaaaaaaaaaactagctcttatttttttattatttatttatttttatttttatttttatttttgagatggagtcttgttccccaggctggagttcaatggtacgatctcggctcaccacaacctccgcctcccgggttcaaacgattctcctgcctcagcctcccgactagcatgtgccaccatgtccatctgattttgtatttttagtagagatggggtttttccatgttggtcaggctggtctcgaactcccgaactcaggtgatctgcccgtcttggcctccgtaagtgctgggattacagacgtgagccactgtgcctggccagctagctcttattttaaatgatgcctgtcctcctcttatgggggttaacattttcgatttttgcaaaataaatgtgataagagatttatttttgttgttgttgttctgtttgcttttttaaaacttacaagggggcaaaattcaaaaatggtcagtaaaatgttagggaagattttactggtccttgaaatccaaaaaggaaacactggcctagggagaatgggagagctggagttgttctttgtgcctcgaaggtgtttcagccccagttccctttctttcagcccttctctcccaacacagcaaacaatagaggcagcccctacaacattcaaaaagccctctcctgaagaggagctgggagcctttgaattattcattggcccagctgagctagcagctggggcctggctcctgtgactccgtcttctctgtccccttcagtgcctcgcctaagactgagatccctggggaatctggggctgactagtgcttcctggggccaagatgactgtgccatccattgtaagcccccgtttctgcatgggttaggtctggcctgtgcttatcagccattcctggtttttcacaaagccaggctctggcagcgctctcacatttcagcaaggcagctttatgccatcctagccctctgccttagccaggtgtaaagggaaatttatcctcttacaggctactttttctgtcctcccatgccccaagcctagataaaggggagataagagagagcagcactcagggccggtttcacatatgcagctgggggcatggccagcctgtttcattagcttaagcctgcctctccccaggtacatacatagctcttggctgagtctttgcacatggcaggcctggtctgccttgccctcccaggcgcaacttctcatgtgggcatcaccctgctagttcctacccagtgccaggatttcctgtaagtttcttatgccgtttgtttccatagacacaggcaagatccacttcctggcagggactcttttctcaggactgaatggctgcagatagcctccgcgttgtattttccaccggccctggtgctgggctatttctacaagccaacctggaaggagcaccttctaactgatctttgggttggatagacagccacccgatttcttcattgagtaacattttatgtgccaatgctgcccgcacctctgactccgattctacttcttggtccctgtcttctgtgggaaaggtgtagggggatgggctctcaaactctgccaccctacaaagcattgcacacgatgatctggcatttccacaaagattgagttgcaagctgatttaccatagcattgtgtatgaaataggtagtgaaacaggtggaaataacccaaacatttaacagtgaggaattaaattaattataatgcagtggcacgatgaaatgttattcacttagtaaaagttgtcataagattatgtttatatgtagatgtggaatgaggttcatgaggaaaaggagcaggctgcaaagcagagtgtgtcctgcgatgaatgcataccattaccccgcgccgggcactgtgcaccttcggaggtatttatcatcagccccattttttagacgaagaaactgagaggctcagagttagtcacttgctcaaggtctcacagcagctaaatggtgttttagctggggtttgaatccaggcccaccatgctaaaccatgtaaaacactatgagaagataacacagaagggtatgttaaaatgtttagtgtaggccaggcacggtggctcacgcttgtaatcccagaactttgggaggccgatgcaggtgcatcacttgaggtcgggagtttgagaccagcctgactaacatggagaaaccccatctctactagaagtacaaaaattagctgggcgtggtggtgtgcgcctttagtcccagctacttgggaggctgaggcaggagaatcgcttgaacctgggaggcaaaggttgcagtgagccgagattgcaccactgcactccagcctgggcaacaagagcgaaactctgtctcaaaaaaaaaaaaaaaaagtttagtgtatttctgggtggcaggattactggtcattttcattttcttctgtttatatttctattttttatgatgagtaggtattgcatactgaacaaaaggcttccataaagtctttttaaaaagatgtcagggctggagttagcttctctatagcagcagcccatgggtaggctgcctacagaaaccaggtgctaaagccaccccgtccctgtcccatcagcctagtgtgcttccctctctggaaagcctatcatgctctcctgaccctccttcatattcagaacagtggggaagaaagagggatgggggagagttcccagtaggggccatgccaaggggtcattgtctggcagcagtggacttccctctgtggctaagcgggagccacttgctctgtagcttggacccctctattttgcctccacaggccattgagaaactagtcgctcttctcaacacgctggacaggtggattgatgagactcctccagtggaccagccctctcggtttgggaataaggcatacaggacctggtatgccaaacttgatgaggtgaggctgccacaggacaggccagggactgggctggcagtgagggtggttctggcaccagttggggaagggcctgcattgtatagcgcttctaggcatatacaaatctcagtttgttaaaatgtcaatttcacttagcaaaattacaaatgagtttatactctgcttggtcatcttctgggaaacacgactgtgcacatacggccctctgcactacaaggctgtttattaagtcactgtattacagcaaactggaaatgttccaagtatccatctgtaggggattatttaaataaattagtccatcaatatcatggagtactgtgcagctataaaaaggaattttttttattttttattttatctttttttttttttagacggagtctcgctgtgttgcccaggctggagtgcagtggcgcagtcttggctcactgcaagctccacctcctgggttcacgccattctcctgcctcagccttccgagtagctgggactacaggcacccaccaccacgcccggctaattttttgtatttttcgtagagacggggtttcaccgtgttagccaggatggtcttgatctcctgaccttgtgatccgcccatctcggcctcccaaagtgctgggattacaggtgtgagccaccacgctcggccccaaaaaggaatttttttcatagctgggcacggtggctcatacatgtaatctcagaattcggggaggttaaggcgggaggatcacttgagcccaggagtttgtgagtaggttgggcaacatagcaagaccccgttactgcaaaaaataagaaatggtggtgcacacctttggtcccagctgcttgggtggctgaagcaggagaatgacttgagctctggagtttgaggctgcagtgagctatgatggagccattgcacacccacttggaatgctagctgcatactccatggtgtggatggactagtctattgaactgatcctctactgatgtttttatttttgaatcttacgaaggtgttacctattcaaagcaaacaaaaataaaaatgcaggatctcagaccctgtctagaaaagcagagtctacaggtctgggtagggactgggaacctggatttttactagctttccaggagatggctcatgccagttgtctacaactgagcttaaggaaatttgggtcctaattgctctggcccaatattttcacatagagcagaggggaggactcaggacccagtgaagtgctgttcccaagagacgcccgggcctgcctctggactcttaagatggtacatgatctttttttttttttttttcctgttgttcaggctggagtgcagtggcatgatctcagctccctgcagccttgacctcctgggctcaagcaatcgtcctgcctcagcctcccaagttgctgggactacagcatgcgccaccatgcttggctaatttttgtgtttttagtagagacggggtttcatcatgttggccaggctgatctcgaaatcctggcctcaggtgatccgcccaccttggcctcctaaagtgttggaattacaggtgtgagccactgctcccagccttaagttatatcttaaagctgacaaatcatagctttacagcttgatggatttttacatgtttttactcatggactcaccactcatgccaagttttttacccatggattcaccactcatgtcaagcaatagaacattctagctggagtgctccccttcccaattgatatcgcccagattattctgatttctattccataaattgatttttttccatgtttctgaacttcgtataactctctggcttcttttgctcaatgtcatgtctgagattcatccatgttttcatgtctagctataggtctttttctttgctgtgtagtattctattgtatgaatataccacaatttattcatttcactgttgatggacatttccattgcatttccaccttttggctactctaaacagtgctgttgtgaacattcttctgcacgtcttttgatggcacatgacaccagctcttgctgacctgagagtgtgaaggaaggtggcctgtgtgggaatcatagcactgaccttccagagtctctgtggggctccagtgagttaccacatgggagggttgaggcttttttccagattcctcctgttttgcccctagactcctgtgccctggaaaaatcagttgatgataagtcgcctgggtagtcttctgctgtggaagaataaatgctgtccctccccttccttctgtggcctgtcagaacaggaaccaagctggcctggcaaggcagtgtgggcccccagtcaggtgctgcccctgggcacctgcccactgggatgctgcttaatatgctgccaccactttgtgtctcttgtgttaccaggaagcagaaaacttggtggccacagtggtccctacccatctggcagctgctgtgcctgaggtggctgtttacctaaaggagtcagtggggaactccacgcgcattgactacggcacaggtatctgctgcttgtggggctctgtacttatctagcttcactgctttctgttttgggcttcaggtggtctctgggccctctgagcaagtgagagcaatcaagaattcgccaagcacctgcaacctattggggccagctggggttagggtggcttcaccggcagggagggcgtaggcatgcagggaggcccggatgctgcagctctgctgtggtccaccagggggagctgatgccccgtgcatggtgcttgcgcagcgctgctttctgttcttgtgaaaatggtctctgagctcctcatcatcaccaaaataattattaattgagcacttactgtgtgtcaaggcagcagcttactgaagctttgagaaatgggaacgcttcttggtggcctttgcagtgtcgtggcacaccctctcccttgaaccccttgtctcttagccacattctctgtgctattgggctgtttggatctgtggtccatgtaagccaagggacctggactttgaggagagggagtgtgtggacactttaaaagggaagtgtagacaggtgcagtggtgcgtgcctgtaatcctagcacttttggaggctgagggggaggattgcctgagctcaggagtttaagaccagcctaggcaacgtagcaagactccatctcttttttaaaaatttattttaagttatttttatttatatatttatttttttgagacagggtcttgctttgtcacccgggctgcagtgcagtgatgtgatcttggcccactgcagccttgacctcccgggcccaagtgatcctctcacctctgcatctccccactccccagtacctgggactacaggtgtgcaccaccagcctggcaatttatttatttatttgagacagagtctcactctgttgcccaggctggagtgcagtggcatgatcttggctcactgcaacctccacctcctgggttcaagcgattattctgctgggactataggcacacaccaccatacctggctaattttagtgtttttggtagagacagggtttcaccatgttggccaggctggtctcgaactcctgacctctggtgaggtcacttctccacccaccttggcctcccaaagtgctgggactgggattacaggcgtgagccactgcgcccagctgattgttttgtattttttgtagagatggggttttgccatgttgcctgggctggtcttgaactcctgagctcaagctgttctcccacctcagcctcccaaagtgctcagattacaggtgcaagccaccatgctgagaccccatctctcaaaaatataaaagggaggtgttctctaggtcagggcatggcctgtggagccaccatgctgagaccccatctctcaaaaatatagaagggaggcgttctctgtgtcagggcacggcctgtcgagccaccatgctgagaccccatctctcaaaaatagagaagggaggcgttctctaggtcagggcctggcctgtgcagctaaggaggacctctgctttggtgagggcccgccttccttccctgaggcaggcagatggggcaccgctcagccctccccttgtctggggaatgtgatccacaggagggagccccagccacagaggcaggccctggagaagggccctcttggaccgggtggggctttgactaagaccagcaggaaaagatcaaagagggaagactggccaggtcagcaggggttggtgccccagctgcatgtgaacccctgaacaatgggagcctgggccctgtctggtcataattggaaactgtggcaggggaaggaaactgagctcacaagcttccaggccctggaggggtcttcgtcctccagagacaggacagaagtattctctgacacattctcttctcacctccctccagataggttttgtgtgacattgtgaacaatgggattcaatcacagtccagtgagttgttcctacagtgcagaccattcctgtttgatatgactgggaaaggaaggaggatactttttcaccctgtaatctgatcatgtgttccctgcttagaagcctgcagtggctccctattgctcttagggtaaagtctgagctctttcctatggccaaaaggcccatgtgacctgtagcctcctgtcattacacgttctcccttgctctcactgccttcgacatactggcctccttagtgttcctcaaacagatcaaactttttcttgcctcaaggcctgtgcacatgctattccttctggctagaatgcatttcttgcttccctcactccctttgccttgccagctcacatctttcagatttcagattagatgttacttccttaggggaaaccttgaacccttacgtcagggtccttctgtgatatcctccagttagtaccctgtctttctccttcagagctggaatcatagtagtgactgtatatttataatgtctgttgtccctgatagatcataaactttctgagggcaaggacttacttgtcactgtctcctagtgcgtaacatggacagtgactgcttacatagtaggtgctcagtaaatatggtggaattgctgagtgagttaaacctacgtaatgaaatgtaaatgtccagcccgggtcttttacgagtggaattatagtactggtagttcttttttttttttttttttttttttttttgagacagtctcactttgtcacccaggctggagtgcagtggccttatcatggctcactgcagcctcaacctcctgggctcaggagatcctccatctcagcctcctgagtagttgggaccacaggcacatgccaccatgtctggctaatttttgtattttttgtagagacagggttttgccatgttggccaggctgatctcaaactcctgagctcaagcaagctgcctgcctcagcctcctgaagtgctgggattacaggcatgagccaccatgcacggccagtactggtattatagttcttgaaaggaaagggcctagcaagtctttctgaatggggaagaggtctcattgtctccatgttgaccaccctcctcagaggggcacttatcaatgattcggattctgggagactaaaacaatcccagtcctttacctggactactgtcaacgctggttgtttttctcctccagggcatgaggcagccttcgctgctttcctctgctgtctctgcaagattggggtgctccgggtggatgaccaaatagctattgtcttcaaggtgttcaatcggtgagagaaaggacaggagggttggaggagggggcgtgaggggccatctgtttcctcctcaaactgggaaatggggtgctctagggttctcctgagtagctcatggttctcttgtcctgtcctaatcaagctctggctgtggatggagtgtccaagccttttttccaacaggttcaaattaacctccaagtaaaagcaagtgaaagaattgtcacataggccgggcgcggtggctcacgcctgtaatcccaggactttgggaggcccaggcaggcggatcacaaggtcaggtgttcgacaccagcctggccaacatgatgaaaccccgtctctactaaaaatacaagaattagctgggcgtggtggcactcgcctgtaattccagctactcaggaggctgaggcagaagaattgcttgaacccaggaggcggaggttgcagtgagctgagatcgtgccactgtactccagcctgggtgacagagtgagactctgtcttaaaaaaaaaaagaattgtcacataatgtctgccagtattgacacagtgttgaccatatggaggaagaattctaagcactttatgtataactcattaattctaacaacaaccctatgaaatagcaactgttatttccattttacatatgaggaaactgaggcacagagatatccggtgtcttcactgggttcacgccagctgaacccaggtagtcagactctgacctgctgccccacaccacccaagccagtcgctgggcagcactgatgtggatcagttacccagagctcttaaaatccccattgcgggccccagtctagcagtgctgctgcagcaggcctgtgacggagcccaggagcagtgctcgatgcttcacaggtggttgatatgcagcctctgataatatagaaggttggaaccagaagaacctaggagataacctgctgggacttgtgttagctttcagacaggccaactgaggctggagaggctgaggccctgcccagggttttacaagttgtcaggagttgatggcaccaaaacccaccttcctaatcagtgattttttatttatttatttgtttattttttttgagacagggtcttgctctgtcgcccaggctggagtgcagtggagagatctcggctcactgcaagctctgcctcctgggttcatgccattctcctgcctcagcctccagagtagctgggaccacaggcgcccaccaccacacctggctgattttttggatttttagtagagacggggtttcaccgtgttggccaggatggtctcgatctcctgaccttgtgatccgcctgcctcggcctcccaaagtgctgggattacaggcgtgagccaccgtgcccgggcccttaatcagtgatttttatgcctttcctgagccaaaagatggctgagtgtttgttgggggaaataaagctacattattgaaattgagaccagttaacactcttcagtggttattttggggtctccttgtgctcccagtggccgaaagggtgagactgtctttttactttttgctaccttccctttccctgtcctcctgtgcaggtaccttgaggttatgcggaaactccagaaaacatacaggatggagccagccggcagccagggagtgtggggtctggatgacttccagtttctgcccttcatctggggcagttcgcagctgataggtactggagcgggaggtgcctatccctccacccccaaccaaggctgcgttctgtggccctcccctgcccctcctgcgctccctccttcccttcttcctgcccagggcagacagtgacagcttggaaagcagggcattagaccagctattgagggaggctgtttactgtcgaccttctgctgtgagagcccgtgtggtgggctggaggaggcggaggccaagcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccgccaagtgctgggtggtgggcctgcttcctgtggggctcagagaggcctgctctggtgactccccaactcttgaagctagttttcaggatgggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggaggaggtgctcttcttgtccccagtgtccaggtgaggaaactgaaccttggcaggctgaagtcatgcgtccaacgccatgtagctagagcttagcacattagaatacacaaacccagagttacttattgctccttcaaggtgaggtgttgagggcaccacgggcaggactgaggcccctgggggggtgtgactgctgggccgggttgcccaggtagtcgtggggcctggttctgaacgctggggcccattccttttcccagaccacccatacctggagcccagacactttgtggatgagaaggccgtgaatgagaaccacaaggactacatgttcctggagtgtatcctgtttattaccgaggtgaggaggaggggtgagagagaagcccatggctgcctccaggctcagatgaaccaaggctggtggccttacagtggatcagaagagccagagctgctgcccaaaatggcagggccggccggagcgggttattgaaaaggaagcaccactgggcctcttccgaaagagccgctgctgactgtcaggtcctccgcccagttctccttcagtttctcctgaacaccacaggagtcttgagatgagggtctaagacttggtcactaactggccttggtgactgctgcagcaggtctgaaagggtcggggcgggcggaggtttgtgggggagggtcagcatctttcggtggggccccacaagggtctgtagaaccatgtgctgtggatgtgtaaaatgaaaccaccagaggagatggagcgaacttctggtgcagacagcttttctgtcgaagggacacgtctctgtcagtgcctgaggacgtgggcccgagcaaagtgctggagtgggagtgcgcaggcctggcctgtggtggcagtcactggatagccagccccacggctgggttctggaactggaagttattgtctcaccaaggcaggattccttgcagtgggccctggaccacttgtgcgagatctcctagtgtgtttgttaaaacgcacattcctgggccctccatcccagcttattgcatcagaatcttaggggacaagagccaggaacctgcatctaaacacacgtgccaggcgactgcacaggaaagctggggaccctctgctctctggacctctcttgagggaggtgttaggacttctcatcctctctgccatccccatgccccagtttccaaagggcgccctcgctcagctatctggagagggtttgagagttctatccctcctcagtccctttcccgacaccagcacggatgtctgctgcctcagtgaggttcctagcaggcctgtggatgctggccacgggggctgctctccgtccgggctgtgtattctgagcccccgacgaggtggagaaagctgggttataaccagcagccttggctccaggctcttcctggtcaacattcggctcaggcttctgccaaactccagaggccagaggggaatgacacattttttccaagtcagcaaatggagccgggactgacggctgggcggccaccacttcattcccggagatctgctgccctcagcagtgtggcaggcccaaggtcgggaggacttgggggcagcctggctcactgccttgaaagccagtcacgcgctgctctctgtggagtggaatgtgggggtctgcggagccctgggggacctcaggataagctggaggagcagggtgggaagaagggtgcagatgccacactgagttcttgggtgtggctgaaaggctgagctgtttgggctcccccggcggctggccaggcctctgggtccctgtcggtattctaactaggaggcatgccaggcctggcctccaggattttgggaattgattccatggtaaaattttgtctttagttggttggttgattttgttggtataaacaccccaaaagcttttccaaagtttgggacccagttcctccagtagaggaaatctcaaagtagccactaggtggcaggagaggcacactgaacttggagagggtttggtgacatttatttgaggcagcagaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttggtgagtggcctggcctagctcactggggacctggaggcttgcatggagttctgtacgccttgcttgggaaggaggcagtgtttcctctggagaccctggattcaccatggtgctcttttaactgggagattaactaaaacaccgagaacttgggagtggaatcaggcagccctttcagggtctcatgccaagactgccctgatacccgtgggcatcctaggtgagggaccccaccttgcagggcctctacagcctctgtaaatgcagccctggcgcctttaagagcccagggcaggcaggaaaagaatttcagtttcaatctggcttctaaatttggagttttgggaagggagggatcagatttcagctggaagggaaggagctgacaggaaggcgctgtgcagagcctccccacccccgcccatccccccagttactgacagaggagccatttacaaaaggccgattctctggggagtggagaggcaggaacgcagcgtctgtgagtaatttcctgctcaatatggctgctctgactcacacgattcccctggggtcactgcgggctgcagctcgctcgctcattctggttctttctcttctccctttgtggctagaatgagctaattttttctttgtcttccagccccgattcctttttcccccactcgtctgttttcctttgccagagttacaggcaaaggactgtaacctccctgaaggacttagggagaccctggggtactgaaggcctgggggcagcctgcagcccctccaaagaaactacctctctggcctttctgtgtgtaggggcccagggccactggagctccaggacatgggcctagccctggctctgccagaggccttttgaggatctgttctttggccctggtaggcgaggctggccaggaggcaggggctcttgtcttccagtgcccatctgcctgcctttgcctcggagcccttgccgggcaggcccctggcagacaaagccgacaaagccgacagggtgcctcctggttgcttgctcagagggccctgtccagagagtgaaactggttacacagctccatgctccctgagctttcctgggcctggaagtgtgcacagggctggagcctgcagactggggaaggggtggggtagggtggggaggtgggggaggggctgggggtggagtgtggttgagcagggcagttgaaacaaagctccccagaggtgaggcccctgtaggctcggggtgcctggctgccctcctggaggagagagcctggggtgattctgagtgaagcgagtggtccaagacaaggcccccagggaccagagtgggctttgtctctgttgggtgcctcgggctcttgcctggctgtggtggagcctgggagagaagaggaggggagggaggagcctgttgtccttgctcctgaacatgggtgtttggatgggctttttgggaacctgggccaggggagggaaatgagggggataaaatgacaggttttttttgacttaaatcttaaaagttttgtcacagttgcccttactagagaagtaagaggcctgccaggagtgggtcaccaggtggcagcccatggctcaagagtgggggctcctgagggctcttgtggtgaactgatgcccctttttggagagcgtttctggcttatcttttctccttcaaaaaataacccagtctcccctgacacccgcatgtttctagaaccttccaagtctctgtttctttgccagattcagcctctttgcagagtcttccttctgcagcatgggtctggggtacagagccctgttcccctgtaaatgctgcctatgagctggggggctgtgtcgaggggaattatgaactgcttggttaataaatacaaatgtgctggacttgcggtgtcagggggatatgctcaggcacacaggcgtccctctgtggtttctgacgtcatgggaacttcatgctggctgcagaatctttctcttccgtcctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcaggtgcagaccacgtgtcctgtgggggggcctgggggagagggggtgggcctggaggggtggggcctagctgctgctgctatttatctgaacccaagtgaatccctgtgctggagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgcgcgtgcattgtgtgtgtgtgcgtttgtgtgtgtgtgtgtgtgcatgcatgggtgtgactttgctgcaggggaggagggatgagctcccagccagaacctgtctcttcagcttgtggcttctctttttcagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtcggagtctggctctcccatggcatacctgggaagggtcttaccctttggaggcatctccaaagtgctgccttcaaatgttagtgtgtatgatcactgagtggtgggaggtctgagggtaggccgagaattggcatttttatggaccgcttcagggattttgatgcaaatggttttccctgctctcaaatcagatgctgaggagaggagagctgaggcttcctggagctccccctgctggcaggcagccgagggtgtctcctgccctcttggcactgttctcccagccaaggaggtggccttttctctcttccaagtggggaggagacattttatttctactctgtcccttctgctagctcctcccacttcctgggaagactaattctagaactgcttgaccttggccagggaagggctggatgtgaagttccacacctggagtgatgggtccttaaagtcccttctttctgttctcaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggcgccagaggccagcggggtgggggagcacagatgcttccagttggcttggctccctgcacttggtcctgaaggggttaatgaggcttgaactgaacagaccgggccctcactcccttccgccccctccccctttggtccccttcctctggacctcacatcctgtgtttaggttccagcccacatacctctctaatctgagaggcctgagagcccgttggctggagctgcctaggttccttccggctgcagctggccacccccggctctccactccgactctgccctgggtcactgccctctggtgtcctgatgttcctgaccccacccccgcctgtcccacagtgggggctgctggggaactctcactctgctgtgccccgcctccagggtgtctgagcatgtgagaggtgcacatcgcccaccagccacctcccaaccccaacccttgtgtgccaaagagaggactctggctgccttctctgcttggtacctgaagtactgtcttctctacaagcctcttaattcaagtgactctaaacttctctcgactcaggctctaaggcccaaaggatagggcaagagaccctgtccccttctctcacctgcccttccagagacaaaagaactccaggctgccagaggatgagggaggagcatattcggattgaaaatggtgatggtgtggcaggaacacagggactgtccactctgcacaggctgtcggggtctccgtgggggctgagcacagggtggcaaacacaaagaggacactgaaaatgaccaactcaggatgggggagctctctagtaatctgaaaaagggagattctagccctagttgaggccggcgctgtgtggggaaggggacaggctcctgtatagggtgacgctggaactccctgactttaagatcaccaagtcaggccgggcgtggtggctcacgcctgtaatcccagcactttgggaggccgaggtgggcggatcacgaggtcaggagatcgagaccatcctggctaacacagtgaaaccccgtctctactaaaaatataaaaaaattagccgggcgtggtggcgggtgcctgtagtcccagctactcgggaggcagaggcaggagaatggcgtgagtccgggcggtggagcttgcagtgagctgagatggtgccactgcactccagcctgggcgacagagcgagactctctcaaaaaaaaaaaaaaaaaagatcaccaagtctttgcctgtaatcccagcaatttgggaggctgaggtgggtggatcacttgaggccaggagttcgagaccaacctgggcaacatgaggaaaccccgtctctactaaaaatataaaaattagctgggtgtggtggctcatgcctgtggtcccagctacttgggaggctgagacgggagaatcgcttgaacctggtaggcggaggttgcagtgaattgagatcacaccactgcactccagcctgggcaacagtgtgagactccgtctcaaagaaaaaaatcactggttgggtgcggtggctcatgcctataatcccagcactttgggaggccaaggcaggtagatcacctgaggtcaggagttcatgaccagcctggccaacacggtgaaacactgtgtctactaaaaatacaaaaattagcctggcatcgtggtgcgcacctgtaattccagctactcaggaggctgaggcaggacagtcacttgaatttgggaggtggaggttgcagtgagccgagatcatgccactgcactccagcctgggcaacagcgagactccatctcaggaaaaaaaaaaaaaaagatcaccaagtctttgcagtgttcaacactcattgacaacttactagcaactagcccttagtccttggtcccgaagggcccatgggctggcatgttgcctacacagaggtccaaggagagggcttgttttctcaggccagttcttagcccctaaggaggccctccaaggcctgccagtcttgcagtccaggggtgggtaggaaggctgggtctccagtcagaactggttgattgaggggagtcagcctcctgggctgccacagaagtctgaccagcctggcagtaggtggcctcaggatttgggtctaactctgctctgtcccagcctttctgaccgaagaaccaagtgctctcaggggccttgtgtggttgcggggcggcgggggggagggtctgtctttcctctgggccatggctgtgtgggtgctgccttcagaaggaccttgtcaggacccagggagtcccttccccagcttgaatcacctctggctggaaggtcagggggcagtctgaagccgctgctccgcccaggtacatgggagggccttgctgggagaaaggctgggctggaggctcctcctgccctggagccttaggcttccttggcccagctcctgtggctctgagggggctggctctggggtcctgtgggcagaatgggaagaacccctgcctccaccccttctcgccttgcaacttcttctatgggagctagagggaggttgacctttgaccccttctggaattccagggcccttggggggtgggggggctcttatgaccacttctgggatgacataagcaccatggcagctgccttggcctctggcctggatctgcggctgctccccctcccgcccagggaccacctcccgctccctgctcccgcattctgtgtctcaggcccaggatcctggctgtggccagggctctgctccccaccccaccatgagcttggtttccatccttctttccctcccctcctggcgcctctttggcccactcgtcaccctggtgcttctccctcttaggttccacagctgatttttgaggagagggaacctgggccagtcatagcacccgtttgtctctaagttagttggaggttaagatcacagccacagagtgaggctcttactctctctgaggccataagtcttgttccaccccagccaggaggtgcctaacatactctgttttctgtggccaaaggtgtgggaggaggccctggtcagtcttggcagatccaaccctcgcatgcccagaacggctcctgtgagagctagtgtccaggtgtggcaggcatgggggtgctgttgcgggagctgcagctggaagctggggttggctgcctgtgggccaggccagcttctgtgataggccctgtcacttgctctccagctctgctcctctgctaggagcccgggctgggctgggctcagggagtcgggcctcccccctgctcagccattcccctgttcagcgctctttttcccctgccccccacacaggctgctgggaattgcccaggggtggggggaactcagtgtcagctggttcttattgtctcgctctgaagtgccaagatgcctttttcagtccagagaactgaaagctggagaaaacaggctttgggacccggcctcagcctcttaggcttacgttcaaatgtccccacgtctcttctctagaactgggacctgggctgggggtccccagtgatcaggagggttctttccacctcaggttcccaacttccctctctgggccaagtgatggcacctggctgcctctcttctcggtttctaccttgtaggtttgggctgccttttctctctttctctctctcgtgggtctcgttgtggagtgggtgtctttggatagaaggagtgaggaactgggggaggaaggcctgggggatcccctggcggggctacttcctgggcccgggatggacacctgggagctgctgcggttgttggggtcctggcaggggtgtggtgtggccctcaccactctgctcacctgctccttcctcacagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtcacttgtgtgaggtatgtcttttcatgtcacatgtttaacccatttctgcatgactgacctccatcaggtccccttctctcaggccacagtgtctgagacgagctgtttcaatttgggttgagcctttcctgggtttaaatcctagctgtctgcagtcccagctgcaaggttgtaagttactgaagcccctgagccccagcttcctcaattcacaaaatggggacagtcacagggtgactgccagcagtggacagcagatgtgaagtcctcagctcagggcctggcacatagcatatcccgggtggtcactgcagctgtgcttggtgaagggggcccctctggactcccaacttagccccaagctggccagggagcctttggatgggctttgacagtggaacatgcacctgtggtttgtgagggggtggccctctattctccctcctctgcccctcctgtccctgctgggctggagttgagggtctctggggctgctgtgccccagacttccttaagacactcttgctcagagaacaagggtccttgacctttctcttggccttagaggccttgcatggactggaaagcctcagcccctcatcaccttgcgctgcctcaggcacacccgagttcaaactgagcagctgctgcttactcaccaggaagtagagggccctcatggttgacttctctctgagcctcagcttcctgatctgaaaaatgggcataatgacgttcctatcattggtcttgaggattccttcatttcacaaatagtggctgcatgttcctcatgactgcagtgcacccagatatgacagtgttaggtagccggtggattatggagaaaataacgtcaattagagaaggcgttgatgggggcagggcagggggttacttgctctaaaaggtcctgtgagctgagaccctgaggacaagaaagagccgctgtggagagctcaggcctgggcctggagggctagggttgggtataggggccagactttcaggccggggccttgcgggctctgctgagtttggacagtgttctatgggaaggtgctggaaggttttgttggggagaaggggagataggaccatttgggaggttgtagttgtgattgggcacagggatagtggcctgggtgagggttcagagtgggatggtgggaagtggtccaatttaggctgcatttggtgtcgctaacaggaagggagttatgacagggagccgagcagccaagaaccccaattcttggcttgtgtggcttggtgccatttcctggggtggggggccctgagggagaggaattgctgtgggggcgcggaactgcctgttagcttctaagaggaggtgctgaggatgagggcgctggggtgggctgaagaggatggaggtggcgggcatggtgacgaggcgtagtgccaaatgggtggaacatgcagatgagggagaggagagggccggcttctgcacagaggagggtggagtgtgggcaggggacccaaagctgcaaatacaaggagcattggccctgggtgggctttcgtggggtgggggaggggggagcagggatgagaacgcagaccgcaccctgtgaggtctgcttgtcatggcacaggcccccaccctaggaggaagatgtggagggatggtctgctgcttgaggtggatactgaccagacatcactcgcttctcttctgagtttcactgtggtgggagtggggacgggagagtgggcagggtggtggccaagggactgccttgaaggtgggctctggtcagactggcaaggggctgcctcctgctgcatgctgggaaggtccaggagagcgggaggttgaagggagcgaggtcctgagaaggtaccggtggccttcacggggcaggtggctgaggcaggatgctcgtttctccctgtgggaggaaggcagaccctgcgccggtttggcggcgggttgggctgggtttatttttacagggaaatgtaaggcatga

SEQ ID NO: 12868 - DNA, 15402 bp, Human
  misc_feature (1)...(15402): n = A,T,C or G
cctttgtttataccagcccacctcacatctgattgtaatggggacggtctacacaaacactttggttcaaagatttcattgcctggtgatcgtgtatgtgttgcacaattaattaaacttctaagaggctaatcaattaacctctgaggctttgaaactgtcagagtggtgagattgctgaaaaagggttgcttcgtgaattctatagcagatgcagttatttaaatattcaggtaacagtttcgggctgtctgatgattgaactggatctgtaattctcagatctgattgacagttggacgaaattgatagctgccagttgcctattcgtgtagtagctatatgcacatgtgtagggagaatagaattcactaagcaatttattttttcataacgggatataattagctctaacattcattgagtggctaatatttgcaacactccatactttaatgtactttacacacatgactgtatttatttttgtctccatttcaggaaatagaaaattgagattcaacaatccaaggttacaggaagtaatagtaaaaaattacacagccacaagctcaaacttagatctccctaaggtcagagtacaagctcttttcactactgcagatactccttgacttatgatggggttacatacagataaacccatcctaaattgaaaatattgtaggtcaaaagcacatttaatacacctaatctactgaacgtcatagcttatcctagcttaccttaaatgtgctcagaacacttacattaggctacagttgggcaaaatcatctagctcaaagcttattttataataaagtgttaaatgtctcatgtatttatcgaatgctatgctgaaataaaaaacagaatggttgtatgtgtacttgaagtgtggtttctactgaatgtttattgcttttccaccactgcaaagtcaaaaaatcataaatcaaagtcaaaaaacataagtcagatattgtctgtactttaaataggggcacagggttgtacaaagaggacatgcacagagtcagcaaacacagtgatcaaccttcctggtgacataagaaatgcaaagggaaaaaaagccaagaaatatatttttcttattgaatgagggttcttctttttttattgataaataattgatgtgcatattttcatggtcttttttttttttttttggaagccacctatctctggtaagaatatatttatatgacattgaaagcaatttgttaatataggttaagaatcctaaatacaatcatatcttttgaatagtcattaaattctttgaagtctatcatatgaaatctatcataagatctatcgaaagaaaataaactaaaataagctgaatttgctgcaacatcatttagattttttaaatttttaattttaaaaaaccctttaaaacttatttttgaaaaccactcagtaatagagaaatgaaacaactgtatgatttcatattacatagtcatgaaaaatgttttacaagactttgcaataacacaggaaatgacttatagtatggtattaaatgaaaggaagtaggatacagttacttacagagtataattccaaatgtcttaaaaaatatatagaaatacactaaaatattaacattggctgtttctgggcattgggactagagaaataattttcttattttgaatttacatatatttataatattctgtaatttaaaagttttataagaaataaatatatgtatttagaaaaaatgctaatataattaatttctctgattcaagtgttttctccctattgtaaaattacaaagcacctctcttcgttgccaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaataggtgagtccccaatccccaattctctcttagaaattgtgggatctttgtttatgataggaaaagtttttcattgcagagaggaaaggcctagagtaaatgtggatgattcaatttgtggatcattattacaacaaattcataattacagtgcagtgtctcctgctaccaattataactgggttctgttagtctacatgaaggttggtagatgccaacagaataccaggctagccttagattgccattggcaaaataaacagatgaaggcatgtcatggatcaaagtagctccagaaatctgagaatcctagaggtgagttccttcagacaaggtggcagtaaccatgaaacttactgacaaaattgaggtcaaagttgaggatgtcaggacaagatgtgacgtagtgaagacacagactccaaggcagaacaagtcagaatccactagtccaagccaaacaaagggaaggaaaatagcattttcttttaaatgttaaaagaaaagcaaggctgaccgtaaagtcccaggaagcaatatggtgcgggggagcaagccagggcttcagcgatgattagggtggcttgaagcctagtctcactagtttgtagttttgtaacctcagacaagtcacttgatactgtgagcctcagttcctcacttgaggctgataatgcctccttcgtaagtttgttatgaggtctaagtgcaatgatgaaatagtaagtcatttggtacatcataggtgctcaggaaaggctgttcttgcctgaaaggtctaagcagagtacataccttatccatagacatgcactgagatttaagctcagtgtaagggaacagctcctttacaaatctgtgctttcggcccctggaattgcatgaacgaggagctggttaaatttgtcctcatcccttcctaccccctggcctggaaaaaataaaatgtaagtgctgctcttggcagatacctaacagatcaaatgaaacagtgcacatggcagtgttttgaggggtgaatggcaaatacagatataaggtttattattgccttccacagagatgatgatttttatagcatgttacatatttatataaatcaattgactctcactttatggagaatgagtattttcaatgtgcctctgcaaacttttccttagattctaagaaagctgctcacctggcagattttgataagagcatcaagtgggctggagatccacaggaagtcaagagagatctagaggtaaattctacaatccagtttacctttcttctttctgcttccttattctttcatgtagtagtcagggttctctagagggacagaactagtaggacatatgtatatatgaaagggagtttattaaggagaattgactcacacggtcacaacataaagtcccataataagccatctgcaagttgaggaacaaggaagccagtgatgggtcagtctgagtaccaaaacctcaaaagtagggaagccgacagtgcagccttcagtctgtggccaaaggcctgaaagcccctggcaaaccactggtgtaagtccaaaactccataagctgaagaacttggatactgatgtttgagggcaggaagcatccagcacgggagaaagatgaaggccagaagtcttagcaagttgtctgctctttcattttctgcctgctttattttagccatgctggcagctgattagatggtgcccaccgagactgaatgtgggtctgcctctcccagtccactgactcaaatgttgctctccttcggcaacaccctcacagacacacccagtcacaatactttgtatccttcaactcaatcaagttgacactcaatattaaccgtcacagttcattaccttatttcctatgggcaattggagggcattctattttaaccaggaaaaaaagaatgttcaaggctttccccatcttgctcactgtcctgactcccctgtaggccatggcatttccttgggcttctcccgcagcagagctttcaagatgacaatgggaaggtgcaacagcttgggtcggtgtggagttggctgtcactgtggacccttactgtatctctttgaatctctcttcctccactaccttaataagtaaataaactgagcatgccacatcttctctccaggagagaatttcaaatatctccaatattcattgaggagttatttttctacctaggaacaaagtaagtgaggtttctttcaccacaaactcaaactcgtgggctacactctgcagaaggctggatactaaggttctctgaaaactcctgggaggagtgaggtcaattcccagcttgaaagaacctaagcttggccaaaaagatgaggactctgaaatagctgttgctcctgaggggacatggagattggccgctgtagaccaaagcccccaggctgattctgaccctgtcagggtaggtctttcctggagagttttacagggtgctgcactttcaacccagtgggtgagactctccacccatatgtctggcctcctggtttggtggcatcagatttcagctccctccttgactggtggctagtgcaaagagttccttaggcgaccttcttcttggcctttcctcctggccacggcctaatccctggggtcatcactttgcctctcctggcctggactgacttttttatttgctgcgtgacatagcctcagacccaaagtcccagtttccagccaggctgtcagttctccctgtgtttaaagcattctccctttcctcaatttatctatattctgtccatacatttgaggcccagctcaaatctctcttcctccaagcagtctgccctaacaactgtgacttatatgtatcttttactcttcataaaactaagtggtatgggcgatatactgccttgaagaggtctgtatgcacacatctgtgccttccctccctaacaagcctacaaattccttgagattcctcccatcatcttgtttgctaatagcgtgcaccactccttccagggttacccaaataattagtaagcatctttggcttgatttatggcttttgtgcaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagaggtaagtaaaactttgtgcagatgccacaggcctccaggatggaaagggtaaggtggtgcagacagaagtctgggctgcaaatcaggagacccaggcttttttcttagcttgggatttactggctgtgtgtccttggagagatgacttaacctctctggagtctgcttttcatttctgaagaataaggaggggaaaaaaagagatgcttgcctctcctatcatgcagaatttttgaagacatggttgtattacttttattaaaaaccaaaatctagccaggcgcggtggctcacgcctgtaatcccagcactttgggaggccgaggcgggtggatcatgaggtcaggagttccagaccagcctggtcagcatggtgaaaccccgtctctactaaaaatacaaaagttagccgagtgtggtggcaggtgcctgtaatgtcacctacttgggaagctgaggcaggagaattgcttgaacccgggaggtggaggttgcagtgagccaagattgcgctactgcactccagcttgggggacagagcgagactccatctcaaaaaaaaaaaaaaaaaaaaaaaaaagaaagaaaaaccaagaaagcacaaaaaacaccaaaatctaacggttttctttttctggaaaaggaaagggagggatgggatgatcatgatcatttagatcatttagtcatcttcagccgctataggacgcttcggaatgtgggaaatgaatccgacatcaaaacacgaaaatctgaaagtgagatcctcagactactgcaacctgggccttctgaacattccaaaagttttgacaagtggacgactaaggtatgaacaattcctatagtgcaggggttagtccaggaataagaatttgtgtaatgttttatgttagtttttctatcttattttacaccagtggcaaaccagaggctcaaagaggtgattttgcctcctgccctcccatccctatccccctaggctccccgccggggtgtctacttctactttcagaagctggccctccctctctcccattcagacccatgcccctctgatagactgttattcaggctccccctggatggccttatcccagcccatgagcctttccctcacttagctgataatcctattgccattatggcacgagcagctgactaaatagagcttaatccaagggaagtgcttcaccatgaggtgtttcagtccaggtacagcctggctgcctccactgcctgtaaacagcccagctctcaggatccacacacagacctacattctgcctgaggaaatagactatgaaggaaagatgatctttcaaattgctctctttaagaaaagttccacctaacttgcattaattatagtggaactctacaaaattagtcatcatctcaatctagtcagtactgtcagaactttcattattaattaacaaacatctatacaataccaattatgtgctaggcccatgcaaggccttgagcatacaaagcagaatacaatgtgtccctgtggggctgagaagcccatggaaatgatgctgtgggatgtgtgctgggcatcccagggacatgtgcaaagcactatgggagaacccataatcttcaggtcttggaaaccaacagcttcctatcctagacctgacctgggactctgcttctcctaattcttgttttgctttccttccctcactggtctctagactgcacatcacactcataattactggcttacggtccattttccttgctagactgtaagttccatgaaggcagagactacccattgtcttgtcagttattgtatccctggcatggagtagatgtgccatgactctttactaaatgaatgtctatcaaactttggctaaaattttaacttgtagaaacaaagaaatttgaaagcagctatgatagtgatagctaatgattacgtagtatcattatgattatgtggcagccatagttcttgagactttacatgagttaccacatttaatctttagcacaacttctgagacaatcatctatattttgcagatgagcaagctgaggcacagacaaataatttttccaactacacagaaccagtaaggggtgcaccaggatttgaagctgggaaggatggctgcagaggccatgtgcttaagccacaccactacatgaagctgtgatggcatcaagtctaccaactcatttactcactgaggaaattgaggctcagagaccacactcaaattactcatgctggacagtcagagattggcagacctggaaagaggaacttgttcttttatttcccaatttattggttcttttccctaaattccatgggcttatattgaattttgatagtcttcaggttttaacttcaagttttaccttttaattcccattttacactttgtttttctgttgacttgcccattttcatggtcacacaattaattttgtcagcataggtctggagcccaagttttccagcttgtatgactgtattggttcttgacttgccccatcctgccacacatacgtgcttggcgtttctcacgggtgttctgcacagagtgcacctggccagtctcagcagcatcctcactagcattgctctttcatcagttactcttcctaagtgacccactggattcttgactgttgcatcttgatctcgtagcccaaactctttctaaatatgagagccatctatggctctgtatctatgagggtgacaagcacagacaaagaggatgacattactgtgatatgaaaggagttgccctgggacacctgcaggcaaggagaaacaagtaaccttgtttaaaatataaattttagagggtactagtatagttttgttacatggatatattgtgtagtggtaaagttgggcttttagtgtaaccattacctgaataacgcacattgtacccattaagtaatttctcatccctctccctccaaccctcccacctttccaagtctccaattatattattccactctgtacatccatgtgtacacattattgagctcccacttataagagagaacatgtgatatttgactttctgtttgtaagtcatttcacttaaaataatggcctccagttccgtccatgtggccacaaaagacatgatttcattcttcttttttatggctgaaatggcccagacacattttctttatccaatcatctgttgatggacacttaggtggattccatatctttgctattgtgaatagtgctgtagtaaacatatgagtgccggtatctttttgatataagatttcttgggctgagtgcagtggctcacacctgtaatcccagcactttgggaggccgagatgggtggatcatttgaggtcaggagtttaagaccagcctggccaacatggcaaaaccctgtctctactaaaaatacaaaacttagccaagcattgtggcacacgtctgtaatcccagctacttgggcggctgaggcatgagaattgcttcagcctgtgaagcagaggttacagctttattttggcagatactcagtacattcttttctctgcatcctcatcaacatctgttactttttgactttttaatagtagcccctagtataagatgatatctcattggttttaatttgcatttctctgatgattagtgatgttaagcattttttcatatgctttttggcaatttgtacgtcttcttttgagaaatgtctattcttgtcatttgcccactttttaatggtgttattattttttattgttaagttgtttgagttccttgtaaattctggatatcaatcctctgttggatgcatagtttgcaaatattttttttcccatgctgcaggttgtttgttcactctgtttatttcttttgctgcgcagaagtttttagtttaattaaaccccatctgtttctttattttcattgcttgtgcttttggggtcttagtcatgaattctttgcctagaccaatgtccagaagagtttttcctaggttttcttttagtatttttatagtttcaggtcttacatttaagtctttaatccatcttgagttgatttttgtatacactgagagagagaggtctagttttaatcttctacatatggcagtctaattttcccagcaccacttactgaatagggtgtctttttcccagtgtatgtttttgccgactttgtctaagatcagttggttgtagatatgtggctttatttgtggcttctgtattctgttccattgatctatgtgtctatttttataccagtactgtgctgttttggttatcttagccttgcacaataattggaggtatatcataatgtgatgcctccaactttgtttttttttccttaagatgcctgtggctatttgggctcttttttggtttcatgtgaattttaggattttttctctaattctgtgaaaaatgatgttggtattttgatagggattgcattgaatctgtagattgctttgggcggggtgatcactttaacaatattagttattccttttggaaatatacctaaaaaaacaaaaacaaacaaacaaaaccgttcactttggccatggttgccaggcccagtttcagtctgaatagcccttttaaagaaagacatgtaatcaagtacgaatttgaaagggtggccacaggataaaaatattgtatagtataatgaacgactttcctagtatagtagtcaaagattttttaaccatattttaatatatttaatttcttatgaaaacaatttacttggaaaatacagacacacatttgaacatacttataatctcacatccagacacaattatatatatagttttaattttaaaatttttttaatttttttgccaggtgtggcggctcacacctgtaatcccagcactttgggggccaaggtgggtgaatcacgaggtcaggagtttgagaccagcctggccaacatggtgaaaccctgtctctactaaaaatacaaaaaaaaaaaaattagctgggcatagtggcgggtgcctgtaatcccagctactcgggaggctgaggcaggagaatcgcttgaacccgggaggcggaggttgcagtgagccaagatcgcaccactgtactccagccctggtgacagagtgagactccgtcttgaaaaaaaaaaaattatttttttgagatggagttttgctctgttactgnnnnnnnnnnnnnnnnnnnntgcaacctccacctcccaggttcaagtgactctcctgcctcagtctcccaagtagctgggattacaggcagcgccaccacgcctggctaattttttagcagaaacttttagtagaaacgaggtttcactgtgttggccaggctggtctcaatctcctgacctcaggtgatccgcccatttcggcctctgaaagtgctgggactacagatgtgagccaccccacccagcccagacacaattatagttagcattttggtatacagcatttacttccatttttaaattattttgctttattaattagttggtaattatagaatatatgaatatattcaaatttatattttgccttttggtatgaatatttcatcaggatttattttgtgttgctaccacatttttgtgttattttttgtttttttagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagtaagtattgttttcattcctacaaattatatgtgaaatgagaacaatttaaaaaatccaattctaagtttatatctacgatggaaaaaagaaaatttattttgatgaaagaaaagtaattccttccctctgtgtgtaaaagggctatcactgttgccttacaattaatgagggacatgtccagcaggctttcatcttccttgtcatttttttgttggataaatggtaaaacaaattgaacaggagctagtgactcccttctgtgaagtaacacaggagactggacagctagataaagtgaaggtagagttatatacgtctaaaaatagcccacattagttagatcagcttttgctgacaaagatgttagttgcaaactcacaaaaaagccttgcagttcagggctcttctggattttggaattgtaggtagaggattgtggcattgcactatttccattttatgaaagaacaatctaaagttcagaaagattgtggccaaaggttgcacaattagttgaagagtcaggggaggagtcttgctctgtcagattccaaagtccttattcattctgcaatagaaatcaagcgagcaaagagatcttcagggccatatgctgtgaagcggggaagaataatttggggcaagcatgctgaacaatttgtgttttatttcaggatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccttattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggatatgtcaattaaaatgcccatttgtgaagcttactcaataaaactttaaattgtcttatttagtctgattttctttaagtgacatttccactttaaggagtgggtgatatctacaatagaaaatattcactaagtaattcctggataagttttaagaaaggtcatcctgctgtctgaaaatgggaaaaggagttatttttgactttctagtaattctggaataatgtgggcctagtatgtagtgagagaagggaggaaatgatcatttttccgtctgcttgaattctctgagagtttctg

SEQ ID NO: 12869 - DNA, 152486 bp, Human
tccctcccacaacacgtgggagttcaagatgagatttgggtgaggacacagccaaactatatcaccttatttttaaaattagctattgtaatctattgaaaaatggcaggcagctatgactatttgttccttcccattgaacataatattagaaaagatcaagtgttgattatgatgttacctatttgtagaaaccaaggaatcaccatttatttttaaactaactgtacaaaaggttcagagtcaaagaatttctgggttggagggaaccagtattttaaaaatcttatgaacattctcagtacagagaactcaccaccttccaaactgactttccatccttagaaagttctgacagtaagaaatttatctcatattgatgttacttatccactaatcatgttgtatcatgcagggccataaaataaaaagatcactttcatattaaccttgagtcttcacttttccagacactacattaccattgttgtttatcatcacagagtgcttttaagtccatttatccccttttttgggccatctacctcctccaacccgcttttctaaatgttttgctcctaaacagtacatctttttgagaagtatgtgagttggatagtgtggtttacagcaagagcatgacttccctcactgtgcacacccaatttctactgattcaacctgaagacacatcacctgtttgtcagccacatcacgctgttgacttgtgttaagcttacatcatctaatacccataagtctttatttattaatgtgctaggaataagctatatatttttctatttcacattattatggttggcactttgggtggaagtactaggccttgcattttgtctccattaaattttatattgttaggctaaccctatttttcttgaaatatttgggaggattctatcattcaatgcttttactatccctgttgcattatctttagtatgattactcacttcctacatatcagtgatgacagatttgagagctcaaatcctttaatgggccactgaaacttctctctagatttaaattcaattctgtaaacatatattcagtatttactttataatggactgtacttagttcagtgatgaacaggatatggtggtagtctcaagcacatcatcactctacagtgggagaaagacatccagaaataaccatggtataaaatattaagtataataacaaagttgtgaacaaggaacacaaaggagaggccagtaattatctgggagaagtgaatgatgcataccaaaatgagggatatttgagccaagttttgaaagagaaggagatgtttgtgagaagtacaagaaaagagtctgattgccattcattaatcagcatttattcataggaaaatgaaatgttatcttcctgatagttcttccctgaagagacaagtggacaaaaaaaaatgagactctagaagggtgaataacataagccaatcaaaaataactcaggagtatgtagtggctagttgacaatgccactgcaatcacattatttcagaatggctgactacatttaaaatattttctagatcttgtgattcttgttttttttcccccctatgagagcagttaggaagctcttactaatgtttcttaaatttggagtttagggaccaagaataggaaattctgaaaaattgtttcctatcctatttacctgaatctgctttgtaagagactcctctatcttggaagcataacttctgtccaggttagatccatcaacagctaggttacagcagcttccagcttcttcaatcagtatttgggacctgggagtcacagtggactccacaccttggtagaaatttagaagtatgttgctgacaacaatggatttgtcccccagcctgccagccctgcccttgggatccattcatgcagctgtagtaaatagcattttccatgtagtatctctgcaaggacaatcaattcagcaacagactttctcctttaaaaaatgaaaaaaaaaaaaaagtaattaaaatcctctatcttctcacaacaaagacctgagaatataaaagtacttcttcatttattgggttatgctactgaccttttaagcggtgtcttagctctgaggatgatgagtgacttgggcattaaacaatctgaagacaccaaggtaattatgctgtgggccaagtcattcatttagttgagagtgttcctgccatttagcaatgagcctgcagcttttaaaagcaaggtcatttgacctgctgcctcagcataaaggtacatgaccttgtctgctgccaggcaggtaaatgcaagtattaaattgcctttacaatagagaggtttaagacttagctggctgttggaaacttagccgaatagttgctctgacttcaacaaagtcacctgctaaatctgtctaaatctccagggaagtcacgaataaaatgagggccctaaaaacataaaattttcaaaactacgtattttatatatataaaaaaactacatgcatataaaaatatttggggccaaatcaacatatcatttgaatatttttctatagtgtttacagactacagtatataaagtgttataatctttctgatatgtgtgtgtatcatatatgtatgtatatgtatatataaatataatatcaatatatagcaaaatcgtgctgatataatcaaaggtagatttagggattaataaagtcagataatatttattggaaaaataaagatttatccttattttatatagataaaagagatggtaatgttttgtcacctattaagtcagggaattcttcagctttttctagtttgtaacaaataaatcccagatctgaggggctacaatgagaagtagtctttcttctgtacaatacatcagggtttggttctgctgaagtcttttgggctctgctcagcttggcttagctccatgcatgttttcgttttggaacccaggctaaaggagcagcccctgtctaggacatgctgtcctgatacaaggatggcacaaaacggccctagctaagccacacagtcacgtttaggcttctgctcaaatgtggtaagtgaacatcgtgttccctcacatcccattagccaaagcctgtgccatagccaagcccaaagccagtggatgagtaagcaggatgaaggttgtatagttgtttgttcacatcctcaccctcctttctatcactttcttatcataagcctagggagtggtaaagagaacgttcttctgaatggaaagctctgggattatggtctgagcttgactttccctcctgcccaccacctcactacctaccaccctcaccccatcactcaaccgtggcaccaagtgcccttgcctctctgggaacctttctccaccctgaaggaggatagaatactctgagaagctggtattgctgtttttctgtctccagtgacctacttcaaggaaatacagggaaaagaatactaagaagccccatgccgtctgtcctttgtctgtggctgcccacttttcctacacagggcagcagtttgctgtccacactggaacccaaccactctctcttgaagggtttcccagtttatatgtgagtttctgagatctgtcagcctcctttttctttctgtggcttctctagggttgggtttggggaggaaacaagtagctagtgtaaactccttgtcaaactactttgtgaagctactttgagttgtataaccagttatttccacatcctaaggataaattgatccataatattggaaacttagcaacaaattttgaatggcacagaaggtataagaatataacagaaattttcttttcaacctgagctgtgaggctctaagacaccatatagcatttttctcagttttgtaattgatgtgctttaatgtttttgcaccgtgcaaattttcagaattatttccagaagcctgcaattcatgtttcttgaaaacgatatttaattatgctttgttatataaaatatattgtgataaatctctgattctcagaaaaagtgccatgtatgtgtaagtgcatacacacacttacgtatgtgatttcttccctccattcttagagtgtttgtcaattatttatgcccattgggaacagttctccccctcttcccacatgcctagaactatgactctccttacttccagatgggtaatctgatgcttttaattattacactagcattactttcactaagagtttatcatgaatcaatattttattgaagttaaaaaaatcctgatttagaaaacaaagtcatgaatgaccaactggggaataagagctgagtgatgaaatgcctggctaaagaaggaaaaggcgatgaagaccctttgctgaaaggtggtatttagcattaaagtaagatttcagaacccaaatggaacattttttcagatacatctcctttaaaccaaattgaggttgaggtgaagggaactaaaaaactcagcctggttctgagcaggttctgagtccagcagaaaactcatcttcagatgtgctgccgtggagcagcaggctcacttcctattttagctaaacacattcatccattgtggcatagaccagcctttggattctcagggattcttgtactgggcacattttttctgtagcaacattgtctcaaacatgataagacaaaactcagccacaaggagaaaactttggacagcagcattcatattgaattggacttggagtccagattaatagcataccttgtacaaaaaagtaaaaaccaggaaggaacaaaataatggcattcacagtgacctggatggaagtggagaccattattctaagtgaagtaacttgggaatggaaaaccaaacattgtatattctcacttataagtgggagctaagctatgaggatgcaaaggcataagaatgatacagtggactttggggtctgataggacggtgagggtgggaaggggtgagggataaaagactacaaattgagggtacagtgtgtactgcttgggtgatgggtgcaccaaaatctcagaagttaccactaaatatcttattcatgtaaccaaacaccacctgttcccccaaaacctatggaaataaaaaaacacaaataaaaaagtaaaaaccaggaggcttattagattaaatgaacatagaaatgtctgcttatattatagcaaatgctgcaaaagataaattgtgcaaaaagttatctttgtttttaaccaatactgtcttctcaatttgggtggctataataaaataccatagactgggtggcttacaaacaactgaaatttatttctcacagctctggaagctgtaagtccaagatcaagagcagacggagaaagccagctctcatgtgtcttttataaggggactaagcccattcatgtggcctccattttcatgacctaatatatcccaaaggccccacctcctaatatcgtcacgatggggttaagatttccacctaaaaattaggagaggggagtggtggcaaatattcagctggtagcaaatacctaattattaaaggtggtggctcattacttcttcatatggctagccagctatcccagcacctcttaatgaatagggagtcctttttccattgcttatttttgcctttttagtagaataatttattttctatttaagatatatcaaccttgttgaatatcagatggctgtaggtgtgcagttttatttctgggttctttattctgttccattgttatatatgtctatttttgtgccagtaccatgctgttttggttactatagccttacagtatagtttgaagttgggcaatataatgcttccagctttattctttttgcttaggattgcattggctcttcaggctctttttggttccatatgaattttagaatcattttttctggatctatgaaagatgtcattggtagctcctaggaataccattgaatctatagactgctttgggcagtatggccattttgatgatattgattcttccaatccatgagcatgaaatacttttccattttttaatgtcatctataatttctttcagcagtgttttgcagttctccttgtggagatctttcacctttttggttagatgtgttcctaggtattttaattttttgaagcaattcttgatttggctctcagcttgaatgttattgatgtatagaaatgctactgatttttgtacatggaatttgtatcctgaaactttactgaagtcatttatcagttccagaagtcttttggcagagtctttagggttttctaggtatggaatcatattgtctacaaagagagatagttcgacttcctttttcctgtttgaatgtcttttatttctttcttttgtctgtttgctctggctagtacttccagtactatattggagtggtgagaatgggcatccttttcttgttccagttctcaggggtaatgcttccagcttttgcctgttcaatatgatgttggctgtgtgtttgtcagagatggccctttttattttgaggtatgttcctttgatgcttctagttttttgagagtttttatcataaagcaatgttggattttatccaaagctttttctgtgtctattgagatgattagatggtttttgtttttaattctgtttatgtagtgaatcatatttattaatgcacatatgttaaatcaacccagtgtcccaggaataaagcccacttgattttggtgaattaattttttgatgacctgctgggtttgatttgctattattttgctgaggatttttgcatctatgtttatcagtaatatttggtctgtagttttcttttttcgttgtgtctttgccaggttttgatatcagggtgatggtgtctttatagaatgagttagggaggagtcccccctccttgatgttttggaatagtttcagtagaattggtaccagctgttctttgtatgtctggtaggatttgggtgtgaatcagtctggtctggggctttggttggtacattttttaattactaacttcaacttcagaacttgatattggtgtattcagggtttcagtttcttcctgatgcagtcttgggaggttgtgtgtttccagaaatgtatccatttcctctagatgttcttgtttgtgtgcatagaagtgttcataatagtctctgaggatttgttatatttctgtgggatcagttgtaatgtaactttttttgctactgattgtgcttatttggatcttctctctctttttctgtggtaatctagctagtgggctatcaattttgtttatgttttcaagaatccaacttttgggtttgttaggtttgcatggatttttgggtctcaactttgttcagttctgctctgattttagttatttcttttcctcttctagcttttgggttactttgttctcacttttttggttcctgtaggtgggatattagattgttaagttgatatctgcctttctgaggtaggcatttagcaccttaaactttcttcttagtgctggttttgctccattccacaaattttggtatgctgtgtctctgttttcatttatttcaaaaattttttttctttataccttaattttgttctttacccaaaagtcattcggagtaagttgtttaatttccatgcagttatatggttttgagagatcttcttggtgtttatttttatttttcctgtactgtggtccagagtatgggtggtatgatttagatttttttgaatttattgagacttgctttatggccaaacatgtggtcagtcttggagtatgtttcttgtccagctgagaatgatatatatcctgtggttggtggttggagtattctgtagatgtctattaggcctagtgggtcaaatgttgaatttaagcccagaatttcttcattagttttctgcctctattatctaatactgtcagtagggttttgaagtcccttactattatttatgtggctaagtcttttgtaggtctagaagtacttattttatgaatctgggtgctccaatgttgggtgcatatatatttaggatagttaagcttctagttgaattgaatgctttataattatgtgatgccatttttgcccttttttattcttatatgatataaggataatgacccccccccacctccgctctttgttttccttttgcatgatagatctttctttgaccctttcctttgatcctatctgtgtcattatgtgtgagatgggtctcttgaagacagcagactgatgtacttttttaaaaattcaacttgccactctgtgccttttaagtgaggtgtttagggcatttgcattctaggttaaggctgtgtgtggtggatcatgcctgtaatcccagcactttgggaggccaaggcaggagtataacttgaggtcaagagttcaagaccatcctgttcaacataacaagatcccatctctaccaaaaaaaaaaaaaggaaattacattcaagattaatattgatatgtgaggttttgatcctgttgtgaagttgttagctggttgctttgtagtttctattgtgtagctgctttatagggtctgtgggctgtgtacttaagtttatttttgtggtaacaggtatcattcattcttttgcttttatgtttagaactctctcaaagatcgcttgtaaggttggtctaatagtagtgaattcccttagtgcttgtttgtctggaaaaaatctatctctccttcacttatgaagcttagtttggtgggatatgaagttcttggttggaatttcttttctctaagaatgctaaaaataggctccccatctttcctggtttgtaaggtttctgctgagaagtccgctgttagctgatggggttctctttatacatgttctgacccttttttccagctggctttaagattttttctttagtgttgacctttgacagtctggtgactatatgccttcatgatgtttatcttgtatagtatctcacaggtgttgtctggatttctcgtatccagatatctacctctctagcaagattgaggaaatttttctgaattattcccttaaatatgttttctagattgttgactttccgtctctgcagaaatgccactaattcataggtttagtaactttacctaatcccatatttctaaaagactttgttcactttttaaaattaccttttttatttttgtctgactgtgttagttaaaaagactggtcttcacgcactgaaattctttcttctgcttggtctggtctattgatgaagctttcaattttatattgaaatttcttaaatgagtttttcaattatagaagttctggttttttttaagatatttatctcttcctacatttcctggattgcttaagaagtttcattgtgttgattttcaaccttgtcgtggatcttgttgagcttccttgcaaccatgcttttaattctttacgtgtcatttctgagtttccattttggttggggaccatagctggagagctagtgtaatcttttggtggtgtaactgcattcagatttgtcatagtgctggaattcttgcatttgttccttcccatctggaaatgctggcgtttctaatttttgtcattatttttgtgtggttggggttttttctttttctgtctttccctataatattattgttgttttctttctttccctttccctttcaccccctccctggaggatgtgattacagagaaggctgggtagtatattttggctttgcttctatagccctatgcacttctgctgacaggtcttatcttgggctgtgcagttcaacctcaagccagtagatggtgcctatgggtaggagctgtctgtggccaatgtggctgggtatagccttgcttaccgggagaagttctctgttgcctcaagcaatgggctggtttatggtgtgcacattggtctgagctccctgctcagccctggaaggggtgggacaggtggcaaatgggtggggttggactaggcaggctttacaggccctctgatggcatgcacgagcaccagcgccaaaggagaacccagtgggcagccaccacgtacccagaggtgtgcctagttttggagctgggaaacctcctaggcctcaaggtctctgcatggtggtggggagtggctgaaactcctaatccaggagagtgagtgttccagatggctggagatctgcctgggaatggaccgtagaggaccctactgcaccagaatctctgcacaaagaaggtggggtggctctagctgctaatccaggagaacaggtgctttgaatgcctggagatctgcctgagcatcgagtagagagggcccctgtgcaccaggatctctgcctagaatagtggggcagctcaggcttctgttctacatgagcaggtgctcaagattcttggatatctgcttgggcatagagagcacagagggtgcccctttagcaatatctcttcacaggaatggtggggtggttcaggctgccaatcctaggcaaacaggctctctgtatgcctggaggtctgcctgggcatgaaacagagaaggccccccttcaccaagatctctgcacatgagtgataggatgactcaggctgctgaccaggcaagcaggtgctccaaatgcttggagatttgcctgggcatgaagtgaagaggacccccctgtaccaggatctctgtataggaatggtacaatgggtcaggatgctaatccaggtaagtgagtgctctgaatgcctggagatctgcttggatgtgaagtggaaggaacctctttgaacttgtgtctgcacctttgcacaggaaaggtagggcagcttaggctgctgaactaggtgagcagaagctccaaatgcctggagatccacctgggcataaaatggagagacgcctgctgtaccaggatctctgcacaggaaggatgggctgactcaagctactagtctttgggagcaggtgctctgaatgcctggagatctgcctacatgtagagcagagagggcccctcataccatgatctatgcacaggaaggataggctggctccgactactgatccaggcaagggggtgctctgaattcctggagatctgcctaggcatggagtggagagggtccttctgcaccatgatctatatccatgaagggtggggtggctcagactgctggcgcaggcaagcagatgctccaaatgcctggatttctgcctggggatggagcagagaggaccctgccaccatgatctcaggggagcaggctgggacacccagcaatgacacgtgcagactggttccaggttgccaagctagccctggcttacaagtctcatcacccagatgagatgcagctgtagcggctctcctcccaccccgggcctgcaataggagaaagcacaattccagcacctcctgctgaggcactttccatagctctggttgcagaggccactacccaactccagagcaggcacttcagtctctgacctaagactattataaaatgcctaagtggccatgctgccaggtcactaaagaatggctgcctttgaatgtgcctggattaaaaatggtgtcctgttcttggttccaggcctcggaaaatgtctgcagcttttcccagcgtctttccctcatagcatttccaagcctttccccaagttacctccagggcttggagaaacataatgctgttccttaacctgggctgctcagatccccagtggaaaggtgagtcacagaggaggctctctgctcctctcatgtgctggggcttcacttatgtttatcagacagacactgtcacgagggctgtttgcccacgttttcctcctagagatctggggtgtccttcataaatctagtggattctcatttactttgtgaattaaagcttatctttatgcactgtcttaatgcagtatcttgctatttccaactggctgagacatgctttaacattcaccatcttggaaaacaatccttatacattttgaatagtaactccttatcagaggtatagtttgcagatattttctcctactctgtaggtagtctcttcattctgttgactgtttcctttgctttgcagaagttttttaaattcgatatcatttcatttttttgtttttgtttgtgttgcctgtgcttttgaggtcatatccaaaaaaataatcgcccaggccagtgtcacagagctttctccctaaattttcttctagtagtttcatagtttcaagtgttatgtttaagtctttaatgtattttgactggatgtttgtatatggtgagagataacaattttccacttttctgcctgtggaaatccagtttgcccaacaccatttattgaagagactgttcattccccgctgtgtgtttctggcacctttgtcaaaaattggttggccataaatgcatggatttatctctgggctttctattctgttccattggtttatctgtctgtttttatgccagtaccatgcagttttggttcctatagctttatagtagtacattttgaagtcaggtagtgtgatgcctccagctttgttattttttgctcaggattgctttaggtatttgggatctgttgtggtcacacacagatttctggtttgttttttctatttctttgaagaaggtcattggtattttgacagggattgtgttgaatctgtagactgcttttgggtaggatggacatgttaacaatattaattcttctaattcatgaatatgagatctttttccatttatttgtgtctttttcaatttctttcatcaatgttttacagtctttagtgtagagatatacatttaacctccttggttaaatttattcctaatatgtttttgtagttattgtaaaggggaatattttcttgatttatttttcagataattcactgttaatgtatagaaatgctactcatttttgtatgtgattttgtttcctgcaactttactaaattcatttattagatctaacagtttttttggtggagtcttcagacttttctatatacaagttcatgttgtcttcaaagagagacaatttagcttcttcctttcagatttggatgccttttatttcttcctcttttcctaattggtctggctcaaacttctagtactgtgttgaacagaagtgacaagagtggtcatctttgtcttgttccaggtctcagaagaaaagctctcaacttttcccgttcggtatgatgttagctgtgagtttgtcatatatggcctttattgtgttgaggtacattcctaattgttgagagttttcatcatgaaagcatattaagttttattaaatgctttttctgcatctactaaaattatcatatgggtcttatcctgcattctgttaatgtgatgtattacatttattgatttgcatatgttgaaccgttcttgcatccctgggatgaatcccacttgatcatgggataaagttactttttaaaattttcagagtggagagaataaagaatggagaacaaggactgaagagatgagaatcaggcacgtattatatttctcatcagcagcactgtacatgagaagacagtacacaatgatttcagatttctatggagaaaactattttgaacttagacttctatacccacccgaactattattcgtataagcaaaatcaagatattttctgacatttaaactttacaactttattgctcaagtaccccatataaaaaaaatctcaaggaggtaatcctaacaaaactaaattcagggaagaggatggaatacagtataaaacataagaaattgtagtagctgaatatgacctataaagcatgaagaaaagtgaaattagagaatttattgaatcttaatgcctacagcttttttctgttgagtggtaggggatttagtgatacgagatcacagtttcctttctttgagtctaaacatgcttcttatttttatagaaaataatatctaagtcatgataatacaataattctgtttattgccataaattttagaaccatcctgtggataaagtagagaagtcctaattataacttttgaaaaatatgtaaattgtataaatcttggcagtaaaagtaatgtgaaaaatcagtaactggaaaggatataaatgatagtgaaaatgcactgaagtttttaaattttatataacaggaactacctcaaattactaaatctagaaatacttacaaaacagatcatttaattaaatcatagtaaccaccagaagtaaaaaaataaaaaaagttagaagagtgaggtgaagggagggagaatttaacttttaaaaagccttattctaattaaaattaaagtctttctctttttgtgattataacattgcaaacagaaagtgcactgtatgtactttgcttggtcattagaaaactttaaatgcagaagccttctgagcctgtgaaagtcaatcactaaaattactacttttaaggcactaactcaaagggcaatccttggtaataagaatcagacaaagactctcaaaacaccagagtactcttcatagtgaagagagctggcgttggcaagagctaaaaaacaaagaaaagcaaattagatggatcaccagttttctttcatggcagacaaaagcccaaaactcttatctgactaataaggtcaactacctgaaaccaaagatactaaggaaataagagagtaattctaaagcaagagaaagaagcccttcaagggacctactatggagatagaatactaaatactctatgatctaacctttcaggaaatagaaatgaataaacagatttgtaacttggctcacctggtttgaaaaacaaagaaagttttcagaagttgtggtaaaaagccatcatttgtgacatttaattctacagtgaatggatcttaggcaagtatattacaaagtgttttgagactggccagagacaaattctaactaagctttttttttttcaattttctaaaagaaagttaaatgaaaaccaaaagaaaccctagtattaaatgcctactgaattgacagataaagatgtgtattgaatccacgtcatttcaaatctgcaaaatgtattttccatgtcagttatattagaaatgcatatttcacttcccctatcccaggatgatttggaaatatttagatcagaaaataagtcattgtgttaatacacaaaattaatactaccttcatacaactttaaatggattaattaatgtatttttcagctatataaaagcaaagagttgatgccaactagtgatttccaatagaaagagaacatgaggttgagtctggaataagcttcagtataggaccaaaataatgcgttagtaaggagaaatgggattggcagattcatacatcaaccatagtgaatgtcaccaaatatcttgtgtcagttgacttttaaatattaaccgagaaccaaaatgtcactcccctaggtacaaatcaaattgcttctcctttcttttgcctgcactcttaaatgctgaataacctcataagtaagatttctattaggcaaattagtgcatgcgtattaggaaccacagtttctggagtggagttcagtgggactaactatattccctatgattagtcactttaatcatagaattatgaggaaactcataaattatcaaatcatattctcaaagccttttttagcaatgcttaaccatgtgctctgtaagtatacatttgattttgttccctagagacaattgtttctgttttatgaagtgtgaaacattactcattggcaattatgagtaacttttatacttgttaagttttattgttgtgttaatgtaaacagaaacacttgtgtttgtttccatttgttcaatacacatttattaggcatctactttcgccagaagctgggagatacaaagatgaccatgagtcagttcctgccctctagcaattcaaaggagacataggtataaacttcaacagcaggaaaggcaagtggaatccttctgtgggggcagaagtagtctatctacccagcagccagcacaatgcatggtataacattggatgtgtaataaatcttgttcaaataaataaaataatcatgagaagatgtaccagaaatagtaatgccataaggaaaggaagacaaatggagttgaaccttgagctaagtcttgaaatatggagcaggtgagagaatttcagttgaagaaaagaatgtgtgtaaagtcctcaaagggtgaaatagcatgtgatttcagggaattaggataattccatttttctggaaagtatgtcagtggcaaagccatgggagatgaagatggggagatgggaagcagccacattaaaaagcacatgctggatcttctagcttcttaaagggtagcaccatgatcagatttatgtttagaaagatttctccatgagaaggacagattggtaaccaaaaggatagttagaagatcactaaaaaaatctagtgagcagtgacgagggtctaaactataaactaaagctgtagcagctgagaggatgaatttgggagagatttggaaagtagaaatcaaggtttgagggtaggggaagggaacagtgagacagaaacaggaatctgggatgatccttgtgttctgatgtgattagctggatgaaaaagaaggctgcttagtggaacacgatctgagaaggtgatacagggaaaatgagttcatagatgcctaggagacattcaggaagatttatttagtaagcagttagtgacctgaacctggaactcaagagctaggtccaggctggagattcagagctggtggtacccatgtctggtggtaactatgagcatgagtgagagagcccagtggagaatacagagtattagtgacccagattcattatttcccagtgcctactgcagtgtgtggtttggggatggaattgatatgacactcatcattgataatcattattggagctagaaaaaagggttgaaaaaatagtatggagaacattttggcattttcaaattaccattttttaagattcagaatgattttctattgagagacagttactcatggaataaaacatatgaatcaagaaccaagtaaattaaaagcaaagtaactgacttgtttttgttagaggaaatatatgttcatatgtctaaattaagaattgttcatagcaaataatgcttggtaagtttttgttggatttgtacatgtggaaatctaagatgtatttaataaatatggaaataataaaatagatttgtagttttatgagcacttagatgaaaagagaagcagagaaaaaagagaaaatgggaaatagagatagacacacacatactattaatatagaaacttataaaagacaaaataactgtaatccataattcaaccaccactgtcaaaatttcaacatatattctattattatgtctgtacatatttttgtatacttgttatgttggctatataaattcatatacttctttttttaacttgatatgataaacattttcccaagttattaaaaactcttcataaatatggtttttcatgacagcataaagatgcctatcacttttcagttacttagttacacattctctattgttcaacatttagattttagctttaaaaaactttaaataccactccattgagtatctttgtttataaggctttgtgttcatttcaaattattttcttgagatagatttctggaaatagaattaccatactaaaacatatgaacattttaaggctcctattgccaaattgtgttttagaaagatgatacaaatgtatacttccatcagctttatgtggcaatgcctggacacactaaataatacagcatgctataaagccttgtatttgggttcattgggaaattggtaattggcactaaccttgtattttattcagtgaattcactgattagctcaaattagtaaagatagacttattgtaaacaatgacaactatctccttttttatttaacttttatgcaaaataactttaaaatggaattcaaaacacacttccctatattttgcatggtttcacttggaaatacttctccagaaggaaagaaatgcttctctaactggtatggagggaaagagggattgctctttcctttttagtactattaagcaacaattgtctattttggaggaggtttatgacttctttcaaaaacaaagtatcccattttttccccagagcaaagctcttagaaggcaatagctaagagctatgttactaacatgattgttctaggaggagcactgctcagctcccatggcaacaggtaccatggaaatagacacactttgtcagaggtattgtaaatgctattgggtatgagggcagtagttgcagtgaaatttcattgttgctatgttgtagaggttgcacaacacaccaagccttatttagattctgttgataagtctgacctggtttttaagaagttctatttttttaaaaaagaaaaacaaaccccaacccccaacctgttagacctaagataaaatgagaacaatttgcaaggttcaaattgttctgtatggaagctctggaaaattatatgcaagtctgtatggaagctctggaaaattatgatatttcagagaactgtgaactttgaagtgtctgtggcaataagtgataggttgagtgtgaataacttaaatccagaagtcatccccagacttcatttgagctaaacagttcagcttcttctcataggtcaggtcactgttaatttttgcagtgacaatgattaacaatgaaattattaagagtgattactaatataacacctgttttgtactctgctgttttactgttcaaccctttttaataaccattaaaaggtacctatgactagtactataagcagattcatcccacagttggggaaattaaggcatagagaagaaataaagacctcatggtcttagctggagagaggtagagtctggattgagaaaagttagagctccagtctctagccttattttacaaacattgatacaatggtaaagatgaaacctaagtcaaagggtgtatgggttatcattggtggctctgtttgtttaatagataactcaatttagcagagagggctgtactattgtttcatttcagagcacctgtgcaacttctgatgcttaagagggaaattgagaatacttctctaattcatacccaagccaccctaacaattacacatgataatactcaatacaaaatgtcaagttagggattatcttggcctttttctagtagattcctacctgttcccagtcttttccagacactgtcatccctcacaatccaatctgtcactctgccaggagccaagaggattcagatgctatcccttgctttttgaaatcacagttgaactcaagaacccaacagagttagatactaagaccctgcacctgtatctatggtccttaaacttatatgtgcataagaattacctggatagcctgttaaaaatgtacattctcagcttcccattctgactaagtaagcctggggtgaggcccaggaagctgcatttttaaccaactcccccagtgcttctgaagcaggtggtctgtggtcacgctttgagaaacctgaagatcagcatgtcagtctgttaaagtctcttccacaccagtgagcctaaggacaatggggacagtggaggttgaggaaggggcagtagtgagaagggaggcctgtacctctgtgcctgggagcccagcaaggaaccttcagctcttgaggtcccaacatgtgctgtggcccacgctggacctcagtatgtgggaaaaagcaaccagctttcagaattcacaaaggatgaggcacaaggtagagaaacagggatgctgcaatctgcaatctgagtgcgctggcccctgagtcagtaagagttgtctgtagatacctaaatgtttaaatcaattttcttctctcagacagtggaatccagaacatatattaaaaagagaccacttccagcctgtaggaaaaatgaagttttgtagctcattgatggcttctttcttgctgttaggaaggccaagccagagaagctaaaatgattgagctaggccattttcgcattagcattcaacccttaaataaaactttggagaaaagaccccttttcacattccccacgcacccctaccaccactgcctaagctttggcagccttccaaatcctccagaccccagaacaggacttgtccctgggcttgttttccagggtttatatgacgcccttgttcccttcttggcaattcaagtgaaactcaccatctcaggccacagcgtggtagtcattgttgtaaatagctttgactatttatttttctaaaattcctagaatagcatttagatgccaagatcctgggagtgagaaaagaatgttatttttgtaagaaagactattttaggggactgttctaacattaagagacagaaatgggccatgtggtttgctaggaaatttccttgcaaagctaaaatccacattactgcctttcatgactggggtagttagtcactttctcactttattttaaatgaggtcatgattcctgagttattgtcacctttggaagctagaaggatgggtaagtgccaagtgctttgaatctactcaagagaaagccaacgtacaatggttttccatttacctgtagaaggcaggtccatatcatctttgaaaaaataattacgcctgttctttgcatctcccgcctcaggaccagaatttgtgtttgtttagtgatgaaaaatctccaatattaatattaatctttttgtttgttctgtttcctttgccatcatgctctgtccacttactgcagtatttgactccttgagatacatttcaaatcataaatctctcctcatggctccttaaaaaagtgaatctttctcgtgtccctactttcttgtgtccctacttactatttttattaccagattataaccatgatttcctcattgaccacagcagtggggtaccagcatccctggaaaaagatgtcttgaatatcctacaatgaatatcaaatggagagagcctctgcctgttcaaggctgaaaatctgagaaaaataaaactcacgttgctttttaaattcagagatgtgaccactgtgaatgtattgcatcaacataagtcaaatattggtacctatgggtatagaaggattcaaaggctggggtcctggaagaagagggtcagaaagcatcagaaggaggaagagcaagacttgcagacaaccctgaggtgggagccagctcccctcactcagaaagtgtgggctggtacacccgataggaatggagcagggcgcacatggagatttggggtgagctctcctttcctaagtagggtacactgacaatgatcaatctgttcccatcatctgaacttataatgccttcccagaaaacctctttgggctaccatcatacctcttagagaacaagcatatatctaagcctcatcacttttcaatgctgcggttatttctgatgtttcctggatttaagaagtagtggtttactattttttcagtgtttaagaatgaccttagaaacccgttaaagtgcatatgctagggcttcatccccagcaattctgatttgattgattggggatggatccagaaatttttatttttagtgagtatactgaattattttaaagaagatagttaggttagcagagctactctttgcttctttttacttccacctttcatgttgtcctgcctcctctttgatcaatacatactatgtttttgcatgtgccctttgccctcaaaagtcttttccaatcatcgattaggtaggtatcatctaagcttgggtttctcacataatttcgttaatgcttctttgcttcaaattttgacttacctttaaggccatataactactgatacttaattgaacctgttctctaattgccaccactgcagttacaaatgatgatgatgatattttcaaggttatttatttatatcacagaaaagaacagtagcacttgctatatacttagagctttctgaggatcagctatacacataagacactgactcattaatttttacagcttctgtgcaaaaactagctaaaattgctttccacttcaagttgaagacagttagtcataagtatacattccagcattaatttttttcctattaactttgatgcataaggtttatttatttaatggatgtttctggactgtctgccatatgtcagtcactatgctaggtattaatgatacaatgatgaacctcccctcatgaagcatccaggatagttgcagagcaaacaagaaaacaaagagaataatgaaagtatacagagtggtacctaacacagcattaaatggggagtgggggttatcagagagttgtcttggaggattgaaagttgagtaggactaaaggtttgaatggaggctgaatatgttgaccccagatcatgcccttaatagctggttgcatttaaaacagaattccagccattgtaagaatttattttcttgtgatttatatcttaaatataaaattcaagtgaaaatggataataaaaataatctggctgggatccctgggtgttggaattggatacccctgagtttcaatccaagctccaccacttatacatgatgtgactttagacaagttacttaacctctccaaatcttaggctcctcatctgtgaagtagaaataatgatttaataataatttattattaaattattataaaattgtattattaaattataaaatatattattattaaattatttatttttacaatttaattgtgagtgttaaatgaaagaacatattgaactagataattcagtatctagaacatagtaagtgctcaataaattatagcgccccccccccagtcctataggtctcaaataattaatttttctactttaactagtctcctgatccccaaattagcattccagcttcctactgagcattctgacttctgtctttatattccctggcctaaaagactctccacatgcagtccattttcccctttctctctttcctgccttcacccccatatgcacacatgatttgtgtgacttagtttattcatctgccaagacttagtttagacactatttattccaggaaaccttccctgaccctctttaccatatcttggttagccaccactcctctgtgcaccataactcactgagcttcctccatcatggtgcctttaacaccatttgataatgtgtgtgtgtttgtgtgtgtgtgtgtgtgtgtgtgtattcatctgcataccccactgggctgtattgttttcatgtgtgacttgcttgcccttttaagtccagcacctagaggagataggtgctggccccaatatgcattttcaacaagtatttttgaataaattgagatatcaatttcccctaattttaggtgaggagtgtacctgatacatatacactagcctcattatagtttgtatagataactttgtcttttaatctgtgccatttgcaattttgagatacttattaacttctctttgctacttcttcctttgccatttgcatctttcatttcagaattatacaatgtccaggttttttctttctacagtataaagctctgaactcctgattaatctttcaatatgttgaataacatacacacacatacgggcacacacgtacagcctttatgtttggtttctttctttgaatgccgtttgttaaatagttcctttggtagtaatccctctggctttaggtaaagccagttcaaagcatttttagagcctggcaatttgtagctctctttaaaatatcttttcatctctccaactccgtgcttcttaatctgtactagaaaccaagcatttgaaagaaactaatatcacctgcattgtggctgcttctttgcctttctgcctcccacttgttactgtagtttattcatctttatttttccagcatctagtccatgcctggagcactaggcatgctatcactgcttgttaaattagaatttggaaaactacctagtgcaaatatgtttcccactgctagtagaccacccatatcggtagctatctggcctagttagctgacatggccaataaggctgccatagaggtataactttgtctttaaagtatttattcatttctgtttctcttgtggacttccaatacatgtagaaaacagggacattgaaaactgaaacagttgggggaagattgaagggatgtgggtgtggttataaaaggttaacacaagaaatttttgtggcattgaaactgctcaatatctttattgtggtgataaaattgtaaataatagacactcacacaaataccatgaatacaagtaaaactagggatatatgaataagattgggggattgaatcaatatccatatcctagttataatattgtattacaattttgcaaaatgttactgatagcaacaggagacagacaaattctgtcagatagacagacagggacagtcctcagtgaaacctgaccttcaatccaaggacagtttaaagcctaaaaacagagctgccagttctcgatagagtccacgactggagcgaggacctctgtgcccatcttaccctcctctctctctgttggttccttctggatgatgccttttaaccagtcaaatggtgctttttccaaagaccacccatggaccaatcagcatgcatgcttccattctaagcccataaaaaccccagactcagtcctatgggggctacctgcctttgggcccctactcactgccgaagggtcccctctcgcagttgagagctttgcttctgttgctaaataaaattctttgccttactcactctctggtgtgtgcagatgttattcctcttggttgtgggacaaggacctggaactcacaaagctgtgggcagcaggaacaagacagctgtaacacacccgcatttgcctagctccagacacaaaaaagcaaagccactgggtaccactccctcccactcgccgagcaacaagagagaaaaagcttctgggcaccactccctccctctcacggaacacaaaagccacaacatttcttgggggctcagaccttgggactccccaagcaagagctgtaacacagtggctacagagatttccagctggggaagtagtaccaaagggatcctgtaacattaccattggaagaaagcgcacaaagtatacaagggctctcttagtattatacaagtatttcaataaaagttttcatttaaaaaatgaaagttgaaaaagagagaaacaggaaaccaatgtcataaagaaaaggggtaaattatttcactttgagcttcctagttaaccaaagaagtcaaggcaaaaaagaaatatcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaagaaatatcttgtattcattcattcaacaaatcactcattcaacaaataatgaatgcaataaataaccatcatctaataaaacatacaatctgcttgagaaagacagcaccttccttgatattaattttgaaatttgccatatgatgtgtcctttatgtggattattatgaaactcgaagcaccatagtaaaagcataataattatccttggaatttgagtgttttaaagtaacattttttgagatcctgcactggctttgttcaagctggagtaacatcatagcgctttacttgctattgtggaatggctttttatgttgaggtgcactgtctaatttcactttctgctgaatggacaccagctgctatttactgaccaccataattgctggctatttacatatgtgttgtgagcaagtgtctcatttttcctggtgacaaacctgagctcaaagaggtcaaatggcatctaaagtagtaaggctgataagtagcaaagccagggcactcttccctgcctgtagcttaaccagactagattcacatcctaaagccaagagagaaggcaaggctgattttagagactttcaacatttgtgcttcctactaattgtgtcctaatcactgtggcattaggttgtatagtgtccatttcaggaaagagaaaagcaggaactagatgtcagaaatataatatcaggctttcttgtttttgttttgtgggaagtagccaaagaccaaacaagacaaaagattaaacgtacaatatcgtctctctgcattgatttctgagcccaggtccagctctgtagagtggacatatgggggaagcttagagctgttccccgcctaagcattggccttttcaggttcaaaagctttagatcctttgtgtgccctggccccagcttctctggtacagacagtgggtggttgttagaaagtgtcagtaggtggtaaagtgtcctggtgctctgaagccaggcaaacctgggtctgaaacttgattctaccactgaggggctttgtgagggtagtcaagttacctaaggttgagtattagcagcccttccttgtaagtctgttgtgaggattaaataaaataatccatgtgaaacacttagtccagtgtctatcatttggtatatgttaatatgtgcgattgttggtatcactcattctttttagtgtggaatgtttttctctgctctttggtttgtatatgagttacaagtaatcttccttccatgttatctgacagttgcaaaagaagtaatgaggagaatttcttcaagaactctggatcgtgggcctatagctaataggggtttaaaataagaagaaagaatccttttccacaaatatggtaaaactataatttttttaaatgctcaaagagagaataggttgactcaacattttctcttttttttccacaagtatgactttttgatgtgtctttacaagacaaactgtctttaaaaaccttacataacaaccctccctcctccctatgtacacttccatatgtacccacacaaagactgggccagtttatgcatctgtagagtccactacttaaaaccaacaggatggagtgatggatggtcatagtggtatcagtgagggcactgctattaactacatgtggtagctcagattagaaagtcctgaaaggaatgttgtacatgtacacctttcccaatttactcatattttaatgggaattgctttcaaagatgtgttaataaccatgttgctgttatagaaggagtccaaggataccttctgaaatggctcaaaatacacatgcaaaaatatactagccatcatgacacctggatgtcatttaccttctttgggcataatgagttactatattaacacttatttagcctgttccagcatatttttcatcttcgagcaagtgaagagactgagaccagtatatgctatggaggtactgacacatatagttgaaggagattggttaaaacatgtgccgaattggtcaaacttcttttcacttcaagtttaacatcagatgtgagtttttctgaatatatttaggtccacgttgccatcttcaagactttttaaaaccatcttcacctaaagttagattacattaaaagaaaaataagaatatatttggagcagagctctaactttattttataccacaagagttctgattttgtggattcaggttgcgtcttgctgagaagaaatttcagtgctgcttcagcagcttcctgggctttcagattattatttttttaatttccttctatataagttaagagtggtttgcaaaattgcatttgtttgcaaaaatttactgctgggctataaatgtttaatgagatcattattttaaatctaattctggtccttgcttattaatgcacattctgcaaaggaaactttgagtggggaactttacactatctcactacactattgcactaggcactattgcaaaattcttagtatttcccttctatgatgatttattgagaatgtttctgttatgttgatgtactgggcaatttttgcaatagcaacccattcatttagttattctatttgtcgttgcacactttcaaagtgatcaatgatgaccttcaaataaaatattggaaaatgtctaactcattcatggtgagagaaatgagcaaaaaaatggagacagaagattttgttgctctggaacaaggagtctgcatgatgaaggggccagggaagaggtacaacagtgctactgaaccttagtgagtttaacagtagaaatgcttttggctgcaagtggcagaaaatccactcatcggcagtgtgaaccttaaggttattcactactcacttaataagaactttagagcaaggagatctcagagacataggtgacttgacagagctctagtgccagggcactagacttacagagtattcctcatcatcatctcctcatgatcataagatggctgcaacagttcttttttttattttttattttttatattatacttaaagttctagggtacatatgcacaacatgcaggtttgatacataggtatacatgccccatgttcatttgctgcatccatcaactcatcatttaaattagatatttctcctaatgctatccctcccccaggcccccatccccctgacaggccccggtgtatgatgttccctgccctgtgtccaagtgatctcattgttcaattcccatctatgagtgagaacatgcagtgtttgattttctgtccttgtgataatttgaagagaatgatgatttccaactccatccatgtccctgcaaagaacatgaacccatccttttttatggctgcatagtattccatggtgtatatgtgccacattttcttaatccagtctatcattgatggacatttgggttggttccaagtctttgctattgggaatattgctgcaataaacatatgtgtgcatatgactttgtagcagcatgatttataatcctttgggtatatacccagtaatgggattgctgggtcaaatggtaattctagttctagatccttgaggaatcgccacactgtcttccacagtggttgaactaatttacactcccaccaagagtgtaaaagggtgcctgttactccacatcctctccagcatctgttgtttcctgactttttaatgattgccattctaactggcatgagatggcatctcattgtggttctgatttgtatttctctgatcaccagtgacgatgagcattttttcatgtgtctactggctgcatagatgtcttcttttgagaagtgtctgttcatatcctttgcccactttttgatgggattgtttggtttttttcttgtaaatttgtttgaattctttgtagattctggatattagccctttgtcagatgggtagattgcaaaaattttctccgattctgtaggttgcctgtgcactgtgatggtagtttcttttgtcgtgcagaagctctttagtttaattagatcccatttgtcaattttggcttttgttgccattgcttttggtgttttaggcatgaagtccttgcccatgcctatgtcctgaatggtattgcctaggatttcttctagggtttttatggttttaggactaacatttcagtctttaatccatcttgaattaatttttgtataaggtgtaaggaagggatacagtttcagctttctacatgtggctagccagttttcccagcaccatttattaaatagggaatcctgtccccatttcttgtttttgtcaggtttgtcaaaatcagatggttgtagatgtgcggtgttatttctgaggcctctgttctgttccattggtctataaatctgttttggtaccagtaccatgctgtcttggttactgtagccttgtagtatagtttgaagtcaggtagcatgatgcctccagctttgttctttttctgtaggattcacttggcaatgtgggcccttttttggttccatatgaactttaaagtagttttttccaattctgtgaagaaaatcaatgttagcttgatggggatgacattgaatctataaattactttgggcagtatggccattttcatcatattgattcttcctatccatgagcatggaatattcttccatttgttcgtgtcctcttttatttcgttgagcagtggtttgtagttctccttgaagaggtccttcacatcccttgtaagctggattcctaggtattttattctctttgtagcaattgtgaatggctcatgatttggctctctgtttgtctgctaatggtgtagaggaatgcttgtgatttttgcccattgattttgtatcctgagactttgctgaagttacttatcaacttaaggagattttgggctgagacagtggggttttctaaatatacagtcatgtcatctgcaaacagggacaattcgacttcctcatttcctaattgaataccgtttatttatttctcttgcctgattgccctggccagaatttccaacactatgttgaataggagtggtgagagagctcatccttgtcttgtgccagttttcaaaggggatgcttcccgtttttgcccattcagtaagatattggctatgggtctgtcaaaaatatctcttattattttgaggtatgttccatcaatacctagttgattgagagtttttagcatgaaaggctgttgaattttgtcaaaggccttttctgcacctattgagataatcatgtggtttttgttgttggttctgtttatgtgatggattacatttattgatttgcatatgttgaaccagccttgcatcccagtgatgaagccgacttgatcgtggtggataagctttttgatatgctgctggatttggtttgccagtattttattgaggattttcacattgatgttcatcagggatattggtctaaaattctctttttttgttgtgtctttgccaggttttgttatcaggatgatgctagcctcataaaatgagttagggaggattccctctttttctattgatttgaatagtttcagaaggaatggtacctgctcctctttgtacctctggtagaattcagctgtgaatccgtatggtcctgggctttttttttttttttttttttttttggttggtcggctattaataactgcctcaatttcagaacttgatattggtctattcagagattcaagttcttcctggtttagtcttgggagggtgtatgtgtgcaggaatttatccatttcttctagattttctagtttatttgtgtagaggtgtttagtattctctgatgatagtctgtatttctgtgggattggtggtgatatcccctttatcattttttattgcatctatttgaatcttctctcttttcttctttattagtcttgctagcggtctatcaattttgttgatcttttgaaaaaaccatctcctggattcattgattttttttgaagggttttctgtgtctctatctctttcagctgtgctctgatcttagttattttttgtcttctgctagcttttgaatttgtttgctcttgcttctctagttcttttaattgtgatgttagagtgtcgattttagatctttcctgctttttcttgtggacatttagggttataaatttccctctacacactgctttaaatgtgtcccagagattctggtacattgtgtctttgttctcattggtttcaaagaacatctttatttctgccttcattttgttatttacccagtagtcattcaggagcaagttgttcagtttccatgtagttgtgtggttttgagtgagtttcttaatcctgagttgtaattgattgcactctggtctgagagacagtttgttgtgatttctgttcttttacatttgctgaggagtgcattacttccaattatgtggtcaattttagaataagtgtgatgtgatgctgagaataatgtatattctgttgatttggagtggagctttccgtagatgtctagtaggtctacttgttgcagagctgagttcaggtcctggatatccttgttaaccttctgtctggttgatctgtctaatattgacagtggggtgttaaagtctcccattattattgcgtgggcgtctaagtctctttgtaggtctctaaggacttgctttatgaatctgggtgctcctgtatttggtgcatatatatttaggatagttagctcttcttgttgcgttgatccctttaccattatataatggccttctttgtctcttttgatctttgttggtttaaagttgttttatcagagactaggattgcaacccctgcttttttttgctttccatttgcttggtaggtcttcctccatccctttattttaagcttatgtgtgtctttgcatgtgaaatgggtctcttgaatacagcacactgatgggtcttgactctttatccaatttgccagtctgtgtcttttaattggggcatttagcccatttacatttaaggttaatattgttatatgtgaatctgatcctctcactacgatgtttgctgattattttgcccgttaattgatgcagtttcttcatagcatcaatggtctttacaatttgggatgtttctgcagtggctggtaccggttgtttctttccatgtttaatgcttccttcaggagctcttgtaaggcaggcctggtggtgacaaaatctctcagcatttgcttgtctgtaaaggattttatttctccttcacttatgaagcttagtttggctggttatgaaattctgggttgaaaattcttttctttaagaatgttgaatattggcccccactgtcttttggcttgtagagtttctgccgagagatccgctgttagtctgctgggcttccctttgtgggtaacttgacctttctctctggctgcccttaacacattttccttcatttcaaccttggtgaacctgacataagcagacatttcaccaaagaggatatatagatgttaagtaagcatgagaaataacatcagagacaatgtaaactaaaaccacaaggagactaacaacattaacagaatggctaaagtcataagcagtggcaacactaaatgcggcaagaatgtggagatactggatcactcattcattgctggtgggaatataaagttgtacagccactttgcaaaaaagttggatagtttctataatgaaacatataattatcctgtgactcagtaattgcactctggcatttatcccagggaaataaaaacttacgcttgcacaaaaaaaaattatacacagatgttcacagcagttataatagtcagaagctttcttcagcaggtgaatgatgaaacaatacatggtacatccataacatggaatgttactcagaaaaaaataaataaaaaggaacaaactgttgatacatgcaggcctctgaagatgtcaaaacatcatatgatacagaaaatacaaaatatagttaatacacatgggcataggtttaaatattctatgttactgatttcttaattgagttatatttctcaagactctattaaataaaaaataatgttagttgcctcagatgcatttaattttatcatattgtggttattttgtgactttttttattatacttgaagtaatgggatacatatgcagaacatgcaagtttgttacataggtatatacgtgccatggtggtttgctgcacccatcaacccgtcatctacattaggtatttctcctaatgctatcacttccctttccccccaccacctgacaggccccgatatgtgatgttcccctccctgtgtccatgtgttctcatcgttcaactcccacttatgagtgagaacatgcagtgtttggttttctgttcctgtgttagtttgccgagaatgatggtttccagcttcatccatgtccctgcaaaggatatgaactcgtcctttgctgtggctacatagtattccatggtgtatatatgccacattttctttatccagcgtatcattgctgggcatttcggttggttccaagtctttgctattgtgaatagtgctgcaataaacatacgtgtgcatgtgtgtttagagtagaatgatttataatcctttgggtatatactcagtaatgagattgctgggtcaaatgatgtttctggttctagatccttgaggaatcgccacactatcttccacaatggctgaactaatttaaactcccactgacagtataatagcattcctatttctccacatcctctccagcatccagcattttaatgatcaccattctaactggcatgagatggtatctcattgtggttttgatttgcatgtctctaatgaccagtgatgctgagctttttttcatatgtttgttggctgcataaatgtcttctattgagaagtgtctgttcatatcctttgcccactttttgatggttttttttttcttgtaaatttgtttaagttccttgtagattctggatattagccctttatgagatggacagattgcaaaaattttctcctattctgtagattgcctgttcacactgatgatagtttcttttgctgtacagaagtctgtcagtttaattagatcccatttgtcaatttttgcttttgttgccattgcttttggtgttttagtcatgaagtctttgcccatgcctatgtcctgaatggtattgcctaggttttcttctagggtttttatggtttaggtcttatgtttaagtctttgcccaagcctatgtcctaggttttcttctagtgttttcatggttttaggtcttacatttaagtctttaatccatctcgagttatcttttgtataatgtataaggaaggagtccagtttcagttttctacatgtggctagccagttttcccagcaccatttattaaatagggaatcctttccccactgcttgttcttgtcaggtttgtcaaaatcagatggttgtagatgtgcggtgttatttctgagttctctgttctgttccattagtctatatatctgttttggtagcagtaccatgctgttttggttactgtagccttgtagtatagtttgaagtcaggtagcatgatgcctccagctttgttctttttacttaggattgtcttggctatatgggctctttttaggctctgtgtgaactttaaagtagttttttctaattcggtgaagaaagtcaatggtagcttgatgaggatagcattgaatccataaattactttgggcagtatggccatattcatgatattgattcttcctatccatgagcatggagtgtttttccatttgtatgtgtcctctcttatttcattgagcagtggtttgtagttctccttgaagaggtccttcacatcacttttaagttgtattcctaggtattttattgctctttgtagcaattgtgaatgggagttcactcatgatttggttctctgtttgtctattattggcatataagaatgcttgtgatttttaaagacctggaaccaaccgaaatgtccaacaatgatagactagattaagaaaatgtggcacatatactccatggaatactatgcagccataaaaaatgatgagttcatgtcctttgtagggacatggatgaagctggaaaccatcattctcagcaaactatcacaaggacaaaaaaacaaacaccgcatgttctcactcataggtgggaattgaacaatgagaacacttggacacaggaagggggacatcacacaccggggcctgttgtggggtggggggggggggggggggtagcattaggagatatacgtaatgtaaatgacgagttaatgggtgcagcacaccaacatggcacgtgtatacatatgtaacaaacctgcacattgtgcacatgtaccctagaacttaaagtataataaaaaaaaaagaaaaaagaaagctggatttcactccaaaatgtaaaaaataaaaaaataaaataaaaagaatgcttgtgatttttgcacattgattttgtatcctgagattttactgaagttgcttatcaagttgcttatcaacttaaggagattttgggctgagacagtggggttttctaaatatacaatcatgtcatctgcaaacagggacaatttgacttcctcttttcctaattgaatacgctttatttctttctcttgcctgattgccctggccagaacttccaacactatgttgaataggagtgctgagagagggcatccttgtcttgtgccagttttcaaagggaatgcttcgggattttgcccattcagtatgatattggttgtgggtttgtcataaatagcttattattttgaggtacgttccttcagtacctagtttattgagagtttttagcatgaatggggtgttgaattttatcgaaagccttttcttcatctattgaaataatcatgtggtttttgttgttggttctgtttatgtgatggattacatttattgatttgcatatgttgaaccagccttgcatcccagtgatgaagctgacttgatcatggtggataagctttttgatgtgctgctggatttggtttgccagtattttattgaggatttttgcattgatgttcatcagggatattggcctcaaattttccttttttgttgtgtctctgccaggttttgttatcaggatgatgctagcctcataaaatgagttagggaggattccctctttttctgttgtttggaatagtttcagaaggaatggtaccagctcctctttatacctcgaatagaattcggctgtgaatccttatggtcctgggcttttttttttttttttttttggttggtaggctattaattactgcctgaatttcacaacttgatattggtctgttcagggactcaacttctttctggtttagccttgggagggtgtatgtgtccaggaatttatccatttcttctagattttctcatttatttgtgtagaggtgtttatagtattctctgacagtagtttgtatttctgtgggatcagtggtgacctaccctttatcattttttattgtgtctatttgatttttctcttttttcttctttattagtctggctagcagtcttatctattttgtttatattttcaaaaaaaacagctcctggattctttggttttttgaagggtttttcatgtccctgtctccttcagttgtgctctgatcttagttatttcttgtcttctgctagcttttgaatttgtttgttcttgcttctctgtttcttttcattttgatgttagggtgtaaattttaggtctttcctggtttcttttttgggaatttagtgctataaatttccctctaaacattgctttagctgtgtccaagagattctggtacattgtgtctgtgttctcattggtttcaaataacttatttatttcttccttaatttcattatttacccagtagtcattcaggagcaagttgttcagtttccatgtagttgtgtggttttgagttccttaatcctgagttctaattgattgcaccatggtctgagagactgtttgttatgatttctgttcttttgcatttgctgaagagtgttttacttccaattacatggtcaattttagaataagtgcaatgtggtacagagaaaaatgtatattctgttgatttggggtggagagttctgtagatatctattaggtctgcttggtccagaactaagttcaagtcctgaatatccttgttaattttctgtgtcattgatctgtttgatattgacagtggggtgttaaagtctcccacaattattgtgtgggagtctaagtctctttgtaggtctctaagaacttgttttatgaatctgggtgctcttgtattgggtgcatatatatttaggatagtcagctcttcttgttgcattgatccatttaccattatgtaatggccttctttgtctcttttgatctttgttggtttaaagtctgttttatcagagactaggattgcaacccttgcttgttttgctttccatttgcttggtaaatattcctacatccctttattttaagcttatgtgtgtctttgcatgtgagatgagtctcctgaatacagcacagtgatgggtttcgactctttatccaatttgccagtctgtgtcttttaattggggcatttagcccatttacatttaaggttaatattgttatatgtgaatttgatcctgtcattatgatgttagctggttattttgcccattagttgatgcagtttcttcatagtgtcgatggtctttacaatttggtatgtttttgcagtggctggtactggtttttcctttccacatttagtgcttccttcaggagctgttgtcaggcaggcctggtggtgacaaaatgtctcagcatttgcttgtctgtaaagtattttatttcttcttcacttatgaagcttagtttggctggatatgaaattctgggttgaaaattcttttctttgagaatgttgcatattggtccccactctcttctggcttgtggggtttctgctgagagatccactgctagtctgatgggcttccctttctgggtaacccgacttttctctctggctgcccttaacattttctccttcatttcaaccttgatgaacctgacaattatgtgtcttggggttgctcttctcaagaattatctttgtggtgttctctgtggttcctgaatttgaatgttggcctgccttgctaggttgaggaagatctcctggataataccctgaagagtgttttccaacttggttccattctccctgtcactttcaggtacaccaatcaaatgtaggtttgatgttttcacatagtcccatatttcttagaggctttgttcattccttttcattctttttttttttctctaatcttgtcttcacactttatttcattcagttgatcttcaatctctgatatcctttcttccacttgatcagtttggctattgatacttgtgtatgcttcacgaagttctcttgctgtgtttttcagctccatcaggtcatttatgttcttctgtaaactggttattctagttaacaattcgtctaaccttttttcacggttcttagcttccttgcattgggttagaacatgcttctttagctcagaggattttgttatcacccaccttctgaagcctacttctgtcaatttgtcaaactcattgtctgtccagttttgttcctttgctggccaagagttgtgatcctttggaggagaagaggcattctggtttttggaattttcagccattttgtgctggtttttcctcatcttcgtggattcatctacctttggtctttgatgttggtgaccatcggatggagtttttgtgtggacgtcctttttgttgatgttgatgctatacttttctgtttgttagcttcccttctaacaggcccctctgctgcaagtctgctggaattttctggaggtccactccagaccctgtttgcctgggtatcaccagtggaggctgcagagcagcaaagattgctgcctgttccttcctctggaagcttcgtcccagaggggcacccaccagatgccagctggagctttcctgtatgaggtgtctgttgacccctgctggaggtgtctcccattcaggagacacaggggtcagggacccacttgagcaggcagtctgtcccttagcagagctggagcactgtgctctctttagagccagaaggcaggaacatttaagtctgctgaagctgctcccacagccaccccttctcccaggtgctctgttgcagggaactgggagttttatctataagcccctgactggggctgctgtctttctttcagagatgccatgcccagagaggagtaatctagagaggcagtccgtctacagtggctttgctaagctgcagtgggctctgcccattttgaacttccccgaggctcggctttgtttacactgtgagggggaaaccacatactcaagcctcagtaatggcggatgcccctccccccaccaacctgaagcgtcccaggtcgacttcagactgctgtgctcgcaatgagaatttcaagccaggaaatcttagcttgctgggctccttgggggtcagatctgctgagctaggccacttggctccctggcctcatccccctttccagggcagtgaatggttctgtctggctggtttcccatgtgccactggggtatgaaaaaaaactcctgcagctagctcggtgtctgcccaaatggctgtccagttttgtgcttgaaacccatggccctggtgctgtaggtacccgagggaatctcctggtctgcgggttgcaaagaccatgggaaaagtgtagtttctgggccagaatgcaccattcctcatggcacagtccctcatggcttcccttggctaggggagggagttccctgaccccttgcacttcctgggtgaggcaaggccccaccctgattctgctctctctccatgggctgcacccactgtctaaccagtcccagtgagatgagccaggtacctcagttggaaatgcagaaatcacccaccttctgtgttgatctcactgggagctgcagaccagagctgttcctattaggccatcttgccagccatacacccttttttgttttgttttgttttgttttgttgagacagagtctcactctttcacccaggctgcagtgcagtagcgcagtctcggctcactgcaacctcagcttcctgggttcaagtgattctcctgcctcggcttccccagtagctgtgattacaggcatgtgccaccatgcccagctaatttttgtatttttagtagagacagggtttcaccatgtaggccaggctggtctctaactcctgacctcaggtgattcacctgccttggcctcccaaagtgctgggattacaggtgtgagccaccgtgcctggcctgttttgtgactttttgtgcactgtttgatattcacaacctttcctttttccagctatttgtggattaggtattatatcttttggttttgttttttattttgctataagcatgaaatgtttcatatgtgcttgaaaaaaataaaagtggggatcatgctaatttcctgtgagtcatccacttgataggtggtaagacaagaaagagaaaatctagaactgctgtagaatgcagagatgtgcaaggagcagaagtctgaggaactgaattcctagtaagtttaaaaagtctgcaaatgcagtcatgcctgtgtttggtggaaatgtgaagactgcagaaaccacttcaagttatgtacttgggcagaccagcagggaacattctgagagatgtataggacaggaggaccaggaaagggacagcaataaattcaggttgccagggagttccagagaggaatcatggcccgagctaaggagttgtactgtgatcagaggctgagacagaggacaggctggcctagagggagggctaagaagcaatccaagtgaccatgtaaagctgccaattctagattgtcgattctgttccattaacctgtatgtatatgtgcccctgacaagagtccctggccaagatggcaagtgaagcttgactccggctcactctgttcaccaagccttgtgttgagatgcagcactgcagccacctggaggaggaatcttattccaatttttttcttccatatttctttttaattaacatacaatttatataccataaaacatacccttttaaaagttcagtagtttttagcatattcacaaagttatgcagttatgtgatttcaaaacattttcattaccccccaaagaaaccctgtaaccattagcagtcatttctcattccccccacctcccagctcctagtctgctttccatctttataaacttgccttgtcttgacatttcatataagtggaatcatacaacatgcaacctgtatatccagcttctttctcctagcataatgttttcaaggttcattcattcaaaatacttccttcctttttatggctgaaaaatattccattgtatggatatactccatttttttgtccattcattaactgatggatattttagttgttttcaatttgtgactgtcatgaacaatgcttctgtgaatgttcgtatccaagtttttgtgtgggtcttgaagattatgcctttgttttctttgaagaattttctagttttatgtcttatatttggtctttcatctattttgagttaatttttgtgtatggtgtaaggcagaggtccaaatttgttcttgttcatatccagtcgtcccaggactgttgttgaaaatacactgctgttgaaaatacagaaaattctctcccccactgaatggtcttggcacccttgttaaaaatcagttgaccatatatgtgatggtttaattctagactcttgattctgttccattgatctatatgtctggccttatgccactaccaccaccctgtcttgatcattgtagcatggtagtaaattttgaaaccaaggagtatgaggcctacaactttgtcctttttcaagattattttgtttattctgagtcccttgcatctctacatgaattttaggatcccgttgtcaatttctgaaaacaacacaaaacaaacaataaactaaatgacattttgacagggattgtttgaatctacagatttatttcaggaatactgccatgttaacaatgtcaaatctttcaatctatgaacaaaaaaagtcatttcatttaattaggtattctctaatttctttcaacagtatcttgtagttgtcagggtatgacttttgctcatcttttgttaaatttattcctaagtattttattccttcttatgctattgaaagtggaatcgttttcttaatttcattttttattgttcactgctagtgtatagatatacagttgagtattgtatattaactttgtattctgtaaactgctggatgtattacctctaaatcgttttgtgtggattccttagaagtttctacatacaatatcattttgtgtgcagatagagatagttttacttcttcattttcaatgtcaatggctttcatttctttttcttgtttcattgccctagctagaccctccacagtactgaacagaagttgtgagaatagacaatctttgtcttgttccagatattaggagaaaatcttccaatctttcaccattaaatatcataattgccatgagtgtttttggagattccctttatcaagttacagaagttttctactgttcttagtgtttaatactgttgttcttgttgtcgtttttaacatgaaagggcattggatttctcaattttttttctgcattgagataattgtatggtttttgtccttaattttattaatatgatatattacattcattgttttaccctggaacaaatcccacctaatcatgatgtatcctttttatatgttgctggcttcagtttgttagttttgttgaatattttggcatctatattcataagagatattgctctgtagtttttttttttttcataatgactttttctgattttagcatcagggaaatagtgaccttacagagtgagatgggatattttccctcctccttttttttttttttttcacagagacagagtctcgctctgtcacccaggctggagtgccgtggcacaatcttggctcactgccaacctcccctgcccgggttcaaacaattctcctgcctcagcctcctgagtagctggggctacaggcacgagccaccatgtctggcttgtttttttgtatttttagtagagacggggtttcgccacattggccaggctgttctcgaactcccgacctcaggtgatccacccgccttggcctcccaaagcactaggattacaggcatgagccactgcgtccagcccctcctcctcttctttgtggaagaatttgtgaagtactgctgttaattctttttaaacatttggcagaattcactagtgaaaccatctggaactgagtttttcttagtgggaagaatcacttgaaactgggaggtggaggttgcagtgagccgagattgtaccactgcagtgagccgatattgtgccactgcactccagcctgggtgacagagcgagattcatctctaaataaataaataaataaataaaatgttgttcaattcctctttccttgttataacaatattctgtttagttctatccattgttgaatgagggatattgaagttttcaactattattgttgaattatctatttctccctttaattctgtccatttttgtttttattttgggaacctattattctgggagtatgtatattaggggagtatatatataatttttgttttcttaatagattgctatctatatatgttataaattcaataatatagtcatatgactattgctttatatatatagttttattttattgcttatatttttattgcttatatttattgctttatatatatttttacatatagaatagtctcattcttaaataaataaaaaacagaaactacatattatgcagtctattacatacaccaaaatatttactatttctggaattctttgtttctatgaattttagcagctatctgggggaaatttcctttctacttgaaagattttctttagaattttttcgaaagtgagtctgctagcaatgaattatctttgtttatctggggatgtctttatttcaccttcagttttagataattttctggatataaaattcttggttgacagcatttgtctcagcatgcagaatgtcatggaacttctttctggtctccattgtttctaatgagaaatcagtcggtattagtattaataatctcctgcatgcaatgagtcatttttacttcctcctttccaaatttctgtcttttatttcaagtgttcgataaaggtgtgtctaggtgaggctctctttaaactacgtgaggtttgttgtgttcttatatctgttgactaatccatttttaaatagaatttgggacattttccaggattatgtcttaaattttttttctgtttctttctttctcctctctctttctggaactcctattatacctacattaatacccttgatattgtaccacaagtctctgtacttttttcgtttttctttaggcttttttctctttcagttcttcagattagattgtttttatttatctatctttgtttaataattctgtgtttttttaacttttattttagattcagggggtacatgtgcaggtttgctatatagctaagcttatcttacagattatttcatgagccaggtactaagcctagtacccaatagttattttttctgatcctctccctcctcccaccctcaagtaggccccagtgtcttttttgccctctttgtgtccatgtgttctcatcatttagctccaatttaaaagtaagaacatatggtatttggttttctgttcctgcatcagtttgctaagaataatggcctccagctccattcgtgatcctgcaaaagacatgagcttgttcatttttatggctacatagtatttgatgatgtatatgtaccatattttctttatccaatctgccattaatgggcatttaggttggttccatgtctttgtaattgtgaatagtgctgccgtgaacacagtgtgcatgtctcattatggtagaatgatttatattcctttgggtatatacctagtaatgagattgctgggtcaagtggtagttgtttttagctctttgaggaataactacactgccttccacaatggttgaactaatttacacttccaccaacagtgtataaatgttcccttttctctgcaacctcaccagcatctgctatttttttgaactttttaataatagtcattctgactggtgtgggatggtatctccctgtggttttgatttgtatttctctagtgatcagtgatgttgaggttttttttcatatgcttgttgactgtatctatgtcttcttttgagaagtatctgttcatgtcctttgcccacttttcaatggggttgttttgtaaatttgtttaagttccttataaatggtggatatgagacctttgatgcatagtttgcaaaatttttctccaattctgtaggttgtctgtttattgatagtttgttttgctgtgcagaaacaaatttaatttaaattaaattagatcccatttgtcaatttatcgtggttgcttttggtgatttcatcatgaaatctttgcccatacctatgttgggtttttttgggggggttgtttgtttgtttgtttgttttgagatggagtctctgtcacccaggctggagtacagtggtgcaatctcggctcactgaaatgcccacctcccaggttcaagcaattctcctgcctcgacctcccaagcagctgggattacaggtgcctgctaccatgctcagctaatttttgtatttttagtagagacagggttttgccatgttagccaggctgatctcgaactcctgacctcaggtgatccatccaactcggtcccaaagtgctgcaattacagaccccatgcctatgtcttgagtggtattgcctaggttgtcttccagggtttttatagttttgggttttacatttaagtctttaatccaccttgagttgatttttgtatatggtgtaagcaaggggtccagtttcagttttctgcatatggctagccagttattccagcactatttattgaatagggcatcctttccccattgcttgtttttgtcaagtttgtcagagatcagatggttgtaggtgtgtggccttatttctgagctctctgttctgttccattggctctatgtgtctgtttttgtaccaggaccatgcttttttcattattatagccccatagtatagtttgaagttgagtaacgtgacacctccagctttgtcctttttgcttgtgattgccttagcttttcaggttcttttttggttccatatgaattattaatgtaaaatagtttttttctagttttttagtagagacagggtttcgccatgttagccaggctggtctcaaactcatgacctcgggtgatccatccaactcagtcccaaagtactgggattacagaccccatgcctatgtcttgagtggtattgcctaggtgaaaaatgtcattggtagataggtttgaacctataaatttctttggccagtatggccattttaatgatattgagtcttcctattcatgagcatggaatgtttttccatttgtttgtgttatctctgacttctttgagcagtgttttgtaattttcattgtagagatcttacaatccctggttagctgtattcctgggtgttttattctttttgtggcaactgtgaatgggattgctttcctgatttggctctcagcttggctgttattggtgtacaggaattctagtgatttttatacattgattttgtatcctgagattttgctgaagttgtttatcagcttaaagagcttttgggctgagatgatgggattttctagataaagaatcatgtcatttgcaaacaaaaaatagtttgacttcctgtcttcctatttcaatgcattttattttattttttagttttactttaagttctgggatacatgtgctgaatgtgcaggtttgttacataggtatacatgtgccatggtggtttgctccacctatcaacccatcatctaggttttaagccctgcatgtattagatatttgtcctaatgctcttcctcttctttccctgcacatctgacaggccctggtgtgtgatgttcccctccctgtgtccatgtgttctcattgttcaactcctacttatgagtgagaacatgcagtgtttggttttctgtttctgtgttagtttgctgcagatgatggtttccagcttcatccaagtccctgcaaagggcatgacctcattcttttttatggctgcatagtattccatggtgtatatgtgccatattttctttatccagcctatcattgccaggcatttgggttggttccaagtctttgctattataaataatgctgcaataaacatacatgtgcatatgtctttatggtagaatgatttataatcctttgggtatatacccagtaatgggattgctggatctaatggtatttctggttctaaatccttgaggaattgccacactgtgttccacaatggttgaactaatttacactcccaccaacagtgtaaaagcattcctatttctccacatcctcaccagcatctgttgtttccagactttttaatactcaccattctcactggcatgagatggtatctcactgtggttttgatttgcatttctataatgaccagtgatgatgagctttttttcaaatgtttgttagccacataaatgtcttcttttgagaagtgtctgttcatatcctttgcccactttttgatggtttttttttataaatttgttttaagttccttgtagcttctggatattagacctttgttagatggatacattgcaaaaattttctcccattctgtaggttgcctgttcatgctgatgatagtttattttgctgtgaagaagcccttcagtttaattagatcccaattgtcaattttggcttttgttgccattgcttttggtgtttcagtcatgaagtctttgcccatgccagtgtccagaatgatattgcctaggttttcttctagggtttttatggttttaggtcttacttttaagtcttcaatccatcttgagttaacttttgtataaggtgtaaggaaggtgtccagtttcagttttctgcatatggctagccagttttcccaacaccatttattaaatagggcatcctttccccattgcttgtttttgtcaggtttgtcaaagatcagatggttgtaaatgtgtggcattatttctgaggcctctgttctgtttcgttggtctatatatctgttttggtaccagtaccatactgttttggttactctagccttgtcataagtaaaaagaacaaagctagtggcatcacactacctgaatgccatttatttctttctcttgcctgagtgctaaggccaggacatccaatactatgttgaataggggtggtgagagagggcatcctcgtcttatgccagttttcagggggaatgcttcctggttttgtccattctgtatgatgttggctgtggtttagtcatagatggctcttattattttgaggtatgttccttcaatacaaagtttattgagagtttttaacataaatgaatgttgaattttatcaaaagtttttctgcatctattgaactaataatgtgatttttgtctttagttctgtttatgtgatgaatcacatttgttgatttgcatatattgaaccaaccttgcatcccagggataaagccttcttgatcatggtggattaacttcttgatgtgctgctggattcagtttccaagtattttgttgaggatttttgcctcagtgttcatcaaggatatggggctgaagttttctttgttgtgtctctgccaggttttggtttcaggatgatgctggcctcacagaattagttggggaggagtcccttctcattttgttggaatagtttcagtaggaatggtaccagctcttctttctttattttaatggcagaatgcagctgtgaatccatctggtcctggactttttggttgatagactatttattactgattcaatttcaaagctcattattggtctggtcagggaagcaatttcttcctggttcagtcttgagaaggtatatgtgtccaggaatttatttatctcttctaggttttctaatttgtgtgcatgtgtgcatagaggtgttcataatagtctgtaatagttatttgtatttctgtggggtcaatggtaacatcccatttgtcatttctgattgtgtttatttggatctgtcttttcttctttattagtctaggtagtggactaccttattaatgtttttcaaaacaccaactcttggatttgcttattttttcatggcttttaatgtcttgatctccttcaattcagccctgattttggttatttcttgtcttctgctagctctggagttggtttgctcttgcttctctagttcttttagttgcagggttaggttatacatttgagatgattctaacttttgatattaagttggaatttagtgctataaatttccctcttaacactgccttagctgtgtcccagagattctggtatgttgtatctttgttctcattagtttcaaagaatttcttgatttcttccttaatttcattatttacccaaaagccattcaggagcaggttgtttaatttccatgtaactgcatgttttgagttttttgtagtcttgattttcactgctatccaagagtgaatttggtatgatttcagttcttttacatttgctgaaaattgttatataaccaactgtgtggttgactttacaatatgtgccatgtggtgatgagaagaatgtatagtctgttgttttggggtggagagttctgtggagatctatcagatccatttggtccagtgttgaatttgggtctgaaatatccttgttaattttctgccttgatcatctgtctagttctgtcagtaagtgttgaagtctcccactattattgtgttggagtctaagtctctttgcaggtctcttgagaacttgctttgtgaatctgggtgtccctgtgttgggtgcatacgtattaggagagttaggttttcttgttgaattgaaccctttaccattatgtaacgctcttgtcttttttgatttttgtttgtttaaagtctgtttgtctgagattgggattgcaacccctgcttttttctgttttccatttgcttggtagattttcctccatccctttattttgagcatatggatgtcactgcatgtgagatgggtctcttgaagacagcataccattgggccttgcttctttatccagcttgttactatatgctttttaaatggggcacagagtgacaagctggttaaagaagcaagaccccttcaagattattattgatatgtgtggatttgattctgtcattgtattgttatctgttttttatgccagcttgtttgtgtggttgctttatagtgtcactggcctctgtacttgtgtttttttttaattggctggtaatggtctttccatatttagtgcttcgttcaagatctcttgtaaagcagatctggtggtaatgatctccctcagcatttgcttatctgaaaaggatcttatttcttcttcactgaggaaggttagtttggctggatatgaaattcttggttgaagattttcttcattgagaatgttgaatataggcccccaatctcttcaggcttgtagggtttctgctgagaggtctgctgctagcctgatggggttccctttctctctagctgcttttaacattccttctttcattttgaccctggaaagtctgattgtgtatcttggtgatgatattcttatggagaatcttgcagaggttctctgtatttcctgaatttgactgttggcctctgtagtgaggttgggaaagttttcacagaagatatcctgaaatatgttttccaagttgtttgctttcccccaatccctttcagggatgccagtgatttatagtttgggcctctttatataatcccatatttctcagaggttttatttgttccttttcattattttttctttatctgtatatgactgtcgtgtttaaaagagccagtcttccaagttctgagatttcttcctcagtttggtctattttgctgttaattcttgtgactgcattgtgaaaatcttgcagtttgtttttcagctctatcagatgagttcttttatactggctattttatctgtcagcttcggtatcattttattttgattgttagttttctcggattggattttgccattctctggaacctcaatgatctttgttcctatcagtattctgaattttctttctgttattccagccaaccctggttaagaatccttgttgaagaactagtgtagtcatttggaggatataagacactctggtcatctgacttgtcagagttcttgtgttggttctttctcatctctgcatttaggtgttctcttaactgctgggctgcctctgattgaagcggtcaggcaggggcagagtggttgcactggagtcctgggcctggtaactctgcccagtgaagagaagtgaggaccaggacctgcgtggagaacagtatggacacttttccattaggtggatgctctgtgctgggggttcagaccagtgccgggtccccatggactctctagagcctggagacaagaagggtgagggctgtgagacagcaaagatggcaacccacccctcccactgggagctctgtcccagagagctgaagaactgctactggctcaatagctccagtggggaaaggctggagacccaggctgggagaacctgcccagtgaggagatacgggaacagggactcatgtaacaaacatatagaaaacatgtaacatgtagaaaacatgtaacatatagaaaacatgtaatatatagaaaacatgtaacaaacatatataaaagtctggccacttttccattgggctgctggaatatgcaggaggtctgctccagtttctaatcacctcagattttccagcacctgaaggtatcaacaatcaaggctgcaaaacagcaaagatggcagtgtgtcactccctctgggagctccatcccagggaggtatggatctgttgccagcttgaacatactggcgagggtagttgtaaatcttggtcaggagattctgcccagtgaggagaaatagggtccaggacccataaggaaaggcagtctagctgcagcttcacagagctgctttgctgtgctggggaactgccccagtccctagttgccttggactctctagagccctatggcaagaagagctaaggctgtgaaacagcaaagatggtggcctgtcctccccctgggagctccattccagggaggcttggaaccactgccagctggaaaacactggcaagggcggctggtgaccccagtcaggagatcctgccccatgagaagcaaggccagggacccatggaaagagaagcagtctggccacttttctgtagggtggctgtactgaaggcaacgacagccaaggctgtgaaacaccaaagatgacagcctgcccctccctctgggagctccatctcagggaggtataatgccaccatcggtggctagctagacttccaaaccagtgggtctcgtcctgtgaggtaccatggaaacagggtctgcagactgtcactgctcagtcccctggattcagcccctttcctcggggtatgtatgggggtctaacctcccactttgtcagttacagctgcttttgccaggaagcccgggtatctaaagctcccggggctccacgtgtgcctgagcagctgctctgccaagactccacatagctctacatgtcataccacaggccctgatggagtgggttcaatgaggtgatctcttgacctgagggttgtaaagagacctgggagaagcatgggtcttagggtcactcactcactcaccgattcccaggtaggggaggctcccctggctccatgttgctcctgggtaagtgatcatcctgccttgcctttctccattctttgtggattgagttgttttcttgatgaatcctaatacatgtacctggatgtttcagttgaaggtgctgtatttattcgccccttctattgctctccataagagcaacacacaccagttgcttctagttgcccatctttaaaacttagagagttattgtacttttatctccagaatttcctgttagctcccttttagagtttctgtgtctttatcagtacttcctatttgttgaatcattatcatcctatttttcacaaagtctttaaatgtagtttctttttattctttgaacatattcatagtagctgctttgaagtttttgtctgctaaatcaatatctagacctagtcatagtaagtttttattttttttttcttgagtatggatcattcttttgtttctgtatgtctagtaattttttgttgaaaattgaacatttggttaatataatgtgacaactttagattctgacattttaactgagagttattgttattgttttgattttttgtttgtttttagtaacttttctgacttaatctgactgatctatcttttccatggtatatagctgctgatatctctgctcagttttgtttttattgtgtatcctgtcttactaagcatcccccttttgtctgcatagttcagcagacggctaatgatagtagtgctcaaatgtctcaagttcacaaagtttcagccttcaactagtagatctgtctgaggcatgcattaaaagttcaggaggccaggtgtggtggcccacgcctgtaatcctagcactttgggaggccaacgcggatgggtcatgaggtcaggagtccgagaccagcctgaccaagatggtgaaaccccatctctactaaaaatacaaaaattagccaggcatggtggcaggcacctgtaatcccagctactcaggaggctgaggcaggagagttgcttgaacacctcagcctcccaaatagctaggactacaggtgcacagcaccatgcctgaattttttttttattttttgtagagacagggtctccctaagttacccaggctgatctcaaacttcttgtctcaagcagtcttcccactttggcctcccaaagtgctgggattacaggaatgatccaccatccttggccttgtgttctttcttttttcttagactagccagaggcttattggcctaaaacaatcacatttcaaatgccatctatgagatcactgaaaccagaggtaggcctagcctaactaaaactgcaacccaccataactcagcttaatttctgatgggaatttatcaattcctcagttgctacttactagaggcaggagcaacttttctgaaggaaaatagcatcaactgtcagtctttgtgattctttaatacacaaagcccatcatgctataagatattattagacatataacaggcaaaaacatgagaccaacaatcaagcaaaaaaggagatgatagaagcagacccatagatgatccagatattggatatggctgataaagacttcaaaataactattataaatatgtgaaagaaaattgataaaaaagatgaagaatttcaacagagacatggaaactatttaaaaaagtaaaattactagaactgaaaggtaaaatttctgaaattatgacttaattgactatgtttaataagactttgaacacagaagacagaattagtaaactcaaagatagctcaatatcaaatatccgaagtggcagataaagagaataaaaatataaaaagaaaagagtagagtataaaaaacttgtgaaacattttcagaaggtctagcatatgaaaaattgctttcatagaagaggagaaaagaaaatgggtcggaaggaatatttgaagaaatatatatgagacattattcaaaattgataaaaggcatcaatccacagatttaagaagctcagtaaacccaaaaggaataataaaactgtcataatcaagctgcatcaaaccaaagctaaagagaaaatcttaaaaacagtcataacagttactttctaagaagcaacaaaaagactaattactgacctttcaactgaaattattaagtctagatgttggtggaatgaaatatttaaattgctgaaagaaaaaaactgccaaattaaacctctgcccaatgaaactatcattcaaaaatgaaaataagataaagttattctcaaagaaaagttaatataaatacttgccatgacctgagataaaaggaatggtaaagaaaattctttggactgaaacaaaaggatctcagatggaaggaatggtatgaatggtatgacaggaagagatgaaaaacactggaaaggataaatatgtgagtaaatgtgaaagattattaatttttttacaacaaaaaactgttatataatttggtgtttatagcaccaatgatatataaaagccctagcacaaaaggagacagagactaagggagtttgatgttgtaagaaacttgtattgtacaagaatttgtaaacttgctaatttaagattggcttcaacatattaaggatgaacattgtaatttctagaataatcactaaaatgttcaaaaagaggcctggcatggtggctcatgcctgtaatcccagcactttgggaggccaaggcgggtggatcacctgaggtcgggagttcaagactagcctgaccaacatggtaaaaccctgtttctactaaaaatacaaaaaattagctgtgtgtggtagtatgcacctgtaatcccagctattcaggaggctgaggaaggagaattgcttgaacccaggaggcagaggttgcagtgagctgagatcgcaccactgcactccagcctgggtgacagagtgaaactctgtctcaaaaacaaacaaataaataaataaataaaatgtccaaaaagataaaactataagctattagaagaaatgatttataaaaatatacttgattaatttcaaagaaggcaagaaaagaagaacaggccaggtatggtagctcatacctgtaatcctaacacttgggaggccaaggtgggtggatgtcccaaacccaggagttcaagaccagcctgggtaacatggcaaaactccatctctacaaaaaataccccccccaaaaaaattagccacgtgcggtggcacatgcctgtagtccctagctgctttagaggctgaggtgggaggatcacctgagcccaggtcaaggctgcagtgagccatgattgcaccactgcacttcagtgtgggcaacagggcaagaccctgtctcagaaggaaaggaaggaaagtgaaaataagctttcatttgaagaagttagtaaaacaatagtgaattaaagcaaaagaaaagaaataattgaaaataaaaacaaagaaacaaaatggaatgaaatagaaagcagatatacaatagataaaaagaaaaaagtaaaaattttattctttaaaatgaattcataatattgaaaaatcttcaagatgatcaagaaataaagagaaaataaaatttaacaatatcagaaatgaaagaagggacatggctatggcacctccattttgttaaaaaacataagatgatgttataaaaaatttatgccaagaaactgacaacatatttaaaatggacaaagtcaggccaggcacggtggctcacgcctgtaatcccagcactttgggaggccgaggcaggcagatcatgaggtcaagagatcgagaccatcctggccaagatggtgaaaccccatctctactaaaaatacaaaaatcagctgtgcgtggtagtgcacacctgtagtcccagctactcaagaggctgaggcaggagaatcgcttgaacctgggaggtggaggcttcagtgagctgagatcacgccactgcactccagcctggtgacagagcaagactccatctcaaaaaataaataaataaattaattaattaaataaaatggacaaattcatttggaaataaaaaccaacattgacataagcagaaatttaaaaatggaattagaataatcctaacatctattaaagaaatctataattacaaactgttttacaaagaaaagtcccagcccagatgggcttggtggtgaattcttccaaatattccaatatgaaataataccatcttacataaactctttcagcaaatacaggagggagtaacattttctaacttgctttgtgaggccagtataaacctaatacaaaaatctaagctatcacaagatgtacaagcatattgcaagaaaagaaaattgaaggacaatatttcttcaatatggatacaaaaattctacacaaaatattagcatattgaatccaaattgaatagtgatatattaaaatgatgtcacatagaagccatgtgaggttattctagaaatgcaaagtttaacattcaaaatttgatgcatgtaatttttatattaaaaaaataaaaaaatccatgtggtcatctcaatagctttagaaaaagtatttgataaaattcaatatctgttcataacaaaaactctcagaaaactgggaaacaaaggacactttattaatctgataaaggacagctaaaaactcacagccaacatcatacttcatagtaaaaattttgagcacagttttcccttacttcaggagtaagacaaagaataatctgttaccacttctactcatcattatactggaggtcatagccagtgcagtaggacaaggtaaaagagataaaagtacaaagattggaacggaaaaaataaacccatttttattcacagaagatatgattacaagcatacctcattttattgtactttgcagatactgctttttttaaaacacaaattgaaggtttgtggcaaacctgcattgagtaagtttattagcaccatcttttcaacagcatctgcttacttcatgtctctgtaacattttgctgattcttatactattttaaactcttttctagttatgacaactgttatggtgatctgtgatcagtgatcttgatattactgttgtaattattttggggtgccacaaactgcacctatagaagatggctaacttaatcaataaatgttgtgtgtgttctgactgctcaaccaactggccattctctagtctctcttcctcttctcacgtctctttattccctcagacactgcagtatttcggttaggccaatgaataaccctacagtggcttctaagtgttcgagtgaaaggaagagtcatacatctctcactttaaatcaaacgctagaaatgattaatcttagtaaacaaagcatgttgaaagctaagataggccaaaagcaaggccaaacagttatccaagttgtaaatgcaaaggaagaattcttgaaggaaatgaaaagtactatttcagtgaacacatgattgataagaaagcaaaacagcctcattgctgatatggagaaagtttcagtggtctggttagaagaccaaaccaaccctaacattcccttaagccaaagcctaatccagaccaaggccctcactctttaattttatgaaggctgagagaggtgaggaagctgcaggagaaaagttggaagctagcagaggttggttcatgagagttaaggaaagaagccttctccatgacataaaaaatgccaggggaagcagcaagtgctaatggagaagctacagcaagttattccaaagatcattgatgaaggtgactacattgcagctggtgactttaagttgaagacaatgttaatttactattcagaacattctagggcccttaagaattatgttaaatctactctactctgtctatgctcaataaatttaacatcaaagcctggataacaggacatctgtttacagcatagtttactgaatattttaagataactgttgagaactactgtttaggaaaaaatacatattcctttcaaaatattactgctcattgaccatgaacctggtcacctaagagctctaatagaaatgtgcaaggaaatgaatgttttcttgcctgctaacacaacatccattctgcagcccatggatcaaacagtaattttgaccttcaagtcttatatttaaaatacattttgtggctgggcgcagtggctcatgcctgtaatcccagcattttgggagactgaagggggcggatcacctgagatcaggagttcgaggccagcctggccaacatggtgaaaccctgtctctactaaaaataccaaaattagctgggcgtggtggcaggtgcttgtagtcccagcaacttgggaggctgaggcaggagaatcacttgaacccaggaggcggaagttgcagtgagccgagatcgcgccactgcactccagcctgggagacgagtgaaactccatctcgggaaaaaaaaaattgtaagtctatagctgccatattaaatgctctggaaagggttcaccattctaaatgtcattaagaacatttgtgattcatgggaggaggtcatcctccataacaagagtttggaaaatgttgattccaatttttttttttttttttgagacggagtctccctctgttgccaggctggagtgcagtggcacgatcttggctcactgcaacctctgcctcccaggttcaagcgattctcctgccacagcctcctgagtagctgggactacaggcacgcaccaccacacccagctaatttttgtatttttagtagagatggggtttcaccatgttggccaggatggtctcgatctcttgacttcgtgagccgcctgcctcagcctcccaaagtgctgggattacaggcgtaagccaccgtgcctggctgattccaatctttatggatgactttcaggggtccaagacttcagtggaggaagtaagtgcagatatggtgaaaataacaaaagaaccagaattagaagtagagcccaaagatatgactgaattggtgcaatatcaggatcaaacttgaatggatgaggagttgcttcttatggatgaccaaagaaagtggtttcttgagatggaatttactcctggtgaagatgctgtgaacactgttgaaatgacaacaaaagatttagaatattacataaacttagttgatagagagtggcagagtttgagaggattgactccaattttaaaagaacttctactgtgggtaaggtgctctcgaacaacattgtgtgctacagaaaaatctttaataaaaggaagaatcaatcaatgtggcaaactttactgctgtcttactttcaaaaattgctgcaaccactccaatcttcaataaccatgaccctggtcagcagctatcaacatcgaggcaagaccctccaccagcaaaaagattattatgaattactgaaggctcagaagattattagcattttatcaataaaatatttttaaatcaaggcatgtgaattttttgtaatcataatgctattgcacaattaatagactacagtatagtgtaaacattacttttatgtgcacttggaaaccccaaaaatcatgtgactcactttattgcaatattcacttcattgtagtggtctcaaacagaacccacaatatctctaaggtatgcctctatgtgcataaaaatttttaaagaatcttcaaacggaattaataagtaaatttagcaaggtcactatataatactctattaacctagtgtgttaggctgttcttttgttactataaaggaatacctgagactgggttatttataaagaaaaaaggtttaattggctcacggatctgcgggctgtacaagtatgccacgaacatctgctcagtgtctggcgagggcctcgggaagcttacaatcatggcagaaggtgaagtgggagcaggcacatcacatggcgagagtggagcaagggagcagagggcaagaggggtggtcccagactcttaaacaaccacacctcatatgaactgagtgaaaacccacttatcaccaaggggatggtgctaaaccatgagggatccacctccatgatccaatcacctcccaccaggccccacctccaacattgggaatcatatttcaacatgagatttggaggggaaaaatatccaaaccacatcactcggtatagcattttccatttctactttaaactttcctatttcaactatgtatttagattttcttttgtaggcatcctctggctagatttttttcatccaatctgatagtttccatctttccagctggtacaagttagatatatttagatgtatttccaataatgtaagtcctcaatgtcataggttcttggaaactataactttaagtgaaaagatgtacagcaggttcttcaataatgtcatttcatgcaaggtagattcattattaacactgatgagaaaaaaaatattcattctcttatatgtctttttctttaaagttgcagtttccaagaacctatcaacgatgttaagtgaggacttatgacacttcattttgtgctttccatttaccagttctttgtattttcttattttcccctttcctaatttctattgtttgattaattctctagtttatgcaatttatttatttagaagttatatattctaattattttcttttccgctgacaaatatttaatacacaaatatgagttgccaaagtctacagctggtacttctattttcctcctaaacaatgaaaggactgtagaatgcttttactcttcccactcccttccaccttatgttctgtttttgtctcctgttttaattttacctttcttttataaatcctcaagctggcctttaataatttttatgtccagcatttttttcatgcaattcatttctaaggttcaatttttttcttcctaaagtgtcacctttggtagatttttcttcagggtctgcaattagtaaattttctcattgattacatatttgaaaaggtctgttagtcttgctgggtatagaattcaagatgatgattacattcgtttgctactttgaagatgttattttctcaaactattagattctggttctattaaagactgctgttggtctaacagtttctctgaggtaatctgcctttgatttatgcttgcttttaagattttctccttgtctgcgatgccttacatgttcactataatgtgggtcggggtattgatttattacttgtcttgctaagggctgattgactgtcataaccctagaatttatcatttctggaaaactgcaaatttggataaattattcaagttcccgtgttagtccacttctcaaaacccttcagtgtctccctcatttactgccagtattactactcaggactggcatgatctagcccctgcacatttctgtaattaagtttcccattaattccatttctgtctgccaggaaatccccatgactcaaactggtgatgctatttcttgttcataactcagctcaactttacctaccctctaaagcctttcctgaaacctgttcttctccctagccactctctgtttgtgtacccactctttcctgctcataggtctgttagttattgcatttatctatttatgtgtaaaattttccccctctggactcgagttcccagtgggcagctccctttgtatttatggagacaggtccttagtatgggctctataaatatttgtagatcaaatgaataaatgaatcaagaaataagggtaaacactaactcatagggatcttgtaacaactaaatgtataccacatgaagaagcacctggcaaataacatgtgctaatctattgtttgaaactccatattcatgcattattctgctacagtgggttatgtgccaaactggttgccttttaaaatttccttattccatatggcatagagttctcagtgttctttgatcataatgaagtatatttttggttctgtgccttttattccaattgctatatttctcagaacaagaaaaaaatgaagatgcttatatagtgtaccaattattacattctgtcatgaaaacgcagtgcatctgtgaatgttcttctcccatatatcttaatggcattctcctgctcctttaggtgtctgctccgggcctttgctgaccctccttataaaatagcaaattttcacctcacctccactctgtcctcttttatgtgctttatttttcccatacacttgtctacaaatgaatattatatatttacctttttggttattatttgcccacacataaacaccagcgtataaagtaggaactctgctttatgcctagaacagtgtccagcacacagcaggtactcaataaatatttgttgaataaatgtatcaatgcagatgccactgattcccatcagtaaaattctggtgccagaggagacagacacaataaagccactctgggaatgctagccttcaatattaatcttgacctgggatgagattacaaaacttgactattttgcttttcctgagaacagactgcctaatgcatgatttaatcctgaaaagtaaagaaatcacttcctctcctggcaagcaccttaaccaagttctaagctggctgcagataaagcccgtctgttctctactggtttaaagatagtggcagttcctgcctacttttagcaagctttattttgctttctgttttctttcaccacttaaggaaaatttacatatcttctctacccattttatcgttttgatcttggcaagagctttcaattaatactgtgtgagcagttgtgcaaagaaagcacccatttacgatgtttatgggaaataaattcttattatttcataatgacaaacacctaaagcttccatttatttgtattataattatgagaggtccagagatgataaatgacttgctgaaggccatgtagctaacttttacaatacaggtgattcctagttttccgtgaataagttcatttatgtttctcttaccacctacacattaagctaaagcccgccaatttttacttcactagtgtgaatctgtctgtgaaatagccatcttacttcctcaaccttcaactatcaaactgttagagtggatttttgtgtgccatccaacatctctctccacacttagtatgaatgaaaataatgtgatctttcagccaagctgacattccaaggtcagcttttagacggggtctcactatgtcacccaggctggagtgcagtggtgcgatcacaactcactgcagcctcgatctccctgggttcaagtgatcttcccacttcagcctcccaagtagctaggagtacaggtgcatgccaccatgcccggaaaaaattttttttttgtattttttttagagatggggtttcaccatgttgcccaggctggtcttgagctcctggctcaagtgatccactcacctcggccttccaaaatgctaggattacaggagtgaaccaccgcgcctggccccaaggtcaactttatggtcaatgaaaacgcctggcccagaaagtctgacctaatgtatcctccactttaaagagagcttgcttctccctgttccttattgggaacattgtgtattcaccatacacactatacagactgtcagattggcagtacacgctgtttcccgtaatgtggtggacacaatactcatcagtaaaggtacctgctggcaccttctggacttagggaatgataactggggctatcattggactggcagtgcctcctagtggccacagctctaaagatctccctccaactgaaaagcagccagggcagcaaaagcccaccaggcaacccctgccttaccctctcctttcttctcagtcttgtcctcatatcatgcagtgagaagtcggtgctgatcaggctatcatcatataccagtcttttcagtatttaactgacagaattcccaaaaatgacgtggcaatgaaaaaaattgggaggagggaggaaaggtagggaatacaaatagaaaaaataatcaagaataaccttagagtaggtcattgtgaaaagtgctttgtaataatgtggtcattgttgttccttcccatcagccctgtgggagctctgacaccccattaagctttatcaagaataatttcagatatgttacaaagatacgcagagaggcccagctggtttctccacaagcttgtattctgaaaagaatacacatgatcccaaagatcgtattttaaagtgtatatgcttcattaaaatgaaagatgataaatcatgtctacaagcataaccttgagattactgtccttaggcccatgctggtgtggggtatgcaaatgtagattttgatctgggaaagaacacctctggcaactgtagaagaatcgggaaggctccacttctctatgaaaaagaccctgtaatggataaggccatgccacaagatgaagtggaaagtttgttcctgctccctctgaactcttctgtatgctcccgtggtctccagggcattctctgtcctcatgcagtgtcttgtctcctctagggaccccttccaacagtaccttcttttccagacaatgcccacattccagtcctttctctttcctatttctaccttttcttcatcaaaatacatttatcccatccattctttcagggtcttgatgtatgttctgataaagtagtttatggtaagatttaaaaagcaggtcaccacccattgttctgttccttccttagacatttgcattttaactgtggactcctgacatccttaactacctgggcttggaagccaaaagtcttatctcccaaatacacaccacccacctccattgccccccagtggtcaatcccaaagatgacactgttgagacagaatgccctttgcttccctgagttctgtttgaacgtccccacaaatgacacccttggattgtcactgcattgaccaatgactccacgtaccagagtccaagggctttggtctggggtctacaggcaccgcattctgacatggattccttcaacccacaaacagagaggggtaacccaagaaatacacaagccctctgggacagagcagtaggctttctctccagtgattgttgcttgccaacaaaggttttggatatctgtggaatattccaaaaggagagaatctggcaattcttcagaagattctgggcaattaaaattcatcgagttcagatttttaagagttagagggagaagtgaaaggtaaacggtggcaacaattagggaacattatgctgcaagcctgacatttatgatgccgttgacttggtcttgtccagcaggtttcttgggtttctcagaaatttctagaatatgcacctcgcatattctgggagtcaagaactcccaggaacagcccaagtcctcctcctctcacccccaccgtcagccctttttcccctcctcccaaacctcccacccactgtccgcgtcagcgccttcgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcagggtattctctttatttcagtagtgcatgcctgaggcgcacgggaaacccgggacctggactcgtccattgtgcatcatttcacctgtgggacctgtgcatgctttataccccagagctttgtgttggggggtagtaaacctcttatttcaagaatcaaaatggatggtgcttggttgttgtttttttctttttttttttaaccccacccccacccctttgttttcttgttgtaatgctggtattttaaataatgcatcaatcgcctcctccgggagttcttttgggatctgtgcatcattcagtacttgtttaatgttttctcatccccggagttaaagtgctttcttattgttccatgcatcccagtgcatttatttctgcccaaaggttgaaatctcctggcagaaccattaactgagagggctggagtgcatccttttaagagggacacacccatttcagggttgttatttgtggtcacacaaaggagagtggagatgcagactagctctcgaaatcctgaaaatatgatggcgtagccacatattaggatggttcactttgaaatatttggggtttttttctgtcattggagtaacctgtgactactatttattaataataggtatctgtgaaataaatggagggaaagaacgaaacagtgcccgtggcccttggtataacagatttattttggaatagtccatattagcactgggtgtggctaccctccagcctcgcttggattgcttttcagccatttttattcagcctcacacttcacacatccatctctcctttgttacattaaaattcaccttgcagttacagagtatgaggagaaagataatttgcaagaatgaattgtgtgtagtaacttgggtgtttgtcggaggtagtgtcttttcatatttaacaaagatggttctgaagaaggcgcgtttaatttaacctgcagggttttgcagcatccctcaggagaccaagaatactctggagcagcagctgattttgtaaaaacctggcatcttccccttgtaattctatatcacaggaaggataggatgtccttttatctttaatgcctctgtagggttttgcttcggtatatattttaagaaaaagtaaacataaatctcagaattaaaagcctgcttaccttgcctcttgtttgttggattgggtggcaatgacataaaatacagtcgtctacttcaaattatgtgagtgttggaaataccgttgtcaaaagtaaatcgatggagctgataaatttaaaagccagtaaataagaaatgtatgccagttgaggcacaatgttttgaagaatgatgacaattacgtggaagaacatatgttcaatatagaaggcagctgtgaaaatattttgtaacattttattcttgttctgtgtttagatccatccagtttatttgatatacacacctgacaaacaactatggcttggtataagatcaaatttagttggacataaacactggattttagaccatgattatgagtttctagtatttttaacaaaagtagatatccaaagatggcaggttttcttttctatttgtataagatattcacaaaatcttatgaattaaatatcttaatctatttcatcacaatcttatgcggtttgactcggttgcctcagtttatgtctccgaggttttaaaaaaacacatggacttttatcattagaaattaacacaaaatgtcatagtttcgccattgaagacaataatttttcatttctgatgcagagctacttgtgaagattaattgaagatcattgagaatcttttatactcagcgacctttggtcatctttagtaccattgatttccttttgttagatggaacaaatccattatcttgaaaattgactaataagtaactgggtgggaggacttatgagcacaaaagagaaattgtaaggagtgaattattccttttttttctcctcactgtgagaacttttaaccttaacagaatctacattgaggttttgttgttgttgttgtttagcatttttagtgtatcctcttccctttagttcccttattatcaaaaacagttgtgcttaaccctgtctgcccattagaatcacctgggaagctttaaaaaccacgaaggatgcctgggccccaccttttgagattctgattcaattgagctgagcatcagtattttttgaaaagctccctaggtgagtttaatatgtaaccagggttgaagtcactggaatattattattattttgtagagacgttgtctcactatgttgcccaggctggtatcaaactcctggcctcaagcaatcctcctgcctcagcctcccaaagtgttgggattacaggcttgagtcaccatgcccggcatggtgtgtaataattcttagtgagccaaacccatagaccagcagaggtccaggataccaatttaaaaaaaaaaaatgggtgtgatctagaagcagctgtgaatgcagtggaaaaaggtcagtgcaacactgttgatgatgtcctccagaaggattaggagggacaagttttgcttggaaaggaaataatgtgagctttaggttttcttcatgttattaaatactacatggagaaattgcagcagattgaatatttcatgaagactccactgaaactaattatagtgtgccataaacactgtagtgcacatgcagaaggaaccttatcaacatatataatttcagctacagacaagaatgtttaaagaaagggaggctaaagtcctccttatatatactacatcacaccaattctgcttctaattttaaaaagttatactaccaccaaatattggttaataaatcaaagcacattctactcagtgaaaacaaaatgagaattaaatgacaacctagcaaaacacctgtatagataacaatcttacagatcagtaccatcctacaatttacaggactctttactgagtggtttgtttgaattactacatttagtccccacaaaacctgtgtggtgtaagttttattattgtcctcattttggaggggatgactgaggctttggtaagggcacacagatagtaatgccagaggctggctgcaagcctgggctgtctccagagaccctcacttcccactgctccaccttctgccgctgaggttgatggctttttcctcaatgatttttctaaaggtttaaattatctatgtaatggtgattgtgtaggcttaataaccccttcacatttacaagtcttcattttgccagacgtcttctcatttgagcttttcagtttactcttggacattatgaggctcagaagttaactgacttgcccaaggttttttggtagcagattgtgtagtaaaaggtgattctcttggcttcaaatccataactcctcccatctcagcactcactgcctatcttactaacactaagttagagaaagtgaactctcatctacctcatctgagatattttcacagacattctaacctttacaaatacaacaaaatttagcagcaaggccatgatcttgaccaatttataccatggttgtcactgtcatcaccaccatcatcaattcatcattctaaattctccgtaaatattagctacgtgccaggtgctgtcctaagttcttgttacatacctgctttaattaagcctccgtgagactttttttattactctcatgttataaaggaggtaactaagggatttaagaatgagaggggcagcagtttgccccaggacgtaactgggttctgaacacagaacattatgatcatgaagcctattcttttaacacttcgactgtactacccaaatccgaatggtgttgtactaggggaacaaagtttgattagaaccatgcatccacatgattctgtttgttctctaaagatcattttttctccccagatctcactgtactcaacaaattcacctggcaggatgcttagtagtatggttgattgatacatgtgtgcctggggctagaggtcacctcccactttactctgcgtggcagcattttgtagttacagattgccagaatgtaagttattgatggaagatgaaacactttccagagagcataacctaaaggcaatctttttttataaaatattttgaaacttttatgctggtctacagtgttcgtggaaacacttcaggatagtctgttctgaaaggagctagtctgaaacattaaagagctaagcattccagaatacaccgaggaaataatctgttttagccacagtaattgaaaaaaagcatgcctttgggaatagtatttgggaaagacattttacacatatacataaaggcagactaatatcaccttttatgaaaatcagcattttatttagacccattattattaaagtattatacaaatattacaatgtaaatattaacaattgcagactccctggctctaaagattctaatgggatccaatgggaaaactgccttagctggggagaaggggattttttttcccccttagtgaaagaaaactcgtattatgcagataatataccaaatgtaggtaatcaatcactccattgaaaaataaagttctttttcaaaatgtattaacattttcaagaaaaactttttaaggaaatatttcgaactttgggaggggaataatggctttatttttttctaaaaatgaggaaggcacattatgaacattttcatttgtacaaagagaagttcaaataaaagccactaattacccaaaatcctaccacccagagttaatcgttgttaagatttgctgaatattatctagatattgcataaaaatgaaactaaagggctaggtaggcaacaaaaacagtgttgataaaataagattgaatatgttacaaaaagtatttaaaataatttaacggaagaagtggacatgaaactgaaagaattgtggaacgtcagatccatgtttctttactatatgagcttttctttcctggaaattgagaaaaagactagataaacatcaaaaggtttgaatcatttttagttacatgttgcagttttagaccctacagagggacactctgcagtgtccaacattttttttaaagattcattgtgggttagaaaggttgacgaaatactgatctaaatttacatcttcaaatctattattgttctcagatttctgtgaatacttgtttcattaaaaaacgataatcctaatattctatgacaaaaatattatgattactatatatcaatagggattgtggatgacatcgtccattatagttaccaggcccttccttcttcatcatttttaaaaagtctctctttccctccttccctccctcccttatatttgaaatgataatctgtacacagttatttctcatctttagaccagttaatatgttctggaacagaatgtgaagtaattggtatattttaagttaccttataatagaattaaattataaaatccattgaatccaagaaaaccagatctattatgagttgggccttcagtggttagctttcagaataacacttttctttttgaaaataattaaatgtttgtcacaggcaaatttctcatcctcctaagttgtgtgcatgtttgcacccatgtattgttgatatactgtcacctttctagttcttatgaaagtacaggccaggcacagttggctcacgcctgtaatcccagcactttgggaggctgaggtaggtggaccacctgaggtcaggagttcgagaccagcctgggcaacacagtgaaacttcatctctactaaaaatacaaaaactagtcaggcgtggtggcacacgcctgtagtcctaactactcgggaggctgaggcaggagaattgcttgaacccagggggcagaggttgcagtgagctgagatcacgccattgcactccagcctgggcaacagagcaagacgccgtctcaaaaaaaaaaaaaagaaaagaaaatacagccattcaaagaaatatggctgccttataattaagctcataatttgaaagctaggaatttgacattaatgattctttaaaagccatcttctgcctaggtgacagttaataatgctaactactttaaatcttgataattaaaattatattccaaacttacagcatatatttcaaataagaaaactgttaggagttttacaacttaaaagtatagtgttctatttttccaaagtatgtttgagctatatctttaagttcaagctgagcaaagttatcttattgtttcatgaaataaaattctaaattcttccttattttatatgttgccaaaggaaaaaacataatctcagcattactcttgagctctttgacaaagctggtgttaatgttgaacaaatgaaaagcacaactataagttttaatttttagaaagtattgcagttctacacattttacaaagaaaatgctttaaatgtggtcatattttatcccctttcttcagaaatatttcaccaaactgcagattggcaaatttcaaatttggtgataattggcatcaagaagaacataatattttattgaatggaacagaggtacaatgagaaatcaatccttttgtctttttagttcaagaaatatttttgctgttatcatcttggcccaaattttaaacgtattcattttttttaaaaaggaaccaacagctgtctacctcctggttcttttctattccactacaatgatgggttttaagaagggatgacacaatcttaagattttgtggctaattatggttgatgaccaatagaccaaatgaacagtttgtattttgatgaggtcaaaaagcttaaagaaatagtacatgaagacaaccattcttgagtatctcaaaattatttcttcatgcctcaactatcacatttccaaagcccgtcttttcctccctgtgaccatctcttcctttgatcccggttatcctgtgaagatccctccaagtgagccttggctttacaagaggtctaggaggaggaggagcttgcccaactgtctgaaattcacaggacctgttgtttcacttcctgggcaggcccaccccaccatggtgaccaagggcttacacatcattatgttaacttgacagcttggaaagaatgggaatgttctagtcctagtggttagacctagcaaacaggaatcacattcatttctaaccaaggaaaatgttaagccctccataaggataaagtagtttttgccttcagtccagcccgaggaggagtcattcgggaatagtataattccttttgtctctcgtggaagaaaagcagcagaaattgctgttggctgtggctttgacactgaaatccttcattttcctttgttccaccaaagctcatttaaagtggtggattaaatgctatgctcttttactatctatagaaagcaccaggcttaatgtgtctttcctttcaaaacatccacagaattatttaagagtctagaaatagtgttggcatttttctcttgacagtcatataggttgtagttaggaggtgtgagggaagggctggaaaatgaaatcaaaggtgtcttatcagcagaagtccgtgccagcagttttccctctgggctcagggctcctagattaccatgtgaaccttcaactgatgtgggatactatcttggtaaatgaaactcatgactagaagatgtcatctttgaaggtctctatgtttacatctacttctgttttctttctccagtttaatgtcaaacgagggaagattaaagtaggaaaaattacttctattttttcttgttaacattttgtggtgatattttgtttccttcatgaaaatcagtcagaaaaaaactggctcttaatcacctctttggacactgggttggaaacaactgaggtttgtctagccttcttactctgtccacaaagtagtcaattattgtagttaaatcattggaagcttgctaaaaagtaaataaatttcaacagcatatcatttttcaacagtccttttgttgaaatgctgatattatcaatgaacaggaacttgtcacattttctcacttggcatttacttatttatttatttagagatggagtgttgctccgttgcccaggctggagtgcagcggctcgatcttggctcactgcaacctctacctcctgggttcaagtgattctcctgcctcagcctcccaagtagctgggatcacaggcgtgtgccactatgcccagctgattttctttttgtatttttagtagacacagggtttcaccatgttggccaggctggtctcaaactcttgacctcagatgatccgcccgcctcagcctcccagagtgctggggttacaggtgtgagccactgggcctggcctcacttggccttttaaaaagtagcattaatttgtcacatagcaagtggtgtagtgctgcctgaagtattttctgggccaagatggaataaaattacacagttaagaatatggtaccataatgcagataattatgcacaatttattgctattttatattatccgcttatatcacattttaccttataaataaaatataaatagctgcactacttgtcttttcagttcatacatttttaataaactttctgaatactgtggccactgttgggccatttgaatgcatttaaagtatttttaccaaaacaaaaatttggactacagcaaaggactttctttctagaaatttgacataggatttaatttccacttagctattaattcaaaccttggatcacttctcttattcttcttttgttattgattggattctagaaataaggggagcactggtttgatgttagaattcttcaaatctgccacttcacttttggccaaatttattctaagacagtcctaggcaggctgcagtgtgtgtgctcatagctgtggtttgaggactatggtgatcaccaagcccagttcctttatcaaattgataggacacactgatctctcatttcaaagccaatgtgtttctcctcagtttttagcaaagtagctttaatttttacaactggcaaagcaatatagtaatatgcctatcctagtaagtattcttagttaatgtatactcagatgttgaaactctcgcctggcttttctgcattaggaggatattaaaagagaaaagctgatcatattttgttataccagaagaccactgggggtaattaattccagtaacagggttacttatatttttcttacttgggttctaaggaaactttattcaaatacctacttttctggattgggtagtataaagcttcctacgcaagttgataccactctaagcaaaattaaaatgtgaaaaattggcatttacacagcagatttggaatgcagaaattctcttctctgatcccatcacctcctacccttcccactgaatcatcagaacttcaggccatttcctggcactctgaccacacatggccattgccactctcccagcctatcagtcaccagccatctagactgtccgtcattcccagcctgaaccccagggttgttcatttcaattctgtcctcttggaccttagagtcttctgatcatgctccttgtgcctcttcacagccctggaccagccccaccacccattgatcagaacattcagcatctaattctattgaatggatccccaagaaacccttgactttaaccaagccctcttcactttttggcagtccatttattcattcctttttgaagccttattgtatgtttctataccagcactgtttaatagaaatataatataagccacaaatataaattttctaatagccacattaaaaagtaagaagaaataggtaaaattcgttttgattatatattgtattaatagatcaaaagtattagcctttcaaaatatcaatacaaaaagaattaatgagatattttacatccttctttgtactaagtctaagatccagtatgtagttgacactacaggacatctcatttgggactagccccgtttcacacacccagtagccttatgtgactcattgctactgtattggacaatgcaggccttgacttttcctaccctcttcaagccccgcccttaatctacttagtctcaggaacctcttgactcattttccagggaaaattcaagttaatttccctcattatgttattttaccactttaggttatttccgttccacctcaacacgtatctgtggccacaactgtaacttcccaaaatgtccttccatctttacctatctcttttctccctccttctttgaaaacaactgtgattaatcccattttttccttccttagtggagactttgcttcatcaagtctgttttccaaaatcttcacccctcccttccctctaacattcctaggttttgctcaacctaaaggtttacttgttgctactactccccaaactaccatcttctttattactttgaacttccccccacccagccccttacgataaggcttccgtccccactactcatagcagtgccccctgcaaagttatgaatgaccttcctttcagtctccaaatccagtggtcctttctacatttccatttccttgttatgtctacagcattccacactgtagcttaccccttccttctgagaaatgtccttctccttggctgccataacctgcactattgtggtgccctttctagcaggtggacctctcttttctctggacccacttattcctttcaatcccaaaggatggtttcatcctagactgcatcccttagcctaccctccattggagatttcctccactctcatggctgcagtcatcgtttccacatagaatacacccaaaagtaaatgttcagccccctgtactaaattttagccctgcacttccaatggcctactgtacatattcatctgaatatcattggatatatgatattaaggaccatgttaactgagggctactgtgacagagcctaaagagcaagtcatttaacttctaagcttttaaaacacttagtaatgtgtgcaattgtcagcctcatttcatctctgatctcatctctgccccaggctgtgtcagaatgccctgcttagatgtcatcatgtcagaatctggagatttaaagacaagtgtcagcttttccccaaaccagttcaccctcagatttcctgtttttggcagtgatactaattactcagtcacccagctttgaaatgctgttttcacccttaattagctcttcctcgtttctcccacagttagtcaccattcttgtcaactaatcctttgtaatatttccttttatccaccccatctccttaacaaattgtccgccacactcacataccatcccacatcctctttctttgtcaattctagtactatctcttccttaaactcaacttttgccacctacaacagtacaagatgtgttggcatcgagacaacatttgtcaaaagattgttcaatattcccagctagacctaaaattccttaaaagcaggatccaaattttatgatttcttcattcctgtgcttacttagataataggtgatcaataactgtttactattgaaatgactttttactcaaagaaatttctctttaaatatctagttctaaaagcagttttaaatataatcagatttccctaaactaattttacataacttttggggacacttaacatgtaatgtgagagaggcaactattttgttttggaagaagcatcagatttagggtttgatcctgattctcctattaactagccaagatacaagtgtaactgcccaaggggttcacctttcctgctgcctagacagagctgattcatcaagacaggggaattgcaatagagaaagagtaattcaaatgagtctcactgagcattcagggagcagagtttttaaggataactttgtgggtgggcggaagccagtgagccaggagtgccgattggtcagggatgaaatcataggaagtcaaagctgtcttcttgtgctcagtcagttcctgggtaggggccacaaaatcagatgagccagtttattgatctaggtggggccagctgatccatcaagtgcagggtctgcaaaatatctcaagcactgatcttaggagcagtttagggagggtcagaatcttgtagcctccagctgcatgactcctaaaccataatttctcatcttatggctaatgttagtcctgcaaaggcaatctagtccccaggcaagaaggaggtctgctttgggaaagggctgttactgtctttgtttaaattatgaactaagtttcttccaaagttagttcagcctacacccaggaatgaacaaggacagcttagaggttagaagcaagatggagttagttaagttagatctctttcgctgtctcggtcataattttgcaaaggccgtttcaatccttcccttgggttttataacaccttaatcttaaggagtaggctgtgaagatgggacaaggccattgattgctctggcttcttcctgctgacaggggatgtagtgggaatgggagtgaaccccaaggtgagaagagtggaactgctttgcaactgtctgagcgtactcatgcaggcctggctgggctttcaaggtttgcatggcagaaacagtactcttatttatagttttactacagtgtttaagtgaacagcctactataaggtaaataatgagggctaggattaggagtacaattaccagttttaaaagcaaagatttgcttctaaccctcaaagaatttagaatttagtttaaactgcagaaaaaacctcaagaacagctaacaacagtgtagtatagtttttcttttgaatcataatttttctctctccagtcatcatttttattaaaaacaaatcaagaaatggtttgtttataaaatgaattttactcttactgtacttggcctgattatttgcataaagtacagcaagagtaattatttttcatgtaagctttttcaattggctttgatagaactctgttctgttaagaactttagataatactttttaaaagctgagcccagcaatgggtttataccctttaatacctatgaggtgggaaaattcctcttctcttgaggtcccaaaataacttggggttcctggccctgttataaagtgacattctttacttaccacaggtcaggaaccttgtacagggactttgtgaacaaggtatgagaacagattccccaacgggctttaattggctttataagtcaactttgattctttaaaggaagcgtgccatttcacttaaagccttggtaaaataaccagtttctccaaatgtgtcctgttagaaaagaaaacagattgttattacacttatgcaattaactatacttccataaattgagaatattaacaaatagttttcaaattctggagaaattaggtagagaggaacaaatgtgctccaaattttgtttataggagtatattttactcacttgttagaagttgcaaatagctctaaagaaataagtcctcctgactctgaaagaaaaggtttagcaatgtttaacacattagctttccatgagagccctaaaagtttgttcttttcctctctttcaatagcacaatttttaaagttatttgagacctgcacttaagagtcgtatatctgattataaactgccttttgaaaaggaccaaagcaagacaaaatgtctgtggatgacaaaaggctatagccactattaaagctacaattatgtagcagttttgtttacttttgtggcatacaacaattttacataacaattataattattaataatgtgcactaaattgtatcaacattatagaagtttcccataattttggaacacatactaataacatttatataaataaagtccaaagtaaaccaaatgccacttagtcttctatttgaaacattttcctctattttaatgtcacaattttcagcattattaattagaatcctgcatttaagagcacctgttaaatttgatagctgattatgaaacaattttcaccaaaatgagacaattgtctgtggatgataaaaatattttaaggcagccacagttaaagacacaattgacaagaaaatttgttacctctgtggcacacagtctgttaacataataattatgatgattactgataacatatactaagttatattagaataacaggagttttgcataatttcagagcatataccaataacgcatttacacaaatatagaccaaagaaagccaaacaccatttcatatttgacaatgctttctgtatgatttttgtaccaaataagccaaatgttatttttggactttagaggacctaatatctaaaatattaggtaaaaaagagacataatttataatttgatgttggaaagtttgttaaatatcaaaggtttaaaatactggttatcacaaaatagaatcctaggttaccatacgtaattcatttggccaaaatgataactccaaaaaaaattttaaaaaagaaaaacctttactctaatagaggagacttagctttccaaacaagatgcaatgaagatagcatgaggccaaataaatctatctcttttctttctttcctcctttttttccctgccatttacccaaagaagaaaataagacctttttattatcttttaacattacataaaaatcatctttaaaagagaaaaacatatttcatgtttgcattcgtgcattgttaatgttaaagctagtgtttttaaataaaattttgtatctttattcagttttaattagtttgaccatagggtaagattttcacaaaccctttagaaccctttacaattttccattaaacagcagatcaattttctaagaaagccctgttattcagacacatgggcccagattcaggccccacatcagtatgattttgatgtttgttgttgttgttgttttgtttttttttagatggagtttcactcttgttgtccaggctggagtgcaatggcatgatctctgttcatcgcaacctccacctcccaggttcaagtgattctcctgcgtcagcctcccgagtagctgggattacaggcatgcgctaccatacccagctaattttgcatttttagtagagacagggtttctccacgttggtcaggctggtctcgaactcctgacctcaggtgatccaccaccctcagcctcccaaagtgctgggattacaggcatgagccgccatgcccagccgcttttaatgttttaacctaaggaaaaaagctaaataatttcttttaaatattagccaactggtttatacccacagaatttttacaagattaaccctttcactttgcttaagccttcagttttgttctgttactcttttaggttaagacaatttttaaaaccctcagaactagccaaaattacattccctttaacaaaagctatattcccatgccttcttataatcttttaccaaaaacacattccctacataccttgtatgtaaaactgcttcttcagtggtctcaactacatattacaatgttaactgttagcaacttttatttttagtgaaaaacctgataagtaagagattttaattatctactaagggtggagcctaggacatcggacagaaatgaagatctgactcattttagcatagctagtggacttggctttccgtatgtccccaggccttatctataatctgctccaaagtaggtaaatcgaacaattttcaaaagtcaaagaaacagcttgaccttaaagcatttagcaaatttgatatttgaccttaatttagaccaaatgtctacattttcaagacattttattttaccaataatctttaaaactgtctttatttcccaaagattcctaaagtcacgtgaacaaaacggcattaaagtttctatttttctgacaaaatatttgatttaagcacttatgtttctaagccaattagagtttttttatatgtaaacatacaacacatataaatacacagacaggagatttagcacttgtgaaatttttcatttgccagtttcttaattggatgactggcttcagggtggagcccttggaggagcagggccaggaaaacatgaatttctagggccaaataagcagctgaaggcaaagacagatccccaaaattaagggtaccattttataccggatcccggatccccaaaaggaggaaaatactcaggagaagatagtgcaatgcttctaccctgcattttattgcaaggtaacccaaagccaatcagcccattttgtaatcagcccatctctcctgggagtctcatctcccagtgggggtagtgggggcgttttcttgtcttccaagtagccaagagcatgcttctcctatccaagtgtgcaaagaattaagtatccctccataactactattagccatcccttatatttcctacctaattatcataatacgaagtaatttctgatacccccaaaactcaaaaccatcagataacagtatgcaaaacagaacagatcctttaattttgagagggatttatctgcttttaaattcctggggttttataaggaaatcagagggttttttttttccaaaacagggtatgtggtgcctcctctgtttttcccaatgaatctcaggctaccagaagttatcttagggcctctcatgagtgctttaagaaggacaagacaaaaaaatggagaaaaataatacagtcgactgagaagaaaaatcctttttccagaaaaacaagttccaagaagagaaaaacataaaggccttttaaatatatctataggccgggcgcggtggctcacacctataatcccagcactttgggaggccgaggcaggtggatcacaggatcaggagttcaagatcagtctggccaacatggtgaaaacccatctctactacaaatacaaaaaattatgcaggcgtgtttgcgcgcacctatagtcctagctacttgggaggctgaggcaagagaatcacttgaacccaggggacagaggttgcaatgagctgagatcacgccactgcactccagactgggcgacagagtgagacaccatgtcaaaaaataataaataaataaatctatagcttgtttatccacttttaattaaactgacttttaaccatagtgctctttaaagaagaaatcctttcatatttcttattacctgatgttagccatgccaagtggccaatatttttactttctgaactttaccaaaggtaacctcctaggtgcttcaaaggcatggtaaacagtttctttttttataagatttagaatttccgcaaggtagttcaaagaaaggaaaattcaagagaggaaattagaagctaagtatggggggaagaaacctcaataaatggcaaaattacacaaataaaccagaaaggaattattccagaagccaacaattgaaccccggccaccactgtcaaaagataaagccgtagctactgagctatacagcattaagcagtttctattgcttttcccagaaggggcctagagaagcaaatttcaagcttggaaagcttttaactgcccaagaaaaatttttaggactaattatgacatgaaccccaaaattcctgtcctctggatggtggaaaccaaaagaaagtatccccgcatggtcacaaggttaagctcctaaggacacaaaacaagacagaaattttatacagtactggtttcagggacctgtagcaaagtttgtaactgacgagcctgccaagctggcttgagaagcaggcttataggggttgtaaacccacattctatcctgcaataccccctctccgttacagaacacagaaagacaaatttttagcacaaagtacacaacatttgctacagcctaagactagtttcacaaatccttttttctattaatcaaaccttgcggaggagaccagtaatttactgttttacccagacagagaaagggagagagagagagaccagaaacttggctggtaagaatttcttaccctttttgctggcataccaggtttctgggttccttttctctgcagcttccagaagaatggagtggcttctgatgaccctgctcacttgtgctatagcagtggggttccagccactttacaagagaaaatcaccctttactgttttatggaaccacaggcaagattcttaattttcaagatgctgcccaatgggctgcaaggggaaccgaattaacattttccatcccagcaaaatacacataacaaaacagacattagtcacctcattcagcacccaatatcagcctggaaaagctgaaactttttccctttggtccctgttgtctttaatccactccaggtggggacagatgacctccaaatggtaattcacaatggggtctctgggcaaggcaaaaagcagatagtcaccccaagaggcctgttgagccttctttggggctcatggaatgtgaccagataaggatggttccctgagttaggcctgctggatttccatcagcaaccgtctctgagatcccttccacatatacaaacacagacaaagaggagatggacagaaggccttccaaattagatccctaaccaagaactccaagagtatcccttccaaactatcctcctattctctgtctgagaaacctcctcgaaatcttcctgattgaggagaagtctcccaaaccaagactcttcatactagttagaaagaaccaactgagaccccccaaattgcaaaacagacaccctgcaaatgaggctacagacacagacaccccatggtggagctagaaacagacactccacgatggggctacagacaccccccataggctacattaccagtcaggagaagaaaggaggcattggcagcacctaggatactcaccaatctggacaccctgcaatggggctacagacagacaccccaccatggggctacagtcaccctgtgataaggcaacagttaaaggacatctccccaggactatttctccattgcaattaaattcatgcacattgggtcagcagtgccacgccagtagaaagaataccagagtcagccgccagtccaagagaactaggaggccacttgggctggcttctggatccatcactggaggggggccattgaaccacaggcaggtagccacaagggcaatcctggatgagcccccaaatttgtaactgcccaaggggttcacattgcccactgcctagacagagctaattcatcaagacaggggaattgcaatggagaaagagtacttcacatagagccggctgtgtgggagaaccaagttttgttattactcaaatcagtctctctgagcattcagggagcagagtttttaaggataactttgtgggtggggggaagccagtgaaccaggagtgctgattggtcagagatgaaatcatagggagtcaaagcagtcttcttgtgctcagtcaattcctgggtgggggccacaagatcagatgagcctgtttattgatctgagtggggccagcttattcatcaagtgcagggtctgcaaagtatctcaagcactgatcttaggagcagtttagggagggtcagaatcttgtagcctccagctgcatgactcctaaaccataatttcttatcttgtggctaatgttagtcctacaaaggcaatctagtccccaggcaagaaggaggtgtgctttgggaaagggcagttaccatctttgtttaaactataaactaaatttctcctaaagttagttgagcctatgcccaggaatgaacaaggacagcttggaggttagaagcaagagttagttaattagatctcattcactgtctcagtcataattttgcaaaggtggttttacaagtttaaaagtttagtttcctcacctgtgacatacctatataatggagtttattctgagatttcagtgagataacatatgagagtgctttgaacatttcagaatcaatgtaaatagataatattgttgcaaagtgtccagaaccaacagcctgttgttttaagataacagtccttttgttaacctccttattagaaacctcctgcaatcttagcaagtaattgaaagatctgctaagagacgaccctacaccaaactcatgttacttagctaatgctttctgcccacagtttcttcaaggaaagtccatgaagtgcctgccattcacagacttcttgagcaggtggcctcctggttggagatttaggaggcttccctagagggcatgccatttctaccaggtataaagcaattcattcagaggggattcacttgaaaatagcaaattctatcttctgtttgtctgaaaactcctttcaggctcttctgagccccttcacgtctcacaagtgggtaagcatcttccttcacactaaggagtgcccccttcagcacaaatcattctgtcttataatgtatttgtttccaaatatgtacgagcatcataaaacagattaccatttatttcttatccatttgtgtgagtgtgtgtttgttttgtataattcacttatttttatatccccacctccagcacaaagcctggcacttagttcctgctcaataaatgaaaacagatgtgtaagaggtaacacttcagttagtggtgatgctttagtttccttttaattcccatttgcccctcccctgcacaaagagagtaaatacctggaggccccggaccgtcaaagacctttagccctgctgccttggctttagacctttagcctaggcttgccccaatttattgtctccaatccattcaacccaggagctgctgggcttctgtggagagccccttttctcccactctgccctctactctcagagttccaggggtttattgcaggtcatgtcttccaaaagatccctcttctccacctgaaaaagattatggcttttggtgcttcattctaaacaaacccttctaaaagaaaaatcatttggtgaactcattcatgttttgttgttaaggacaagcaaatctttaacacattattctattctagcatctttgcatcaaaaaaaaaaaaagaaaaggattaggccaaatgaatgaatgaatttttttttttttggagacagagtttcgctcttgtttcccaggctgagtgcaatggtgccatcttggctcactacaacctctgcctcctgggttcaagcgattcttctgcctcagcctcccgagtcgctgggattacaggtgcctgccaccatgcccagctacttttgttatttttagtagagacggggtttcaccatgttggctgggctggtctcgaactcctgacctcagatgatccacctgcctcggcctcccaaagtgctgagattacaggcatgagccaccatgcccagcccagaaatgaatttctaatggtcagacagtgtgactggggtcaggatagggagaagagagaggctttagagcacagtactttttttttattttttatttttgcctctggaaacctatttgtaggaccagtcctactcaaaagagaaaaaaaagatctgtttcacccccaaaacatgcttgtgagcctcttctctatttcctacatggcagaaatgtaatagaggaaagggaacaaattttgcccaacaaaggtctgcctactggagtctttctgagttaatgtccctgatggaccaggtagtggtggtgggtggggagtttgtggggagtgaattctctctccggcttcagattgctgggagtatcctcagcctgttatgaaggagactcttttagacctgatttactctccagccagcctgaggtaagtctgtagccaaagagagggttagtactttactctgcaaaaattccttatgtcacctctattgccttgcattgtcatgagggcatgtgactttttcaatattgttctttcatgctaattacacacccatgtaaaatgggagtagctccctgctctcttcaacctgatcacttctgtcttcctatgagcaaatgactggagtctaattctgtaaaccaggtgtctgcaggtacactgcaggtgaagctagcagtacaaaccactaccacttacatttggttgtgagatgggaattttgcatcttatttctcttccttaaaattgattggcatagaattctataaaaaccatttgtcacatacccagttggagggtaaatttgcatagatccttcagtaagggttttatgctatttttttttatatcccgggactggaatatttaaagtatttccattttgcatgacatttgaagcactatgactactcttttgcatgtaattttttgtttctaagttgaaggagggtaataactgaatggtggatgcaatgtagattttaaaggtttcatttcagatttttaaatcacagaatgtaagcaaacaaaccatgttgaacaaaatggtttagtccacatgtcagctccaggggctctctctctctttttttttttttttaagacagagtctaaccctgtcacccaggctggagtgcagtggagtgaagtggtacttcacagagtcctctatattttcaagtttgtttcaaagtcacataattcaggccactgtatggatggtgtagcccacagagctacacccatcgcgatatggtcaatggagattcaatagtcttttcttatatgtgaatttgtgaattatcctcaagggtggaaaagattcttccaaaccaaagtggaatgacagtaagtgcccttggcacagccatctgtctgctcacttgtgtttaggaatccagatgccaggtgagaacccacagcaaccacagcttggtggagtgagccacagcggctcatgtggcggcactgcgggagctcagctgggtgtgtttggtgtctcctgcagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaagtgagtgcctcagctgaggagccctcacccactgaccaggggcttttaccctcacctgtatttcagctcacagatgcacttgagtcatgtttctctgagacccaacagacctcttagagtctcccctaacaccctgtctttgaatatctaacatttctggtgaatttctgaaacaaactcgattattcttattccaatacttattgctttgttgagttttcatatgtatttactattaacagtaatcataatccaacaattacttaatcctctcagcaatatcagaaaggcacagcaggcatttttgtccctatttacaggtgggaacactgaggttctgagaagtgacatgacatgctcaaggccaggtggccagtaaatagcacgaaaccaggactagggtatttgggtctttatttccatgctttctctagaagtttaacaccaaagggccaaccttctggtgggggtgcagggttcatgaacagtcttctcatgtatcctcctctacatttttatactggggaaacctgatttgaatgcacattgaagaggaggaaatacaaaaataaaagggcaatctactaactaagcggatatatgacatgtggcagagggaggtgttagcactgccagctgctataacaaaataccatagacagagtgcttgttctggaggctgggaaatccaagatcaaggtgccagcagggtaggattctgttgagggcccttgcctgggttgcagattgccagctcctcactgtgtcctcactttcactgtgggacggagtgaacaagctcccttgggcctcttttctaagggcactaatcccatttgtgagggctgtgcactcatgacctaatcacccccacaaggccccacctcctaacactatcacatagggggttaagatttcaacatgaatttggggaggacacattcagtccataacactcctgaaaactcaagccaaatactgctttactctttttatctcaattcacagggttaagtaagcacttaaagcactctagaaatatcctctaggtagataacaggtgcagtcttagagcagaggggaggcaggaaaggagagaggaaggatggacctctgtggaggagcttggccaagcagaggaggcttaagctggtatgatatatatatatatcatgtttttcccacccaagaattaaatttaaccatttgaactaatgaaaaatgtcattattaaaaataccactcagtagaacccataagtattttaatatggcccaggtcacttgagttttcaatgctctttctataaacctggaagtaaattctagaatttaaacatgaattcttagagatctgatgaggaacagttggcagctaggattttgagctatctcaactacttaaaaaaagataatttatctccatgaagtcatgtgtggagaattcagcaaatgagctgatttggcactaattttttttctctggtcccagctggtttctctgaattttcagcccacccatgctgtgtcttaggtagccagaaacagtcacaatgctccactgagaaccatgctttctgtgttctcagtgcatggaagcagatgtgtacggtgccctgtggccctcactggctggcataaccccccagagatgactcctgctctcaccctcagagtgagagtaggaacgcttagctgttactggggttcggcagcctgtctcatgattccctctgacggaattttctgtgggaatggtttgttgacagggcctacttggagcttgagatcaccctttctcaggagcagattcagaagtacacggactgcctgcagttctacgtgaacagcacacttaaggaactgaggaggctcttccttgtccaggacctggtggattccttaaaagtatagttgcttaagctgttcacttcacagtcttgactgttattttccctaaaggtgtaatattgtaaactgctacatcaagaagaataaaaagcaagtgctaattatattctggagtcagaagacctccagttgtatggcaccatgaaccagtctaatcccttcattgtaccaatgatgaaaatgtggctgagacatttgtccagggttgcccagtgagtcactggcagagctggaatcaaacccaggtcacatagcttctagctctatagtctttacaacacaccagattgtctccttaaaccatttttagttcctccgacaatttcccaaaattaatattaagataaaaaatctagatagggaatgtgaaaaccatatatacttttgcattgaaggaaactctagattctactaatattaatagtaagccctccaagtgtgcttatgtagttacagctctgaggctagaggtatgcccagcctctcacttgatgaggatcaggggcacctggggctctcactgaatttgctgggttcctttgaataagttgctttggcctcctggtgacttacacgtggaatcaaagttagtcaatcgtgattcggcatggtcataagcagagctggggaagcccagacaaggtagttgtgaagtttctgtgctctcacagcactttatacacaccctggcaggggcttgtactgggagctgtctggtaactgttcaaagaagggcagaaggaaaagtgaaaaatgtggtcttgaccctcaaaatgctttactggaataatgacttgccatataatgactgaagagagataccagggcaattataattacttaccttagtgcttttaaggccatggttgtatttgtaatgtaaaaattgtgggccagaacaggggtcagcaaaccttgtccgtaaagagacagatggtagatactttaggctttgcaagccacaccatctgtggcaccttttcaactttgccattgtagcacaaaagcagaaaaagacagtacaaaaaggaagggcttgactgtgtgcccataagacttctgaacactaaaaatttgattcaatatcatttcatatattagaaaatattaatcttgttttgattttatttgaacatttaaaaatgtaaaaacctttattaactcgtgggcctatgcaaaaaccggtcaagggccacagcttcgtagattattatttccttgagtccctcaaaccttataacaaagtgatccaaatagttccaagagaactaaggactggatcctctttcattgattctgtgatgagctttcaacgcctttcattgactatcgaaatcatgatgtattctgactcaaattcaaatctaggtaaaagtcaatgatatgagactctaacttgtcaggaagggttttaggagctctaataatgctttcgttcttcagtttgcagtcctgatgtggctcctgacctacgttggcgctctcttcaatggcctgaccctgctgctcatgggtaagagcagataagactgtatacgtcttccttcaccccctctgtgaaaacgctgcttcctaggctgtaagctttttgtttgtttaaagagattcctaggaacaaatgccagatatccctgagtgcagagcacttctcttaccatcatagttcaattaaagagtataatatatattatacactaataatgaattcctaagtctaaagggttttttttcttcaaacataactggcttctttctggcttgtaatatatatatttggatcaatatatatatttggatctgtttacagtggcagctatggatggattcattttcatcttgggaggggagagtttatcctaattctaggaataattacaaaatacctgtacagggctcagcatcattttattttccctatgaactgccctgtcatcttttatctagaatgctggatattgcttctcaaaatagggaataaaaaataaaataaaatgctgtatattccaaataatgctataatatcatataaccatataaaaatgtgtctataagcgtattcttattgataactcagaattttaatactatatttgtttttcatcccagctgtggtttcaatgtttactctacctgtagtgtatgttaagcaccaggtaagttctatgtgatgtcaaaaaatggcattgaattttgacctcatcatctttggatatgctcattattttttttttctttatgtaggcacagattgaccaatatctgggacttgtgaggactcacataaatgctgttgtggcaaagtaagtcacatagtgcaatgcataaaaggagagactctcttacatcagcatttgagtggattaggataggggtaatgagaagatagtaaaatgatagattgatttatggtcattcacttactggaatcatatattcattctcttctcaattatgttattttagaaaataagcataagtttttaaactctcaattaaattaaacccagtggtttattcaggtttcataataagttttaatgaatgcatgatattaagctctaaggactggcccatgtacaagaacaagatgcattggaggaaagaaggaaacttgattcaaaaaagtaaaattaacagtttaattcaaataaaaacaagttaacatttttaatcttttaaacaatgaatagcactaattttttaaaaatcatttaaattacttttaaaactttgaattatttttagaactttaaaatacataaaatgtttgccaactaaatacatcacaccattttaactcgacaactgtgtgtatgtgtttaataccactgctttttaaacctgagtcttcagccttactttatggctcccttatatattaggagatagagatttcagttttacatacccatagctaacatgatcattaaacttaggagttttccctaattcttacattactatttttaggtatatagtcatctaaagtgatagctcttatattgcattattattcaatattttgttttattaaaaagctagcctaatctttaactataaatatatttcaccaaaggactagactttttcacaaaaactctatctaattatctgataataatgtggctggacctaggtgagggtcagatttagagagaggcattttaggtagttaaagatgtgtaataacaaaataagaaaggccaatcacattaaagttcctctgctcttagattatatgtgatgtgcttcagttccctctgaagtttataaacttttgttttttactgtgtattatttacatttgtcctcttaaagtcattaggaactcatagggttctatgttgaatttggatctttgagagatctacaacacatttcaaaatgcctgaacgtatcagcttggacccagatgtaaccaatacctaatgaaaatcaacacattaagcataaaataatcattttattttgtattaagaaatggtatcatagcacagtatgagacttggtggtacccgaacctgaggagcctgtttaaaaatacaaatgctaagactccacacagacctatagaattagaatgtctaggattggtaacctggaatgtatattttaatgaactcttcaggtgactttttggcaactagaactgtgttcataaactatagcaaagaataccagaataggagtttggaaactggaagatagaagttctagacctaagttgtccaatacttagtttgagtatcacaaatcatacctattactttttcatttggtttgttggttgagtccaaaaagaggagtacctgttatgttctggacacttcatatgataggtacagagggtataaagataaatgaaatgatctcagccctaaaagagctcttagcccagtggtgcagacaaaattatacagaaataactataataaaatataataagtacagtagagctatatgaaatactaaagtcagagagatgaggaaacaattgttccttcctggacaggatagtggaaagccattaagataaggtggcattcaacctgggccttgaaggatgggtaaacagtcatcacgtggatgataaggggaaagacgttgcaagaggaagaggtaataaagcaaagacagagaagcatgaaaatgtaagtcatgtttaataggcaacagtcaaccagtatgtctagagcttaactgagtcgaaagatcaactggaaagaatgtaggaagagaggctgaggccaggtggtgaatgctctgtggagttttgattccaacccagcaggaaatggccaccccttgatgtttttaagcaggggattgatatcatcagatttatgttttttaaagatcactatggcagtctagtgagaaaagaattggagaggggagagactagagatgtggccatcagctaggaggttatcataattcaaataaaagtgacaagggcatggcctggttaaaatggagggaaaagagagatggcagagaatataaagtatatacaatgtacttgttaaattacaattggaaatcaatgctgtgaaaaggaatggaaaggaaatgttacctatgactaatatggcttctgtaattgagcttcaggcagagttggctctgaatttcctggtagctaggacaaaaagagaaactaggcaagtcacatggttctcactatctatcagagaggaggaaacaacaattcttccaaataacctgttttgcctggcactacattttgaaggaaatttcttggtgggatcttaactctaagtcctcttcaacctctgaaattgtaattccaccttagaataaataattccagcaaaagaacttacaccactttagtggtacagttaagaacatgattgttagaatcagacagactgagtccatttctggcatttttagctgtatgagctcatcataaatgttatttgactctatgagcctatttccttatctgtaaattggaaatgttaataccacacagggttcttggtgattaaatgaggtaatgtctgtaaagtattcttacttggatgtaggaaaccctcaatattatatatcattgtcatcatcatcatcatcatccgattactgcttagagatcggttcatggggcttggaggtagaggacagtcccagattgggccagtagacaccagggccagtctctcctccatactgagtgaccctgtctaggtcgtttcacctttgtttgtctcagttttccagcttaaaataggggttaataatgcataataacacttcttagagttttgaaaatgaggaaaaaagcctcaaatttcaaaaggcaaaataaacactgtagaggaaattaaagcttcgagtaagtgagaccataataagaaatctgctttaagtgaatacaattccctatgtctaggtgagttatgttttagaatgacaaagtagcttgtaattttacctagaagctctcttggtgacctttgataaatctcatggaataaaggacatcctgaaaactcaaattggaaaggagctgtcacgatcttcaaatgagaagaaagaaagattctagatgttatatttgataaactgaaggcctaatttcaagcaaaaatccagaatgaattagtaaaactgtagatactcagaatagatcagtgtatcttcactaaaccctgagatgagatggacttccctagccagtgagtattctgattttagtgggggtagtcagcaagtcttcttggtgtccttgtggaaaaaaatggagatgtatgatccagatgatagcacaggtggtagaattctagaagattgaaataatagaccctaaagatgttcattaatccatccaatatgtgtctggggcaaggtatgtgacacagggctctgcctttgatcccattactttcaaccccattacttctcatgactatgtgaagacaaatcaaatatctttgtcaaagttccagatgatgtacagtttgaagcaaaagcaaattcagaagatggcaagctcaagattcaaaatgaatcaagggatcttgagtaagcgagaatgccgaattgaaatcaataaaatgaaattaataaggaaagtgaagtcctacatttaggtttctaaaaagtcaactttacagatatagaatgcggcgagggatagatgagagagggtaacaataagggtgtatgtaaaaaatacctcgggggttttaattgcttgattggtcacagccaaatgtgagtcaatgatgtgctgaagcatctttaaaaaatcaatgcaagttgagttgttattagtaggagtacaaagtctaaatcaacataggcaacagtcatattatattccatattggccatcccatatctgtgttcaatttcagggttggacattttaacagatgcattaatacattggagtaatgccacaaagatgaccagggtactgtggtattagaaatctgatagtaatgggcagtgaagagcaaactttgctggggatgattaccctggaaaatagatgactttaaaaggacaccatagccattctcaaatacttggaggtctaacattgctaaaggagtaggatttccctttttctctcaagagcagtgaatggaaattttagaagttctgagatttgaatgaaatatgagggaaaagagtaatgattagagttgctcaataatagaaccatctgccccatgaaggagtgagtaccctgacattcattcaagtattcaaatagaagttagatggtcaccattgcacatgtcctctgctggcacctcttcctcttgtccaactcccttctggtcctgtgaccctaaaggttatctcatgtctagggctgcaaacttgtgtctccagcccagacctcttcaactaagcaccaggtctatccacttatttatgtaaggtttctctaaagtgtctgatagacctttcagattcacttagccacacatcgtgcaatctcaccccagaacttgtatttccttcagttatcacaatcttggtaaatggcattttcacctggttcctcaggctaaaaaccaaagaatcttccttgattactcttcctctaatcctagcctatgcattcagtttatcaacagatcaagtgggtcctgcagcctcatctctaaactaaccctgagactgttcccctctcttcatttccatgtctaccatacaatccaggcattgccttcaggtacttggactgctgtgggtttctctccctctgttcattgcttctactctcatttcccaattttttttttacacagccaccatcatgatcttcttacaacattaatcagatcacgtcactcccctgcctaaattcatcaatggtttcccatcacacagggtagaatctaaactcctcaccacatcctacaaactccaacacccaccatctggtccctgcctgcctttcagacctcccctgtccacaccccaagcaaacgggcttctcatctccttgccgccagcttgtcctctctgtgatgcctctgcactcattactccctctgcctgaaacacttcacatccagatctttgcctgatggtcccttcctgtcctctgaggatcagtttctcagatgagtggatttaaaagaggtggtacacaccttaccactgtgcccctcactgcctgccataccaccttgtttttctttatagcagttatcaccatctaaacttctcttgtcttctagtttatttctgtctcctcaattcctacaggaatgaaaactccatgagagcaagcatctcctcccttttgttgaccactgaattccagtacatggaagggtacctcatggcacagagggaggtctcaatcaaaatctgcacgataagctcataaatcttcaaattaacaaaacacttccagtgtaaacctgtccgaaaatcatgctgctatattgtgagcatcacagaatttcaggaccctggagatatctagtctatgcccacattttaatgagtatttaggaccagaaaagtcccttagcttgccggatgccacacagctaattaatagaatagctgagactaggacccagctttttaaattccagttgtgggtaattagactactctgagggtgaacataggttccttttcctatgtccaacataggaacagattatatccctagttatataaccatccctacttatgctcatcttcctggcatagtcagtaatagcactttctctctctttctgaagtgtcccagatgggggataaataatcaccctaactatatcacagtttctgtaatcctgaaataagtcaatatgttcctccacctaaaaagatctaaaaaatgtggctttcttccaattctcttttttgttgctgttattttcattatccagtttttacttccttcttattgctttatagaagagtatttgcagatgtacttacataaagactataatatcttctggaatattaagttctttggtcacttagctaattaaagcaacaacacataaaatgatttcattaataacacttgtgatttactaccttttgatactgtctttttaggattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgttctccctctcttctcatgcatggtcttaccagaaaacacaaaagctcgaagtgatgaagtcactcgatgacattctaggagggctgagagcaaatgctcaccttatttctctctaggactgtggagtcaaactgcaacctggcttacggtttttctgggtcattaatagaaaactgaaaagtggtaaactgtcaatcactcttcatattgtactctgtcaggtggatgcagatatttaagatagtttttaaaaacttgaaagtgatataaattcttacataaactgtatggcaatatgcaacaaaacactggcaaaaacaattgtaattgccatgaactcaccgttttagtaattacttattaagcactgactgtgtgccaagcacttagaatagggctgtgaataagaaagatgacaattcctgccctcaccatgtgaagtcttctaataattcctcactgctttttatacaagtccaattgcatattttgtttcactgctacaatcaaacatcaaagacgaagaggtagaagtgaatgaaaggagtagcagttggagaaaaaaaggaatgattgcttataaaaagctgccttttaccagttttacacctgggttcagtgaatatttgtggagttatccttctatacaaagtggcgtgaaggttacaagggtcacttggcactgtgccaacagccagaaactctcatcactgtgctagggaaagggcaggtggctatgtggaaatgccaactgagcaaagggtagcataaaacaagagccattggcagggcgcggtggctcacgcctgtaaccccagcactttgggaggctgaggcaggaggatcacgaggtcaggagttcaagaccagcctgatcaacatggtgaaaccctgtctctactaaaaatacaaaaattagctgggtgtggtggcacctgcctgtaatcccagctacttaggaggctgaggcaggagaatcgcttgaaactgggaggcggaggttgcagtgagctgacatcacaccactgcactccagcctgggcaacagagcgagactttgtctccaaaaaaaaaaaaaacgagccatgatgcagggtttgagcaacagaagattctcaggggaggtgaacttcacggctgggtcctggtttggtttttgccacatgaagaaggtccagcccgagataaagaaagaacatgagctaaagtgccaagatgtggagtgtgaggcatatgcagagaatggtgagttaaacaagcttagatgggttgtaaagttcttggggtgggaatgatagtgccagataaagctggaaaggtgggttgagatcacaatgggaagaaacttggatgcctgtgccaaggagtttgggctttattctctacatctcagagagtcacatagacacaacaaaggtacaagatactgaaggctagacaaatagagtgataattgtaacctaactccacccaggtgccaaatgactaggtctttactagaacagccacagaaagaatagaaagatgttcacctgtccctgatccttgatagcccagcatgccaagcacccaccatggataaggtgcagctaacagatgatgtggagggagattggactggagctggtaaccaactagctgcggggcttcaagatgaaagctggccttgagaatgagtgcctccttgaattttgcacccaaggaagctcggttgcctcaccctagcccagcactaagactcgctgatcagcaggatgcaatgccattttccaggacagagagcccagaagagattatttggggaaagaagatactaagcttagtttggtgcctgattttttttttaatggttactagatttagaagaggattttcttttttctttatgtttttcagcctccaaccttttagacaaagtttcttctacatggctttattgtatagaattaatcttcaatatctgtatctgcaacattgtcctcatactatagacccagaattcctctcacaggcagctgctcattaggaaggtctaattaggaactctctttgctggcagtggtggagaagtttcctaaggaaactccaggcttccaaaatagtaggtatggatgtagatttttcacaaatggaacatggggcacattataccctgtttctacagggagcatcagcccaggtgatattcaagatgatggaaataatgtgaacagatgagaagaggaccaagagcagagcccctggaaaatccagagtgagtgaggtgattctgaaagctgtgaacagtagaaaattcttacagcccatatatggatgagtgaaagcagtaagagcaaatgaagaagctgcagtattctaacggataaagcacgatagtttctatgtcctctgctctttccccacccatgttagtttcctagggttactctacaaaagtatcaaaatctggggttttttttttttttaaactctcaggctggagtgaagtggcacaatctcagttcactgcaacctccacctcctggattcaagtgattctcctgcctcagcctcccaagcagctgggattacaggcgcgtgccaccacacccagctaatttttatatttttagtagagatagggtttcatcatgttggtcaggctggtctcaaacgcctgacctcaagtgatccaccatctcagcctcctcccaaagtgctaggattaccgggtgtgagccatcaggcccagcctcaaaatctgggtttcctaaaacaacataaatttattctgtcactgttctggaggttagaagtccaaaatcaaggtgttggcagggccctgctctctttttcggctctaagggagaacacttccttgcctcttctaatgtctgcatttgtcagccatccttggtgctcccggcttgcagatgggatactccagtcactgggtgccgcttccctgtgtcatattgtcttccctctgtgtccaaatttcccctttgaataaggacaccagtcgtagtggaatagggcccaccctaaggacctcattttaacttgattatctctataaagaccctgtttccagtaaggtcacatttctgaggtacaggggtttggggcttcaacatatctggtttaagggtggtgcacagttccacctgacactacctcagggctcatatggtcccttaccctattataaagacttcctcctggtgtagatcccaaacctatctctgcattttgtttctctctctagggaatcactgctgagaagtagtcccacagctttctacctcacccaaatgcacgtggggtgtggttgattgctgggccttgcttcacagctgtgaggttccagcaatcaccacattgtccttgaatagggctgctctgagcatcagaaggttagcactctcttctgtgtgcagagaagcacgtaggggagacagaggagccaccactggagctcataccaaatgcgttcgtagttggagggggactaagtcccctctgctgatccaggcagaagggccacctgccttcagacgctgaccggcttccctagtgcttgatgttggcaccctcctcaagctccttaatcagatttttattgtataattttatttttgtggtttattttatgattttaaattttccttaattcaatacatttaatattaaattcaatgttacaaaatcagtctggctggccacattttctttgatgagtacattgaaatgaattaatttgcattctagaccattattgtctttgaaagcaattctgctagaatcagctgtctctggtttcttgtggcagactgccacaattgctacttgagactatcactatgacagttactactgttactacttgagaccatcattacgagactgaatgaagggggatgaacgtagaaataataacaaaaaaacaaaagaaactgttttaaaggaaggtgccaggggaagaagaagagggctccctgcttttagtgagcaagggcagcagccctgagcttatacagcccttcgtatttattgggtaggaagagcagggaggaggagctaacgattggtcagctgcttgattgatgacaggtgcatattattgctaacaggctttggatttgcctaatcataagaaacacttgtgcctgggtcatgtctgccctcagcattccttctgggtggcagatgcagtttgtgagtttgccaacattctgcatttatgagaacagtttgctgtttactcatacagcctccagtggtatactgagttgatcacaaccctcacactttcggcctgcaacagtttctccctaaaatgataaaatggtcctgaagaattaacacttcatcttggcctgctttctctaaacatacaactgctctggattttgctttgtatgtttatgtctttataaaacaagagaagtcatcactaaattatgacaggagtcaaattcttaagtgactaatggcagcctatgtcaaaataatactcaaaaattaaacagttcatatgaagggtaactttttttcaacctttatttctagccatctctaacagaaataaggtagccaaatataatggacgagacattaaccttttttaaaaaaatattcaaacattttaagtaactagcattttgtaacaaaacaatcacattgaattatatcttccccaaagtgattttttcatgatgcatttgacatgtcagaatcaagatatttaagactgctttcttaaatgtattattaaaattaaatttaacttgtcttttaataaaatatggttttagcatctcccagccatttttctagtacttaataagctcaatggaggaaatgcttatgtttggcttatgaatcaaggtgaaggtaaaatgtactttgtcaaaattcaagtagtgaatagataattctcttttttgtctttgttcccttgacttataaatccagggccagtcaataaaaagggtgtgtgtgtcatggagacagagagaaatgaacagggaagaacatacgaaatggggtacacagatttgcctccagctttctggagcagtgcttcatcttttcagcagaacattctggaggaatacctggccagtcctcacccacagtgcctctccaaagctctacacttccctaagacatgttcctggaatgcttttacatccctgtggttcaagaggcacatgcaaccacgtggaagcccactgcgcttcaagctcccacttctcccctatcagggaagcttcccactgggagtagagtgtgaatgtataccccttcagtggagatggttcagaagccagctttgcaagcaaagaatttctttaatcacatatttcatcttagaagttaatgtgaacttgtctgtcattgcataagacctttgcatttaccttaatttaaaaattcttccccatacttctgcattaagttgactcaaggagaatataccatgtttttctttttacaccaagtaaccctagtttgagatacatggtcttcagtgctcaagatgccacgaaggcagttttggctgggagatgaaatagattttgacccttgaaagggggctgcatcatgacagcagacttgggaagaccatgctgcatcttagccaagcttggctttcttcctctcagaaactctgtgagtgtctgtcctccagaaaggcaggtgaggcccttacttccaattagctagcaacaataaacgaaggattttattatcaaatctttataacattatcagggatattcccaaaggtgtacagacaatgttttttacaatagcaaatattgaaaacaatcctaacatgccaagtatcaagcaattgaataagtaaattatagaccttctaatgaaagaccatatagccacttaaatcatcttggggaatgatattctggcatggaaaattgttcacaatatagcaccgagtgaagaaggtaagctacaaaaataatatgaaatgcacagggaaacattaatctgtaaaatgaaatcaacatagaaaatatgagggcatacaacaaatattgaatgtaattgtctttcctcagggaagactttgaaagatcatcctttctctttgtgtgtgtgctttttaaggtttttagattgtttacattttatctgtggtgtctttttctcattttttaaaaattgaaatattgttccaaaccccatacctatcaaaaccaaagctatgaaaatgagtgaaaaatcacaccccagtaaatattattctctcatttgggcccatttttgttcaaatcaaaatttagatttttcttacttgcatctctggttcatacctgcacccatgcctttctctttgctgctaataggtaaactaactggtgggtgtcaaaggagaatggaatttatatgtttcaaagcaaagtttattctcttaacattgttgatttgctttatataactaataattgttctaatttctttctgccttatttatttatttattttgagacagagtctcactctgtcccccaggctggagtacagtggcacaatcttgtgccacttgtggagtacagtggctcactgtaacctctgcctcccaggttcaagcaattgtctgcctcagcctcctgagtagctgggattacaggcacccgccaccacacctggctaattttttgtatttttagtagagatgtggtttcaccatcttggccaggctggtcttgaactcctgacctcatgatccacccgccttggcctcccaaagtgctggcaggtgtgagccaccgcacccagctgccattgttgtttttaaattaagttttttatttttttcaataacagaagtaatatatattaattacagaatatttaaatgatgcagattctcctattcaaagaaaaccaccattggcattttgggataaagcctttttttccctagacatttaaaaataattgaattcttattatctatataatttttgaattctgcctttaaatttaaaataacaaatatatttcatatacatttttctatggtatctttcttactcaaaataatgttgtattagatttctcaaacacactggatgtttttaaggtatcaaaacttttaaatatgggggaaacattctaagaataagttctcttttttcttatattatcaaatttgctaccagttcttgaattatgatctgctaattgcccttcatgtttctatttgaccagtcctcttatttataaccaaaatttaagaaaatgataaaaatactaatatttgtgctatggatatatctcaagtctttcattttacttagtaatattacattttaatttagtatggtatttgaaagacttttaaagcccaaaactcctctcaaatgaaacatgacagcttataaccataaaaggcactgtgctgtttacatttattatttcatttcatcttcaaattaggcctatagaaagaggtataccattttatatataaatgaactcctagttcaaatcttgcctaagatcagtattaaagacagaggtttggatttgagaatgttattcaatcacattttatctctaagttgcaagtcaattgagaaacatgccaaggaaccggctgaatgaagatcagatgaccagttctgctactgataaagttgcttaactatggccagagtgaggcttcctgtgatttctattccctcaacaccaagtgaggatgtgcaccttacccctgcactggacagagctcacaatacaaggaagcagagcagcagtgagtctggggggcaggccaggccgacagggagagagcagatgaggccaggcttcctcagttccctctccaatatcacgcttcttcctttgagaagaatgaagaaagggtagagggaagatacaagttttgccaccatttgttttcctcttgggaatggattggaagtacctgtgtcccatagacagagtagatttcaatccaggtctttttataccaaaagccaatagactttacttacaacagccaacaatgatgacaagacctatttattcattaaaatgtgccatctatgaggactattaggcaacacctttaaaaatatagtttggagtctatattgtccttaaaaagaaacaaaactgaatttttctctattaatttttgtgaatgcaatccatcaatcagagcctagcaggtaacagcacactcaaaagagtaattgaatggagtttaatgaaaaagtagggcagagtttaggaagacgaacaagagatgatgcggtgcctgtggtctagcaagagtgggagcctctaccacccttacacctgaagggacaaaaggagggaatgcacacttaaaccagagaaagtagccagggcctcctgacaggagctgaggttcagaggaaggctgcagccagccttccatgaaggttacagggagaaagcccaagcaataaacaaccttttcactcttcttacagccgtctcagacacaggctctccattcaaaaagttactttgaaaatttaaaaattaaatactaccactcagtttggtagggtgttttctctcctccatcagggcatacacttgtcagaaactactatgttgtctgtattttctttctgatactactcacatattgagggctcagtacaaatatagcacctcagcatgtaaattcgtataaggacaagttgctcagcaatgactatgatgcatctagtctgagataactattaaataggcagtattgttattttttcatggggcattcataagaatatccagaaactccgtagtactcattccatccaataaatatgtttgaaatactcctaacttgaaaattttaaactcttaaatttttctcaaagagaacttaccacaccataatctctcagtggcaaatcgatcctgtctacctttttgctcaatagaatatatagttcattgttttcttttcttcccctaagtaggaaagaacattcaaatgcttgctaccacaaaatatattcccaatagaataaatggagttttctttagggacctttatatcatggtagtttatctgtatgagcccttctgtgcccccagtttatgatagaattgtaacctccattgggaagaatagcgctaagccaagggcatcctcttctggctgttacagaatttcttactagataaaatgcacttacttttttcccctttttacaaaactttactttcattttcattttgctctttaattctttatttgggtattatattacatatatctagccaattaactaattatatagttcagctacttgatatattagtcaataaggttattttgaggctatcaggataaaatttcctaggaattgtatagcatcattgagccagggactgtgccaggctctttacaaacattatttctaaccttcagaagttcaaaattctacatgattggtacttttatttttattttccaagtgaggaaacaaaatctcaacgtaactggcgcaagtttccacagccagtaaatgagacctgattgtctgtttttgaagctgggctctttccgctgagccatactgcctttctagtgtttcctggcccctctccctactgtctctagctcaggaacaacactttctcagcgcgactatttggttgcaagtaatagaaacccactaaagtatattaaccataaatgggcatttactggaagaacacaacaaaatccaaaggcttaactgcaggggatggagtatttttctcaacacacaattttgctgctttgacctttgtggttaaagacggaagtgcttaaatccaggcattacctaacaatcctgccatgaatagaggaagaaaagaaagcacgcaaatcttaagcagctttatataatgacttaattttatatacacattcatcctgagccagaatacacatctacattgcaacaggaaaagcagccgtaacagttggagtcatggtgacaattcattccgtaactccggaagctcatttatccagcagagctgagaatcaggagttctcattaactaaaatcacagttaactaagatttacctctttaaaaatagtaattaggcaataattctggtgccataaaatttacttagaagcaacctttatgcacaatgtaatctgatgattcaaaatgtccttcagcatcttgtaatggtaatgatcaggaagaccattgcgaatgtcagttcttgccatactggcctggatacaagagtggtgtgaaagaccctgtggaagttgcttttttccctagtatttttttctttccaatactaggcctgaactgcagaagatattaagccctatactttttaaaattctgaacacatgaatcttttctattatgttttcaacaatattgtaaatatctattatgtgcaaatgactgtactaggtgctgcaagagatgcagatttatggtatggcttattttgctccaagcattgttttaaacattttaactatgttaattgatttaattctcatgattatcctacaatgaaggcccagttttacagacaagaaaattgaggcataaagtttataaagatattaagtaagaaggctattacacagaaaaccataaatccactcagcctgtgataactatcacctatgaaaagtttgaacaaagtgctttgaaaactcagagattattgggataataagaggtagagaaaccatctgcaatgcagactttgagtttgaacaggctgaaattttacatgcttgcagcatagccaagtgagaatatttactcttcgaggttaacacttaggggagaagatgggcaggagatgcaactcgagagttatttgtgaagatttacctctatgcgagaggagagtttagagagtataaaaagaccaggatggagcccaaggagaatgcccccttttagcaaacagaagaaagaaaacaagggagccagtgaaggatgtgaagaaggaataaccagaatgagaaaagtagaatggcacagtgtcttgggaaccaattaggagtgagtttctaaagaagggttgagggagctgggcaagggtgtcagattctgcaggaaagaagacggagttgaatgaggcttgaacaaaggcaattagaagatgaggaggaggcattttagaatgcagagtaaaaggatgcattacagccaagatgtagaccacacttttaagaagtttggcaatgaagggaagcagggggattccatggcaggggggtttatgagaggcctaggtttagtaagagaacactgggctggaggtctgaggaacacttggaagacctaggtgagcaggagctcattgaggaaggtccctgaggagatgggagagaatgggagtgatagctgcaattatttatgtgtatttttactttccctaaagagctccggaaattcttacctgcatccacatatggaggtcattcagtgacatttttaaattaataaaaaagaaaaaagaaaaaagacagatttttaaatcatatgtagagtttagctactccaacaatcttactgaatcatcttgagatgaatcatcaaatacactttttaaaaataagaacaaaaataaggaaaataagaatattgctacttaaagatcacagtgttggaattgtctgtgaaaatgctaaatgagcatttaaaaaaataatcattgctacaaagatggcccctgaaacgtaatttaagataacaatgataaaatgaaataaggtacctttgctaaatatggcattggttgtttcaggcctaatttagtttctaattactctgcaaattctcacttgaaaaaaatcataatgcctgtgaagtgatatcctatcctaccataaaatgttaccttaggcagaaataaactgatttattaccaagcagctaccagcagggagcagcctgatctgttcatcagcaccatattcacagcaatattatctgcagcataaaatccaactcctcagtttggaattcaggctcctcacaatgaagtcactacccaagtttctggctgggcttctgcttttcctctccaagcacctaacgctcactggccacacctccatggctctgctaacatcctgtagaatgcggagtgccctcctcaacccagcaccaactccctgccctggttgtagggccacagaacagctctggcagagcaggcagtgctccaacctggagtcggaagtccttccatgccactgttcaattctacgattggggtgttaacctcaaggttattgaatcgctcatctaagtgtaattttcaaaaaataggataatgataataatcaccccagagagttgtgataaagtcatggaagcaagtacattttgtaaaactgtaaaatgccttgcagttgtgagcagtagttacggtaccgcacttctcatagggaattgcacctggttctcaagtgtgcttcaaaatcctcccttttcccaccttcaaggccgtcttcttaggaacaggggacaaatctcatccacgtgtttagtcaaatgactgattagactatttggtatgtaagaaagccccacacatgccgaccggattaacagaaagtgaacctctagggaaaacagcactgcccaagctcgtagtccctggaatggggagggctctagaaagaggatcatgtgaagggaagcagctggcagctccggatttctacttcctcctttttttttttttttttttttttgagacagcgtttcgctcttgttgcctaggttggagtgccatggcgcgatctcccaggttcaagccattctcctgcctcagcctcccgagtagctggggttacaggcgcacgccaccgcgcccggctaatttttgaatttttagtagagacggggtttcgccatgttggccaggcaggcctcatcctctttctcttgcctctctcttcctcagcggggcctcccctggcgccacctataggtctcttttgtataatacatgctcgggacacagcacacagtaggcacacaacaaacacgccatccagtgacaatggcatggaaataaaaccaatttcccacctctgtgacagtgacggttgatttaattacagaaattttcactaaggattgaacgaccaagagacttaaggaagcctagggatggcagaaaggagagtcgcatttctatttcagaagaaatgctttttattttccattggtaggaggaaaagatgaaaaatacttagcctgtgctctgtggtaagcacatctttattctgcttaatcttcataatcccaatatgtaaaaatcccattgtacagatgaagaatggaggcttgagtctaagccagtctaaaacctctagcaaataacgcaaccaatatatgtcccaaacctgtttagccccaagaaattgctggagatagataaaaacaaagaaagaaaatggaaaagggatcctcttagtcagttgttacaaacaccgacatggtctgttcttcttcagagatgccctgctttccttgtttggcataactccatcagaggcaccaatccatctgtttgcttctctaacaatctggcactacctggagaacataatcttcctgccattttaccacaaaaatacccatatgctggagtcactgtagatgagaattatagcctgaccacaagacagacactttagaagctgtgagaatcccaagggataggaaatctttgttgaatatataaacctcttgcagaccatcgaggaggaaagcgaacttgaaggcttaaactggggaaatcttactagtacacaatgtgggaggacgaagcctttgcagcccctaagaaggattcacccagccagctaggtaagtcacccagcatcacaagggactgatgtcggggttcataaataatagtttggacaacatatgtatggctgacatcctgtggaaaaacctccagctcttctgaaccctcttctctcccactgcctccccagggaggctagaaattcagattctcactgtcctaacctctttttctttttttctttctttcttttctttctttcttttctttttttttttttttttttttttttttttttttttttgagaaggagtcttgctctgtcgcccaggctggagtgcagtggcgcgatctcggctcactgcaagctccgccttccgggttcacgccattctcctgcctcagcctcccgagtagctgggactacaggcgcccgttaccacgcctggctaattttttgtacttttagtagagacggggtttcactgtgttagccaggatggtctcgatctcctgacctcgtgctccacccgcctcggcctcccaaagtgccgggattacaggcgtgagccaccgcgccctgcctctaaccgctttttcatgggtggccttgggatccagctctagccgctgagacataaaaggaagtgtatgggactctgagcagattttcttccttgaggaaaaggaagaagagcttctacatgtggctcctttccacttctccctgcctttgcacaagggtgggatgtctggggctgcagcagccatctgtgaccatgaggcaacaagcttgatgatgaaatgataacatgcacaaagcagtgaaacaggcaaccactttctatatgtgagatgtttgacccaactaccaagaatggaaccttgccttgatctaactcagggtctaggcccaaggagtttagactttgcctagagatactagatttatgcaaagatgctgtaaaagcaatgttatcatcaaatacgatatagacctcacatacagagactgcaaacctgccagaacatatgatcgtattcattcctgtgcaagttaggggccaaactccaaggaacagttgggttctttccctggctctaacagcagcaagggctaaacagaaacaaacttgctttatgataactaaaaatctatgtcagcaccagactggaggattctcaatgtcatactggctgttcagcaaaagtcctctttaaaatactgcctgaaagataaatgtatctgtttgtgttaccaaagtaaaaatacatgagaaaaggacatgcattttggccaagtgcacaccagctgtaagtagtgaaggctgagaaatctttttttatgtgtccattatttctaaagtttcctatggctgctgttacaaattaccacaaacttagtggcttaaaacaatacaaatttattgttttaagtaaagcaaatttaaaagtaaaacaatacttaaatgtattgttttaccattttggaggtcagaagttcaaaatgagtctttcttagtgaaaatcaagatgtcagcaaggctgaattctctctggagggtctaagggagaatctgtttccttgccttttctagtttccagagaccacctgcattccttggttcatggtccccttcctccatcttcaaaactagcggcttagcatcttcaaatctttctctgactttgatattgactctcctgcctccacctttcagttataagaactcttgtggccaggcgcagtggttcatgcctgtaatcccagcactttgggaggccaaggcagacggatcacctaaggtcaggagttcaagaccagcctgggaaacacagggaaaccccatctctactaaaaatacaaaaattagctgggcgtggtggcgggtgcctgtaatcctagctactcaggaggctgaggcaggagaatcacttgaacccaggaggcggaggttgcagggagccgagatggcgccactgcactccagcctgggtgacaagagtgagactccgtctcaaaaaaaaaacaaaaaacaacaacaaaaaaaacaactcttgtgattacattgggcccacctggacaatctaggctactttcctcatctcggagtttactgattaacaatcttagtttcctctacaaccttaattaccccttaccaggtaacctaatatattcacaagtctcagggattaggatgtggacattttgaggaggcattattttacctattacatctataatttcactaaccaggaataactacaggtaacattttagtgaacaattcttctcagaccattttctatgcatatgtttatagagatatacctatatacatctctatagatatatggacttgtaaaaattaaatattaattgaatactgtacatttctttttcaacttgcttttcccactttatacatatgtatgtgtatgtacatgtaaatttctacccattattcttaataggtaccctattattactttatcattagtgttttttaagtatctaccatgtgctcacttaatttaatcctttgaacaatcctatgaactgagaactcctatcaccgtcaccacccctttagagctgagacactggcagcatgagctgggaggctgtctcaggagatactccatccaatcagtagtggaacgcatttaaatccaccagaacccaagctcttaaccacatggcggattgccttctagattgttccactgcatggatgtcccataaattacttaacaacagtgtcctactgtagatcatttgggctatttttcagtatttaaaacaggactgcaataaacaagttcatacctatgcccatggacaaacctgtgattatttctttaagaacaattcttagaagaattactgtatgtcaaggctccttacacaaatttccaaattgtccttcagatagtatgcatattcccagtgtcaatactttgaagtattattctttttaatcttaatattatgagaaaatgagagtattatttttctttgaatgctaatgagggtaaatgttctttccgtatgtttctcggaattttttttcttttattaagtgatgattcatgttgtttgcctagatttctatttcagaatttataaagtttcctttgaaaaattgtggttgaattttgtacagggcatcccatataaaaggaaccatgagacaagttagaagctgatcatctctcacaaaatatttaatttataaaaattaaatattaattgaatactgtacgtttctttttcaacttgcttttcccactttatacatatgtatgtgtatgtacatgtaactttctcacaaagttcagggaaaaagaaagtattagagacatgaagggaaatagagaaatgtaagaaaatctgtaacaaatccagtaagtggggaggacacaaaatgcccccttaagattagcctttattcatagataatggagagcaatgtgatccaaatgatgcgatatgtaagaagagtcttctggtgacagcttaagggttgccttgaagtagtccagtctagatatttccagaagagagaagtatatcacaaggaatttgttacaaggggtatagaagccaaagggtaagaagataaagaagaccccagacatcagagctgccataacacctgtactgtacgcacaagctcacatatagtgctgagcagctggagactgctggagtcacttggctcctactcctgccacttctagagccaccaaaactgctgggacctacagtcaactgtagcctgaaactaccacttctggaggcagaaatgcatgatttctcggccttctaatctccctcaagtgtttcccattagtggaacttaccaagaaaacaggtggcaaggacatccaggaaatttcatatccagtcttcttactcctgccacacagaggagggcccagaagggcaggaacagatttgaataccaatagaccaaatccagcaaaaaaggaggatgttgtccaggatggtttccaacaccaaaatatggcactccctggatgaaggaggcctggattctagaactagttctgctactggtatgctgtgtcccctccaaggcagtgttgcacagtggtttaggatgtagctcagtgccctcacttgcaaagcaggcaataatacctagctcaaaagattatttgtgagggttaaatggggtactgcaaagtatttaaaacagtgcctggaacaaaataagcatttaacaattgatagctattgtcattgttactatcattctaatttcaattttgccatctgtagagaaaagaagaggagggttgaatcacctttgcttctctctaacccaccagaggaaaaggaactgacagactcaacctaagcctcatgctaagctgaattttggagatgcagagaaaaatgaataatatcctcctgtccccgtcatcacagagctcacagttcgatgggaagacagagaaaaatcactatgattcaaggcaaaatgtgctcagtgatgtactagatacaaggaaagttctaaaatagtacaaaagaaggttttgtagcatagtagaaagagtcatacagacttcactttattattttattttattattttgagatggagtttagctcttgtcgcccaggctggagtgcaatggcgagatctcggttcactataaccttttcctcccgggttcaagcgattgtcctgcctcagcctcctgagtagctgggactacaggcacgcgccaccacgcccggctaatttttgtatttttagtagagatggggtttcaccatgttgattaggctggttttgaattcatgaccacaggtgatcctcccgccttggcctcccaaagtgctgggactacaggcgtgagccacctcgcccggcccagacgtcactttaaatccaatattatcctcttgtggtcttgagccgttcatttagtcgcccgcgcctcagtttacgtgtctgtaaaagtggaggtactaaaagagcctgctcacaaagtccttgtgaagattaagtgagctactgtatataaaggttctcctgcagtacccggcacaaagatgcgctcaaaagtgatcattattatgattccagtggcccacaaaaaagatacaggcctgaactaacgcaatggaaattgaaaggggaaaaattagctaaagagagagtcattcttcccagactgcttaattatcgtggataaaattagagaaccaggagggtacctactagaggtgcgggccacgagggggcgccccacgacctcggtgtcctcgttgcccgtggcaaccggcaatccttggctctggcttaggaggcgctcaagtagagcggcaaaatggccctgagcccctggaccccagggctgggcgctggcgagaagctggtgcaggcggctgccgtctccaccggcccctccctggagttatgcaccttaccctccaccctgggctcctcggtcgcggtcgaggcgctggagcagctgtttgttgtgggtaagacgcccctcgggcgctggaagggacgtctcctcagaggtggcgcttaggaggcactcagcgggaaccctgagcggggactctcctcccggaaccagggcatcactgggcagggcagagccttctccccgctccttggaggctggggagagagaggtggcgggtgggaccaagtgcccagatctcctgccctagcgcagctgaggtgacttcgctcaaccctcagtagtagttaaattactgaggtgacaaatccgggactcccaagccactgccctatgcctgcgacctgattacacacctgcatttagattatgccttcgatttcagttctcttcttgccgttcctttacaagttaacttcctccgacattttgccgtggcaaactggagaatttaacaagcaaataggaaagggagtgtttaagaggcttctgttgtgttgagcaagaaaaattagatgtaaagggttgtttaggagattctaatagaaaatgaccttggatagggccaggttaaagtatttttcagttagaaagctgaacctgtaatcaagtcacttaagcttaaggtaagacaatccaagaaagggtgtttcttgttcggtgcaaaaaccgtttaggccaaacaacaaaacatttcagtgcttcactagaatcatcccatttcttcaagataatcgtattgatttatgttacaatgttactattaatttgggatagtttttattttccttcttaaatgcgctaggttaatttcacaattcttagcaaatatgcttgggtaaatgttatcatgaagaatgttggccgggcgcggtggctcatgtctgtaatcccagcactttgggaggccgaggcgggtggatacctgaggtcaggagtttgagaccagcctggccaacatggtgaaaccccgtctctactaaaaatacaaaaattagccgggcgtggtgacgcacgtctgtaatcccagctactcgggaggctgaggcaggagaatccgttgaactcaggaggcagaggttgtggtgagccgagatggtgccactgcactccagcctgcgcgacagagcgagactccgtctcaaaaaaaaaaaaaaaaaaaaaggaatgttacccactgaggagacctaaagttattaagacctaaattattcacatgtatctgaggtcactgtcaatgacagacctagaaccttgaactcttttcatacttgatctctagatcggcatgccaatgcaaccctagtacttatgtacaaatacatttttctgttaatgtctagacactcagaacatatttcataggaaaaaaaatcattacaccctcttgccctgagttataaaatattaatatgtaaatctccagcacatttgtcctcaaggagcataaaatatatacctaaattataacattatggaataggaaataagtacaaaagagattagtgtaatgtacaataaaaattcagagactgaagatgtaacttccagccgagtaagcatttgagctagatcataaaaggttaagtaggatttggatagataaataagagatctttattttctaatttttttttcagaacaatcactgcaaagtgactattttaaatgtaatgaagaagctaagatctttcttaaggacattgctgtagctgttaagaaattggtattgtattatctataagaaccatttcttcaatcttccacatatttcttcaaactttcatttcgcaccaattctgttcaaagtattaagtagatgactagggaatatagttaccctgaacttaaaaatatttttctctcaattttgtaaggatttgcacaattattgatcaactgtggattgttacttgattttccatgaagaaaactaaattatgggcttatggctgtggatgagggcaagctcatttagagaaagcaatgtgggtgataatacggttcagttaagaggtggaccacatgggcaaatgcttgggacaccaatatataagcattgcttaaaacaaacaaacacacaatctctggaataaattgcaagcatggtgctaattaactcagttctctgtaagcaattccttgcataactggtcaaagattatttgacatatgttccactgaagtagacggtactgttagtgaaaacaaagagaaactctttcaattacacttaactggcccctatcaaagacatgttgaagaaatatttaaagaatttccttctgaggtgtcacagacatctctgttcggccaaggatcacattgacaatgcttccttggcacagtcagagtagtgaaggctctccattttatttaaaaatattggataagaatttactacatatcaaattgctaaaaatgttgaaatatggctgtaaatgagtttgaatccacagactgctgataaaactcttactactttatattttatataattatacacatatatatatctatactacataatcatactttacaatcctacttgagtaggtacacgtaaacacttagggatcatgtgtgttgtgcagctctgtggtgctgtgaaaacatttttccctgcttggttctttctttcagttatgtctttcgctaggattttaagaggccaaaatatttattgtggttaaagtatctagtctgtattcatttaatatctgagctgtgaaatctcttaaacaacagagatcaggctgggtatggtggctcacgcctgtaatcccagcactccgggaggccaggatgggtggatcacttgaggtcaggagtctgagactagcctggccgagacatggtgaaactccatctctactaaaaatacaaaaattagcctggcaaggtggcgggagcctgtaatcctagctacttgggaggcttgtaggagaattgcttgaaaccaggaggcagaggttacagtgagctgagattgacccactgcactccagcctggtcaacagagtgagattccatctcaaaaaaaaaaaaaacaaaaaaacaaaaaaccagatcaatccttttatttttaaaagtaatacatgttgactttgaaaaattaagaaaaaatagataagcaaaaggaccacattaaaataatcactattaatgctgatgaatatactttctattttcagggtataggtgataactgcattgaatttcattttttacagaaaagtgatgatgctatatatgtaattatatagtctgctttttataattcataaaatataatggcagtttctcaggtcataaaatagctatagctattatgacagtttatttaaaagatgatttatctattttttcccaccaactgatttcttagcagtgtttcctttcttaaagtagcctcagctaaaagtaataataacagctttacctacttgtttgggtttgtaggtgtgtatgagaaaaccattttttttatacctaagcatatttttataggcaatttccatattttaataagtagctttctttctcaatattactatttttgttagtctttccttttaaatggattgaaactgcatataagaaacagatactcataaagaaaagataatttctcagtagaataaaatcaatagaaattaagagataaactaacagacaccttaaatagtgattgtagatacttttcccagtttctgttccaaataaaaataatggcagaagatatttagtgaaattatattttgacccctgaaaacatttgtagggcattgtttaggaaatcaatcttactattttagtgtcttaactttttaaaaatgtaatttaaattttcaggaagaaatgagaaaagccacaatcgatcttttggagattgaaagcatggaactcaacaaactatactatctattggaaactcttcccaatagcattaagagggaattggaaggtacttttgaggttatcaactctagaaatttagttgatcttataacagaatgaagtactttcaacaagataagtttcatagttattgctcatgtaagatagagctagaaagcatacatgacacaaacacagtaaggtccgtaataattttcttttatattttaagtggaaatagtatatataacacttgaatttatataatttggtttctaaatagactatagataaatggatcagcccattccaaattggtatttatccaattaaattaggcaacttggctggcctaaaccatcattctactttctgtctctgagttttggctactctgggtacctcatataagtaatatcatacagtatttgtcctcatgaccggcttccttcacttagcataatatcctcaaggttcattcatactgttgtatgtgtcagaactgcctttctttttaaggctgaataatattccattgttggtatctatcacatttccttatccattcatctgcaaattgtcagttgggttgctcccatcttttagctgttgtgaataatgctgttatgaacatggtatccaaatgcaggttgagcatcccttatccaaaacagttgtgactagaagtgtttccaatttctgattttttttttgaatttggaatatttacattatactttccagttgaacatccctaatccataaatctgaaatgcttcattgagcatttcctttgatcataatgtaggtgctcaaaaggtttggggttttggagcatttccaaaattatgctcaaaggaaatgttctttggagcatttcagttttcagatttttggattagggatactccacctgtatccaagtgcctgctttcaattttttttgtatatttatgcataagcagaattgctagattgtattgtacattcaatttttttttttactggggtcagatcttacagagtcatatattcaatattttggagatctgccttgctgttttcaacagtggctgcaccattttgtgtttccaccaacaatgcacaagggttccagtatctctacatctttgccaatacttgttattttccagattgttttgtttttgttttatctggttgttatccaaatggctgtgaagtggtatcttattgtgatttgatttgcatttccccagtgattagagatgttgagcttctttttgtctgctcattggccatttggtacatcttctttggagaaatgtctactcaggtcctttatccatcttttaatcaggttcttttttgttgttgttgagttgtaggagttctttatgtattctgaatgttaaccactgattagatatatgatttgcaaatttttttcccattccatgggttgccttttcactctgttgatagtgacatttgaagcacaaaagttttaaattttgatgcagtcaagaaatcattcccaaattcaatgccatgaaggctttccctatgttttcttctaagagtgttacagtttaagctcttatgtttaggtcttcgatctcttttttttttttttttttaggtaaatttcatatttggggtaagggtcaaactttatttctccagaagccaggaatgttgttggctgagttcttctccaggaattaccttcaacaaaagagagaaggggccaggcaaggtggctcacgcctgtaatcccagcactttgggaggctgaggcaggtggatcacaaggtcaggagtttgagaccagcctggccaacatagtgaaaccccatctctactaaaaatacaaaaaacaattagccaggcgtggtggcgcatgcctgtagtccccgctactcaggaggctgaggcagaattgcttgaacccgggaggcagaggttgcagtgagccaagattgcgccactgcagtccagcttgggtgacagagcgagacttcatctcaaaacaaaaacaaacaaacaaacaaaaacaaaagagagaggcttaattccaagttatgttctctccccagtgcctgccacccgcattcatgattggtcactatgagggtataaaggtctggctcccttgcctcaatgtagaacaactccagagcatcatcatagctccaaagctcatcacagtttaacctcctcctctgcccagctttttatttcctccaaagagatgttcctcagagcactacccaataaatgctctacacacacattttataatctgtttcccagagagcccaacctaaaaagagtggtcttaataagtaaaaaaaaaaaggtagattttccagttagccatttattgcctctactttgtgataaggaagctggaccctgtaaattttcccctttaccagctggcacaatgttcagctttgtcagcagagggcataggagggatatggaggaggaaggggttctcttcctgattccagtgtgctcagcttggctgactcttgcagtgtgtgcaacttctccaggccatggtcctgcagcatccagcagtccacagtgcccagcagcttccaccagtaccccttgagtagcttcagccaccaatgaggcacctctccatgaagagcttctctggcacccccttgggtagttttgtagtgagttctgaagcatggcacctctctgtgggcaggtacccctaacacccccagagagcagatttccagcaagttccatcagcccagcatttcatgaacttctttacgatctaatgagacgcagcctctctaatgaggcctagctcccaggtctccaggtgctgtttccttgagcaccgtatctcagccctagggatggtggctactccttaggtctgctatttctgaatgctttcaagttctcttcacttcttaccacccattccctaatactctaattactctaatcctctgtttattctattaaactttcccttttcaatttactgtgagatttctatctcctaattggaccctgactgatagagtgggtttaaaaaaatatgcttggtgttagtctagtttgccagggaaaatacaacaaactatacatgcagggaaagaaaatcagatttagaagaatctacaccaaaggtagaattaagagtgtttttctttttctttgtttgctgttctttagtttctagattgggttgcttttataatcagaaaaacatattttagaagggggaaaataccataatagcttataaggtccttgatacatgctaaatgcttaaccatgcaaatttagttagttggccttatgtcgtaagtccttgctactcaaagtgtggtctttggttcagcagcataagcaacatgtaagagcttgtgagaaaatacagaatctctgggcccaccctagacccactgtatcagaagctgcattttaagaagatctccagatgatgtatgtgcatatttgagacacaaagtttgagaaagcctgctgcaacaagcaatttaactagtagcctagaaaaaaaatgtcctagctctctcaggagagctaccagctagtttctagggagtttgctgtgtagaaatgagtagtccagcaccttcctaaacagcagtgttcaaaaattcatgcatattgaccatctgtcatgcactgagataatcctttgaagtcatacgtgattacactgacttattatttatggatgaataattatttctttaatacattgggttcccccaaaaagcagagcctgaggcaatggcttttgcattattattttattagggagtataatccaaagaggaggatgggataaggagaccaaagcaaggtcaagggagagcaaatatggggtggattatgatgttggctgctgctaactgaaactaattaattatgagaagaagcccccaagacccagtgttacttcttctcaggactatctatcagtgcgagagagggagaaatatttatgcaccagctcctgtctatcactggtctgatgcttgccctacctcttgtacttctgggttatacatgcatgggtgtgggtgcataaagaagccccatgtagaagttgcagaagtcctaggcaggaggtgagaagtgcatggaacaggcgggaatcaggcactatcagactgcacctgtctgaaattgatccaagcccacagaaagctggttaccagagcagcagcagaaataagagaaataattagtaggtaagattgagagggaccaagggagtaagaaatgcttgataaaaaacattattaaaagaatatttcaaagaaagcttttttgcgtgaaagtcagtatctacagttgtgcttttcctcaaataatgtagtaatatttccacttactttgaagaatgtgtccgagacgctcgcagattaaatctttttgagataaatacaataaaaatgagaattacaaggacagagaatgaaatagagcttctgaagaagaaaataactgacctgacaaaatataatgaagctctggggtaggtattcttatattcagtatttgagggagcaggggtctgaggctggagtgggaaaattgtcgggaggggtttactctctgatctgaactgtggcagggcgagttgagaggtgaagatgggttgtaggagatggcccaggctgatggggtagggaaggtggtggctacagaggactgaggaggagagcagaaaatcttcaaccacagcagccaggaggcttgtaatatttcagaggcaatccagcttcctagcagcaactactgtttgtaaatcacacactacctctaatgctacatccaaaggtagacacacaatgggtttagtttccatttttgtagaattaagtttacaaacccccaccaccaaagtaagaaatcttgcagggattatattgtaaatctaatgtcaaaccagacctattgtatctagttcagttcattgaagatatttagtcatatttgtaatccactgaaggactgaggatgaggctggttcccaggacagggttccagattgtgtctgtaattaaatgagataatatatgaaactgcctatagctcaagatctgacacctcttagtgagcctcattttctccatctgtgaaatggggatcacaactcttaactttgctagctcatgaaaggaagagatatattctgaaagataggcccccttgaagaattacccctatgagaaaatttgataaattttaataaatatcataaatatcagcatgttagtttccagagtgagaaatgttcacaaagagcccttatcataggggaaaaaaagtcttcttgggaatccaaaataatcagagggttgcctggtgtcccagataataaacatcagaaatcagctagagacctcaagacccagggacattgatcccaaaccaggctctcagaacacctgtgctgggagatgctccacaaaagagaaagttcatgattacataagtttgagaaataccacatactctaatccctgttggggattcacaatacagatttgtgtgtggtgcgtgctagccaccatggccagagcctgctacataaactagactattcctaaactaatagcaagaaaaataatacccaggctagatatttatatcaaccggtcagcaacatcacattcctatagaccagtgattctcaaacttgagcttgcatcagaatcatctggagggcttgttaaaacacaaattactgggacttgcttccaaaattgctgatttaacagatctgggaggagtgcggtggggataagaatttgcattcctgacaggtgatgctgctgctgctggtcctgaccacattgggagaaccactgctctagacaaatctttacggaaaggcaataacaaacagaaggtggtggcaggtgtgttggcatcatcaagctacaatcatttgttgcatcattttttcaaagagaaatgaatatcaaagtgttcacagactctgacaggtggtgggtatgtctcctgtcctgggcaaatttcaaaaactagatacagacagagcagctgtttgaatgtgttttcctgaggctccacactgtgtttgtgagtgttcttttcttctcagcccatcacaacacacctagtgaggttttttgatttcacttattttgctttgtttccccgaggctccagtcctcaagttgattcattcttagaaggcttcctctgctgcatccacaaagcacccattatctgaccacctactgagcctctcacctagacttctttttattgcatttcttttgtggagtttgacctctgaaagcaaacttcccagcagcctgcttttattttcctgagccttcaaacacaattcctctgaaactcactagccttgaggactagcaaaaggaaaagggtctttacattgcaggagcttttaaaaaggaaaatagagaaatggcaccaattgtcccttttgtaaaccttttgttgttagcctctgggtagacaaaatcttaaggtcttcctcagacaatcttaaggtcttccttagatggacaccgcccgcaatggatgtgtgaggttaatgactcctattgagctcagagttggctacagctgggagaaggtaagagggctcaaattaggtttcaggcatccttcaaacagtaaagatagactcttttctttccctagtttctatccagaggaaggtgagctttctgttgggccctgcctgcagggctatagcatccagggtggctggagatgtgatgagatttctctttctttagcttaacagcctatctcaggatgataagatagacatgatgacaatacatatcaaaacactcatctggccagatcccattcagatcctgttcaaaattacttttgagtcattgtatactttaacccaaaataccctgtggtcactacctggcatctggggacgggtggggcgaggcaaggccacgtgacattcaaaagtggtaaaagttgcaaggttgatgcttgttttgtgtttccttctgtcctcatctcaattttttttttttaatttcagacagagactcactctgtcactcaggctagagtgcagtggcatgatctcggctcactgcaacctctgcctcccaggttcaagcaattatcctgcctcagcctcccgagtagctgggattacaggagcacgccaccatccccggctaatttttgtatttttagtagagacagggtttcaccatgttggccaggctgcaatctaactcctgacctcttaggtgatttgcccacctcggcctcccaaagtgctaggattacaggcatgagccactgcacctggccttcaaccaagtttagacaatcataaacacagtcataaaataagtattccttacacttttcctcttgctgagggctcttctcaccacacagactactcctttcttaggagctgtgcttctcactctgtgagcaattctttcctcctagggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacaggtaagtggcatgatttattctttaaaatacaataatgtatagaatctggagcaggaaatgggaaataatttatttgtcctcaaggctggcaagcagcctctgtggtatcttctgtgaacacgctgggaaaacgggatgagcgggagactcaaggacacttctgctcttggggaagacatttgattggtagcagcatctcagttcatgggtaagaatataagtgacaggatttgtaacactggggtgtccccttgcttatatgctgccatacagggacaaggaataggctaccatcttatccagttgcctttgataaccctgagactgtgtctgtatggacaggactagggtattcagatagggcaccagcccagccctgctgttcctgataaatgaatcagagagagcagcagcatgcagtggggccaggcagaactgagggctttaaagagaaaacaatgtttcgagagcagcaaaatttgtgagggtgggggagggataactactgcatctttttctgccactgcaggagctgaactgcctgctgtgccatgttaattaaaattcagcatcagatctgttatgattgtttcttccttgttctgctctggttgactgggggagaggtggttttgataagagggtgacatcgttcattagggtctaacaagtggcactgtgataaaatggtaagaagttttccaggattacaagctgctctgtctttgatgattttgtttactctgtgtttagctggttttatttcccattaaataatgtgaatttagattcccagataatttcttcaatccttccttcgactcttcttgtttgcttagtacgttgtaaatccggtcaccactgctgtggtgatttactattaaatcactaccgtggcaattacttttataattagttattaacaatcattgttagtattgctcttacaaatttactatttcaatattcaataattacagtttggcctttgtggctcatgctttttcctgtgatactgcaaaataaggaaaccctggtttttaggtttattttttacttattactatacttgaatatgttatacttagattaaatatgaattaggttgacactgtttttaaaagattttttaaactttgttgtgctaataggctttttaaattggtttcttatgcttgtcactatagattaatgaatttgaaaatacccgtgaagtaaagagaatggagacttatcaaaagaagaaagaattggataaattacaaactaaaatgtcaaaaataaaagaaacagttactgtttccgcagcggtaagaaagaataaactatatatatttttaagccttatctaggcacctcaataaaaaaggagttgattgtaattcatcttcatgtcatgctgagaggatgttttctgcacgttaacattttctgacactttctttaaagcgttatggtgcaattgtggtttcctcttcaggaatatgatgggaagaaggaaatgtggaatgccttagatacaaactgcatttgatgggccaaaatactgttaaaatattgatttaaaaaaatatacagaactaaccaaatgtattgatacatataacatttccatgagattgcttcattttgtataacaaaatgaataaccatgggctgagtccttaattctgaatgtggaataatagaacagagtttaggctctctattgagtacagcaacattaatatgtaaaggagaccatttgtctatttaaattagaaaatacatcagagctctgtacttctgtcaaaaaaattgtgataacatttactgaaaggcaacactgtggtaagtattttgtgaggattatctttattttaaagataagaaaacataagcttatggaggtgactataattgaagtggttaatgtaaatactacttgtatgttaattaaaacaaaaatgcctgttaacttcttatcacaattaattgaactaatgaatctttagtgtattttttctatgtgtcttgaaaaatcacatgcaaacctatactggtacaacagtaaaactgaatattttatatggggtggttctgctcattttaattacaatatatctattatgatatccaattacaaagcattaataaaatgaaaattttctcccaaatatgtgcatttgaaaaattattatctgtttttaaatttcaacatagtaaggaagcactaagcctataggaaaatagaaaggctatataaaacgtattctatctgcatgcccacgctcatatttccagttgtggcctcataaatcataaatcgagtgcaccaccaactagcttgggaaaaatgaaatatgtcttccttagcctgtactccgaagatctctaagcccaaattattttgaaggcggcaggagtaaatttgcctccgggtccttccccacttcccacaatccagcctgcccaccttcctacccctccatcagtagagaatagttttggaagcacaaacttgagtctcacacagagctgcgttcaaatcttagttctacaaacctttagtttcctcatctataaaatggaagtattaatattgcctactgcagagcatttttgtaaagattaaatgaggtcatgcctattaagtgcattatatttggtagtttgttgccgttgttgttggctgaggtttgaaaacagtattttggctatagactgagaccacaaggaatttcagattaactctcacatgggacgtctctgcagccaggtaacattgatatgttgttggcagaaaaaataatagcatgtgacccttaaggcggcctacctgtccaggcaaggaggactgaggactaaagataacagatgtcaggcctatcaggccttcagcatgtatccctaattctgatgattgatcagaggcctctcaacatttagctcattctgatggtagttctacgattccagttagctctggaactagctatgggtgctctagagaaagaaaccattttgagtagcttttacccacctctctcacctggcgtggctgagagtgcctctattctccccacaggtgtatctctgatcccacattgctgtccagggttagatggcattaaatattatgtccatggtaattctctgttggagagaagaggaatttgtttgatcagccttgtctaagcttcattgtccctcacaagctgaaatgcaaacccaaggctgaataagttagactttccttttcttggtcccaaaattgcattgcaaaaatgtcggtttcattatgaattttctccatcaatttttccttcctgtaaatcataactttttttcacagtatccaattattccatttcctaaattttgattaaatattaagaaataaaaattcttttcagcacaaacatagatatcaagggagacaaaagacccaatttgttttgactttttaaaataatactcattttggtatcctgggatgataaatgaagatgattgtgacactatggatttgtttaatttttttaagtgttagacaaagttaattcttgtctcaaaagtttgtaaaaacagttttcacattctcactgctgtatttagccatcttcccctctaaattttgtttttttctgatgatttcagaattatttgtgtccaagtttattttatagagaaacaattataatgattgctttttttccttgaagtacactcctaatgtaaaagttgaatgagtaattcatgaatattgagtggaattgaactgctgttatgaatcacttggtgatgattggatgccatatttttgtttaatttttaataggttcttagtgatcacaatttagagatagcacgactacacgaatcaataaggtattgggaacaagaggtcagtgagctaaagaaagaccttgcaattctggaggcgaaactgtaagtgtaatgctttatttttacttaaatgtttcgagatatgttaatatgatataatatagttaatatgctatgttttcatttttaaaaacatgtctttaatttgacatgaaaattatattctcttagtttactaaaatatatgtgaaagctttatagagtcaccttttcattgtgaaattagctgatgatcaagagaaaaaattaaagatgctgtcagcttggggaaaggaaaggactctttggaatgtctatattattctcatttcagttccgaactccctataaacaaaaatgcccatgagggacggcattagtgggacatatcataggctacaacccatctacccatgctgttagagttgttcttactcaaaggatacttgccaaacttcctaagaaaatacagggaagcctcagggcaaaaactgctacacgtgggactggaaccagaaactgaaggaggtcttccatccatccaaagcctcagtctgtgcttcattttgtggaagtgttttactcctctctttatctgcacacagtattctcttcttggtgagcacatggcaatgtctggctatgccaaatcctccgaattgacctggcacaggtccaacaatctttaaagattggtcaacacactctctcccccgaaaatccccagatttcatatcagaatgtgtttggctcagctttggttcctgatccaatcagctctgcacaagaagatggagtcttataacatggcttccggggactactccagtggttcactgacagtttaagaaacaaattgtggactgagcagattcccaaaatacaagtaacctcacatgtagaatcttgttataacatggctcatttctatatatatttgaatatattgtaattaaaattataataggtctttcaaaacaggatttgtagagtacaatgctgatctaccatcatcagttcataaaataggcaataatctttatcttcagtatcagattaaaaattaagaaagctcaattaataccacaactaaaactcaaaaaaactcttttattttgtgattcaatagtattagtttacatatattttgaagaaaaactagacaaaaaagtcatagtgaaagatatggattacctcaaattatttctagctgttatgaataaaaacctcactacgttgatgaaattttatttataagcagtcttcatgttagctaacgtgtgaggattcattgatcttccatttgtaatgatttatcattatctataatcccagctttttaagagtttggattcatgtagaatctcaccaaagaaaagtgctttatattaatgtggtggttgaggatacaagtgatcctcctttttattcaaaaaatttgctctttctctttattacctggaaaattaaaagaaagttccttgtattctttctattttcttccttagctgtttcctctgtctgtgaagatagggagaggcaacctagttcccgcttggtggatttgaagaatcagtgctgttttataagatttctataagaaattatacaagaaactaaaataatttgcacgacacactttcctatcaatccttaacccttcattttccttcattaaatctttaaattgcaagctggttaatagccttgttacctattttgaattcaaaatactgaggaaaacaaaatcactcaaccataagtttaaattccatgtgcgtttggacaaataagagtaactcaaatgctccatagatcgacaggaggcactgcagtttgatccttgttctttcttatcattgatatccagtgtgattacacagataaaggtgaatccaatgcctacctttctaattcgctatggggtttctttggcattcagctggttttcagcacatgagaaatgtgaaagttaaatgttgtatataaatgacatccaatatgtggcctagagtatatccttgccattaaagtgtatgaggttatggagactatagttgcttttttgcgccaacgtggtttcagaattgccacggttactaatggcttccatcctgttaaagtttagtggtctagtcaattcctgaaagttctcaaattcataatagaatttgacagtttatcacttccaccttcttgtacttccttcacttagcttcctaaatatcatgttttcttatttcactgatcacactggctgctgctttttaggatcctttacttgttccaattcttttttacgactctaaatttcaagttctcagtccttcactattctctgctcataccctcccaatgtgattttattcagtctcgtggctttaaatactttctttacctcaatgacttgagctctaaatgcagatactgtacaccttacttgacctctccacttggaagatgtctattatatatctgtcttatatagatataacatgtcctgaacagactcttgatttctcaccttcctgaaacagctcttcccacagtcttccattatcagttaatgtggcaccgccatttacctagttagtccagccaaaagcccaggggccatctaccatttctgctttcctcactacccaaccctgactcaactcttactccagccaaatccaaagtcacgtcctattgccttcatattcaaaatatatgctgaatatatctatttcttaccactgccaccactgtagctttagcctgaacagccgtgatcttttctggatcaccaccagagccttctacatgatcttcctccacagttgtctttctccacaaagtaaccagagtcatccctacaagatgtccataggttcatgttgctcttctgcttaaataatcttcccctgttcccttcagaataaaatctgaacttctagcctgaccttaacaccctacatgatcaagttccagtctatgtctccagcctcaccatccttcttcctcgaacacaccaagctttttcctgcctctgtcttgacgcctgacgtttcttccacctgaaaagctcttccttcagatcttcatgttgctggctctgtcttaacattcaagtctttcagaggtcattccaaaaaggtcttccctgaccacctgtctagagctgcattcttgctcccaggatccttttatggtttatcctactttgcgttctttggagcacttaatagtatctgagatatattacttattttttgataacttgcttatctcctgatccctccatggaatgtagttttcatgagggtagggaccttgcatatgctgtatccctagtacctgaaacatatctggcagcgtatgtgttcaataattgcttcttaagtgaaagaataaataaataaataattcatcagttcaaaggagtatacatttttgtttattttgataaatatatacataaatatgttatatggggagatggggactggaactttttgatttcataaggaaatatgacttttctggaaagcatgttctttttttttttctttttctttttgttttttatactttaagttctagagtacatgtgcacaacatgcaggtttgttacatatgtatacatgtgccatgttggtgtgctgcacccattaactcgtcatttacattaggtatatctcctaatgctatccctcccccctccccccaccccacaacaggccccggtgtgtgaggttccccttcctgtgtccatgtgttctcattgttcaattcccacctatgagtgagaacatgggatgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgatggacatccgggttggttccaagtctttgctattgtgaatagtgccgcaataaacatatgtgtgcgtgtgtctttatagcagtatgatttataatcctttgggtatatacccagtaatgggatggctgggtcaaaaggtatttctagttctagatccctgagcaatcgccacactgtcttccacaatcgttgaactagtttacagtcccaccaacagtgtagaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtatcttttggctgcataaatgtcttcttttgagaagtgtctgttcatatactttgcccactttttgatggtgttgtttgtttttttcttataaatttgtttgagttctttgtagattctggatattagatagccctttgtcagatgagtagattgcaaaaattttctcccattctgtaggttgcctattcactctgatggtagtttcttttgctgtgcagaagctctttagtttaattagatcccatttgtcaattttgacttttgttgccattgcttttggtgttttggacatgaagtccttgcccatgcctatgtcctgaatggtattgcctaggttttcttctagggtttctatggttttaggtctaagacttaagtctttaatccatcttgaattaatttttgtataagttgtaaagaagggatccagtttcagctttctacataaggctagccagttttcccagcaccatttattaaatagggaatcctttccccatttcctctttttgtcaggtttgtcaaagattagatggttgtagatgtgtagtattatttctgagggctctcttctgttccattggtctacatctctgttttggtaccagtaccttgctgttttggttactgtagccttgtagtatagtttgaagtcaggtagcatgatgcctccagctttgttcttttggcttaggattgacttggtgatgcgggctcttttttggttccatatgaactttagttttttccaattctgtgaagaaagtcactggtagcttaatggggatggcattgaatctataaattaccttgggcagtatggccattttcatgatattgattctacctatccatgagcatggaatgttcttccatttgtttgtgtcctcttttatttcgttgagcagtggtttgtagttctctttgaagaggtccttcacatcccttgtaagttggattcctaggtattttattctctttgaagcaattgtgaatgggagttcactcatgatttggctctctgtttgtctgttattggtatataagaatgcttgtgatttttgcacattgattttgtatcctgagactttgctgaagttgcttatcagcttaaggagattttgggctgagacaatggggttttctaaatatacaatcatgtcatctgcaaacagggacagtctgacttcctcttttcctaattgaataccctttatttctttctcctgcctgattgccctggctagaacttccaacactatgttgaataggagtggtgagagaggtcatccttgtgatgtgccagttttccaagggaatgcttccagtttttgcccattcagtatgatattggctgtgggtttgtcataaatagctcttattattttgagatacgtcccatcaataccaaatttattgagagtttttagcattggagggctgttgaattttgtcaaaggccttttctgcatctattgagataatcatgtggcttttgctttggttctgtttatatgctggattacgtttattgatttgcatgtgttgaaccagccttgaatcccagggatgaagcccacttgatcatggtggaatagctttttgatgtgctgctggattcggtttgccagtattttattgaggattttttcatcgatgttcatcagggatattggtctaaaattctctttttttgttgtgtctctgccaggctttggtatcaggatgatgctggcctcataaaatgagttagggaggattccctctttctattgattggaatagtttcagaagtaatggtaccagctcctccttgtacctctggtagaattctgctgtgaatccgtctgatcctggactttttttggttggtaagctgttaattattgcctcactttcagagcctgttattggtctattcagggattcaacttcttcctggtttagtcttcggagggtgtatgtgtcgaggaatttatccatttattctagattttctagtttatttgcgtagaggtgtttatagtattctctgatggtagtttgcatttctgtgggatcggtggtgatatcccagttatcattttttcttgcgtctatttgattcttctctcttttcttctttattagtcttgctagcagtctatcaattttgttgatcttttcaaaaaaccagctcctggattcattgattttttgaagggttttttatgtctctatttccttcagttctgctctgatcttagttatttctcaccttctgctagcttttgaatgtgtttgctcttgcttctctagttcttttaattgtgatattagggtgtcaattttagatctttcctgctttctcttgtgggcatttagtgctgtaaacttccctctacatactgctttaaatgtgtcccagagattctgatatgttgtgtctttgttctcattggtttcaaagaacatctttatttctgccttcatttcattgtgtacccagtagtcattcaggaacaggttgttcagtttccatgtagttgagcggttttaagtgagtttcttaatcctgagttctagtttgattgcactgtgttctgagagacagtttgttataatttctgttcttttacatttgctgaagattgctttagttctaactatgtggtcaattttggaataagtgctgtgtggtgctgagaagaacgtatattctgttgattttgggtggagagttctgtagatgtctattaggttggcttggtgcagagctgagttcaattcctggatatccttgttaagtttctgtctcattgatctgtctaatgttgacagtggggtgttaaagtatcccattattattgtgtgggagtctaagtctctttccaggtctctaaggacttgctttatgaatctgggtgctcctgtattgggtgcatatatatttaggatagttagctcttcatgttgaattgatccctttaccattatgtaatggccttctttgtctcttttgatctttgttggtttaaagtctgttttatgagagactaggattgcaacccctgccttttttttgttttccatttgcttggtagatcttcctccatcctttattttgagcctatgtgtgtctctgcatatgagatgggtctcctgaatacagcacactgatgggtcttgactttttatccaatttgccagtctgtgtcttttaattggagcatttagcccatttacatttaaggttaatattgttgtgtgtgaatttgatcctgtcattatgatgttagctggttattttgctcgttagttgatgcagtttcttcctagcctcgatggtctttacaatttggcatgtttttgcagtggctggtgccggttcttcctttccatgtttagtgcttccttcaagagctcttgtagggcaggcctggtggtgacaaaatctctcatcatttgcttgtctgtaaaggattttatttctccttcacttatgaagcttagtttggctggatatgaaattctgggttgaaaattctttcctttaagaatgttgaatattggtccccactctcttctggcttgtagagtttctgctgagagatcagctgttaatctgctgggcttccctttgtgggtaacccaacctttctctctggctgcccttaacattttttccttcatttcaactttggtgaatctgacaattatgtgtcttggagttgctcttctggaggagtatctttgtggcgttctctgtatttcctgaatttgaatgttggcctgccttgctaggttgggaagttctcctgaataattccctgcagagtgttttccaacttggttccattctccctgtcactttcaggtacaccaatcagacgtagatgtggtcttttcacatagtcccatatttcttggaggctttgttcatttctttttactgttttttctctaaacttctcttctcgcttcatttcattcatttgatttcaatcactgataccctttcttccagttgatgaaatcagctactgaagcttgtgcatttgtcacgtagttcacgtaccatggttttcagctccatgaggtcatttaaggacttttctacactggttattctagttagccattcgtctaatcttttttcgaggtttttagcttctttgtgatgagttcgaatttcctcctttagcttggagaagtttgatcatctgtggccttcttctctcaacttgtcagtcattctccatccagctttgttccattgctggtgaggagctgtgttcttttggagggggggaggtgctctgatttttagaattttcagcttttctgctctgttttttccccatctttgtggttttatctacctttggtctatgatgatggtgatgtacagatggggttttggtgtggatgtcctttctgttttttagttttccttctaacagtcaggaccctcagctgcaggtctgttggagtttgctggaggtccactccagaccctgtttgcctgggtgtcagcagcggaggctgcagaacagtgaatattgctgaacagcaaatgttgctgcctgatcattcctctgcaagcttcgtctcagaggtgtacccggccagttgacgtgtcagtctgcccctactgggaggtgcctcctggataggctactcgggggtcagggacccacttgaggaggcagtctgtctgttctcagatctcaaactccgtgccgggagaaccactactctcttcaaaggtgtcagacatggacgtttaaatctgcagaggtttctgctgccttttgttcggctatgtcctgcccccagagttggagcctacagaggcaggcagtcctccttgagctgtggtgggctccaccctgttccatcttccaggccgctttgtttacctattcaagccttggcaatggcgggcgcccctcccccagcctcgctgctgccttgcagttggatctcagcctgctgtgctagcaatgagcgaggctccatgggcgtgggatcctctgagccatgcgcgggatataatctcctggtgtgccgtttgctaagacccttggaaaagtgcagtattagggtgggagtgaccggattttccaggtgctgtctgtcatggcttcccttggctaggaaagggaattcccttaccccttgtgcttcctaggtgaggtgatgcctcgccctgcttcagctctcgctcagtgggctgcacccactgtcctgcacccactgtccaacacgccccagtgagatgaacccggtacttcggttggaaatgcagaaatcacccatcttctgtgtcactcacactgggagctgtatactgcagctgttcctatttggccaccttgccttagaattcaaaagtatgttcttatatgaatctgtttggcttcctttgttcataggtgttttttcacagataacaaagaaaaactagatgatatatctaatgatgaaaaaaatgaattcctgaacaagataaaacaggtaagaaggcagaagtcatgacttttacattataattacatttcatttttagttaatgtttaaaatatgtgagaaatatagaatttttcaaaaggatgtttttcattgaccaataatatggttgtttgtagtaatttaaaaatttttatctcctcccaaagtactttaattatattaaagagcaaaggttgtccatgtacagaggaactgttttttggtaacttttcatgtgagtatgggtaccttaggactatccatgattaatggattaatggatatttttgatgtgaattatttagaaagttagaatcttcttgctgttgtgtgctacgcctgtgaagtgcagcaacctgctctacacttaagaatattctaaatattatatatcatattgtgatggttaatactgagtgtcaacttgactagatcaaaggatgcaaagtattgatcttgggtgtgtctgtgagggtgttgccaaaggagattaacatttgagtcagtaggctgggaaaagcagacccacccttaatctgggtgggcagcatctaatcagctgccagtgcggccaggatataaagcaggcagaaaaacgtgaaaagactagaccagcttagcctcccagactacatctttctcccatgctggatgcttcctgctctcgaacaccagattccaggttcttcagctttggtacttggactggcttcctggctcctcagcttgcagatggcctattgtgggaccttgtgattgtgtgagttaatactccttaataaactcccctttatgtatacatctatcctgttagttctgtccctctagagaaccctgactaatacacatattataatataatattctaaatacttatttagaagtatttgagtcagatttagcccccaggaaaattcactagacatttttcaaacttaggttaaaaaaaaatcatatcataagtagataatcatgtgagtaaaccaagatttagcctcaaaatattcaatgaagccttcattaggatagtgaaaaattgggggtgagggtgagtaatacaattaaaattcaaccaaaaggccttggttaaataagtatcagtattgctcataatacgttattgagtgacaaatactatattataaaacagtaggctagtcatggtggctcacgcctgtaattccagcactttgggaggcctaggtgagtggatcacctggggtcaggggtttgagatcagcctgaccaatatggtgaaaccccatttctacaaaaataaaaaattagctgggtgtggtggtgtgcacctgtagtcccagctgctcaggaggctgagacaggagaattgcttgaacctgggagacagaggttgcagtgagctgagatcgcaccactgcactccagcctgggggcagagcaagagtccctctaaaaaagagaaacaacagtatgtatgatatgatcccatttaattacttatacacacaaatatacatacacactagacataactgaaattcttcttgtcccttgtattgaaggagaaatatccttagtatctcttcccaacacctcatatatccaaacttaatttcctttcttttctttcttttttttctttttctttttctttttttttttgagacatagtctcactctatcacccaggctggagtgcagtggcatgatctcagctcactgcaacctctgcctctggggttcaagcgattctcctgcctcagcctcccaagtggctgggattacaggcttgtgccatgacacctggctaatttttgtacttttaatagagacagggtttcattatgttggtcaggctggtctccaactcctgacctgaaatgatccacccaccaggctggaatgcagtggcatagtcacaaatcactatagcctcaacctcccaggcctaggtgatcctcctgctgcagcctgctgaatagctgagactacaggcactcaacaccatgcccagctaatttttaaattatttgcagagacaggtcgctttatgttgcctcggctggttgtgaactcctcagttcaagcaatcctcctgccttggtctcccagaatgctggggattacaggcgtgagccaccacccctagccacacatacttaattttaattgttcaggacttgggtcaggtactctctgtctacatcctctatctttgttttgcccaagtcaaccaggatataaaattcacatttttcactagtttctaaaacaaatttaattacactaagcatttcatgatctattgcaaactctgttggaaattttagtggtcatggggagaaatcctgttgcagagcacaaagccatcttgttcaccaccttttctttctctcacagttcctcatctatcttcttgctgtaggataccaccccacatccaaattcttctccctcttttacaaagcataatatctgcctctgtacccatgccctgaggctcatcagggatatcaaaggcagctccctcccagaagaatgatttgtaccaattaaatgctttccatttttgcttttgtgagctatcagcatgagagatggcttcccctctgggctactgtgattcttttatttgcaaggatacctaacaacagacagaaaccagacaaggttggtttgttggctggttggttggtttcgaatttgtctttcattttgtgagcaaaatattatttttcctcccatttgtttcctactgcagaagctagtagacaactttctgacaataactccacattttctagcccacatgattttctgaacagtctaggacccctaaactggcatggcttacttggtcaaagagttttcctttaatccatagcccttagccaaattccatggttataagtgagtgatcacttcaaagaatgcaaggctcttgcttatttattattttcactagggtagaaactatgggctcttagtgacatccaatcataattctcatgagttattggaggaacattcaaagattgacattcaactcaaactttacctttttttcccagcatctcccctccctcaccagcccttggcaaccaccattctactctctacttctgagttcagtttttttttagattttgcgtataattgggatcatgtaatatttgtttttctgtacctgaattatttcacttaacatgatgtcctccaggttcatccatgttgtcacaaatgacaagaatttcttcttttttaaggctgaatatattcaattgtgcatgtatacattttctttatccattcatcggctgatgaacacctaggttgattctacatcttagctactctgaatagtgctgcaatgaacatagaagtacagatatctctttgccatactgatttcatttccttgggatatatacccagcagtggcattgttggatttagctttgttattataaaatattacacattacagaacaatacataaaccataaatatacaatatttatgtacatatttttgatgaatataatttattaattttaatgaagtccagtttatcaatctttttagttaatgttctctatgtcctatgtcatgagactattctcttctgttaccattgagaagctttgttgtttgacctttcacatttaagactacgaaccatctggaatttatgtgtatgtgctttgagatagtggtcaagattcatatttttccataaggttgtccaattaaccagcaccatttactgaaaatacaatcctttccttcactacattgtggtcatactattgtcataaatcaagtatagatcataaatgtatatgtggattgttgactctattcatttgaactattcatctctcctcacactaaaacaatattgtcttaattagtacctttaaaatgagtttttatggccagtggtataaatccttcacctttgttcttcaaaagtgttccagctattcttgaccttttcaattttgtcacgttcttccaaaaaacctgtttggattttgattgggattgtgttaaatctgtaaatcagtttgaagagggtttcacattttcacagtattgaggcttccaatccgttaacatggcatatgtcttttgttttagatcttctttgttccctttgccttagctgttcagttgcactatgatgtgtccaaattttcttttcatttttcctccttgggatttatttggcttcttaaatctgagaatttctatatttcataagttctgcaaaattttcagccattatgtcctcacctgtttcttttgtcctattctccctgtgttgcccaggctggtctctaactcctgggctcaagtgatcctcccacctccgcctctcaaagtgctaggattacaggcacgagccaccacacctggcctatagtagattttgattgctttgttttacagtattgattttactcaaatgttgagaagctctagatatttgttcatcttttaattgtgcattcttttttatttatttatttatttatttttgagacaggatctcactctgtcacccagactagagtgcagtggtatgatcatggctcactgcagcctcggacctcccagtctcaagcaatcctcctgcctcagccttccaaagggtgaagctctttggaatcccagactaaaatagtgggaggtttatgtaggctcaacacctggatgagcattacatgttggcttttgttccacttgccatgcaaaaaaacccaaaacttggttttcaagtggtttcttctatgttagtaagtgttttcaaggcagaggaattttaagtgctagccttaccgctctggattcttcattctcctagaattaggcctagcaatcacctattatcctttattttttatttttatttttttagattcaagcacatgtgcaggtttattacaagggtatattgcataatgctgagatttgggctgctaatgatcccgtcacccaagtagtgaacataatacccaataggtagttttccaacccttccccacttcttccctccatctttttggagtcccagtgtctattgttcccatctttgtgtccatgtatacctaatatttagctcctacttataaatgagaatatgcagtatttcattttctgcttctgcattaatccacttaggataatggcctctaggtgcacccatgttgctagaaaggatatgatttcattcttttttatggctgcataatgttccatggtgtattattaccacattttctttatccaatccactgttcatgggcacctgggttgattccatgtctttgctattctgaatagtgcagcaataaacatgagcacaggtatcctttcggtagatta

SEQ ID NO: 12870 - DNA, 19732 bp, Human
gccacatccactaacccttcttttcacaaaagatttctgtttagcatacatttttgtttgatagcaattttcccatagtggtacttctttcaaaactggaatcaatcctctgaaagtctaatgctgctttattaagtaaatttaagtcatattctaaatctattgttgtcatttcagcaatgttcacataatcttcaccaggagtagattcaatctcaagaaacaactttcttttctcttccataagaagtaactcctcatgtatttgttttatcacgagattgcagcagtttacttacgtcttcaagttccacttctaatttgagttatctttctatttccaccacatctgcagttatttcctccactgaagtctttgttatagggccaacaggttcatatgcccactctgcaataatagaccaattacaatgagacattatgttttgcaacaaagaaagagtataataattggagggcactgagaaggaagatagttggaggccctcaaacttacctcctcaaggaaatctgggctggagtttttaaggggttaatggagggtgatggactgaaaaattggagtcatagattagtcaggataatgaagataaaatcagtaggagttggaaactgcattctttggtgagtcagctccttgtggggtccttgagagcagctggcatcagggaggtccctcagaccagctgagtcagtagtttcatcagtatgctggacctgaaggaatacctcaaagagaaaaccacatttcaaaatgtttaagttattatctatagaacagttaagatgaactttaatcttgtaacaatgtctgcataattctaagacaatagccaaaaaactattaggaagcgagtcagagagcaagctaatgtaataattaatactgaatgtactacaggcttggtttacttttgtttttttttttcccctccctttgtccttcattaattcaacaaagtctataggaatagtttcatcttgaaactctctaaatcatacatgatggttgtaagaatcaacacgtaaatgctatatcataaatgaacctttaaaatattatgctaagtaaaataagccagccataaaatatcacatattgtgtgattccatgtatttaaaaaatgtccagaataggcaaatctatagagacagaaattcaagtagcagttgcccaggataggacaaatgcagaaagaaggggtagggagtaaaaggctaaagcttatagggtttatttttaggagataagagttctctaaaattgactcttacggtagaagcacaattctgtgaatatactatgaaacattaaattttacacaataattgataatttgtatgatatctgaattatacgtcaacaaatttacaaaagtttttgaaccacatttagctattttatctttagttctgtgtcaaagagactgcaggaacatgagcctctcactgctactcttatgcacactattctgaaatatattacatgagtcaggtgatgagtccatccaagatcattgatattagctgaattacagcacttaaaaatctagggctgggtgcggtggctcacgcctgtaatcccagcactttgggaggccaaggagggcagatcacaaggtcaggggttcgagaccatcctgccgaatacagtgaaaccccatctctactaaaaatacagaaaaattagctgggtgcggtggcaggtgcctgtctgtagtcccagctactcaggaggctgaggcaggagagtggtgtgaacctgggaggaggagcttgcagtgagctctcaaaaaaaaaaaaatccaaaaagaacattaaacgcacttgtgtaaacaggtcatctaccttttatttgtctctttgtcatccacatgctcagactgttaatataatgtatttactttgaagtgtaaaagttacattttaacttcttgactgatttatactggatgtcaccatgagaaatgacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggtaagtaacttttttgattggtaacatgaagatctaactttcttgtacctttgaagctgagtttgtataaagccataaagtcagggtagtggggtatttttgtaatgaatttatcaaatgaaattgtaagatgatctaccaaactcacaagcactatagaaaatgtaaattataggatcagttaaaactctgtggccatcactcatacagaagactccaggaagtcataagcctgtatattagtgcacctaagatttctttaagcaatcacatatctgttttattatacattttttcatcttaaaaaaaagtcagacttattcagaaacatcttgctgaatgcatactggtagattgagtagttacacattttttagaactatctatataacattgcagaaattgttttttcttgtatatttcagtcttattatttagtaattgcaatatgtacccatgttactagaacgtttcctccacagttgagagaaatgatgtctccatttcagaatcaaaaaccaatgcatgttatttgaagtttccagtgtttctattccttcactaaaggattggaaaccatttattttaaggctaatcatcttgtcaaagtgtgaacattaagttacaactgtatagtttttttttgaaactatgtatctttctttaaaaatatgagccaaattaaggttgaatgcaaatttctgtttcaacaagttctcaaaattttctagctgtaatttgcaaacatatttacctaaaaactaatattattatgaggttagcatgactcaaaagcagtagtaggtacaaggatttcagccatcatttcaaaataatcaacagttaacctgaagaaccaaagataaaagattagattaatgaatgggaaattagactatttgttagaaaattgtttttatgggtatggtagaattaattgatcacggagctcaaagagtggtttatacgtatatctgctactatcgaaggtttacaaaataaagaaatggagattaattctctatggcttgtttgtgattgtgaatatactgatgtgacatgagggatgcagttttccctcatgattctctcaccactttgcctttcttgtaaatacacatgggtaaaatatataatacataaaaattaaattatgcctatatacgaatatatgtattttttttcaaggcacaaacactttgcctacatttttgcccacattattctaacttctttcagaaaattacctagtttaattatcttgtgtcatctatcttttctttttttttcccccatcaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggtaaactattactgtttgttttgtctgctttgaagtttcagtacgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatgtaagaaggtactggccattcattcaaagaatatttataaagagattagcacacaccacaggtacgtgtatgggacacagtttctatcccaacacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttttaaaaaaagattccaagatgttcgatggattaaattgtggaagggccaaactagaaagagctgaccattgaggaaattttgtatgaattcaggtagcagatgatggaaaaatggactagaaagtggatagaattacctatgcctacttttacagtaatatgactaacttcatattgtgttgtgtggaaaaaagttaatacaaataaaccacttaaaatgtctctggcatatagttagtgattcagaaatattattttgcaattatggttatttttgttattactaatactatgaattacttaacatgtgtaagtcacttgagatattattcctcatttaatagaaactaattattcagcatttcaagattatattctctaacaaagtcctatggtcttctatatgacagataccctgtagacttgtttaaaataagacatatcagttttgacagtaagatgagcaaaatgaaattgtaaaattctaccacaagtgacaaggatcttcatcagtattctaacttataagaaaataatcccttaccgatataaatgtgtgattctattagtatttgcagccagacccagtgttcacttgattttactaaagcatttaaatcattctgcgttgagatcccagaggtttacatcttagcataaacataccctattagagcaggtgttttctgccttaagacaagcaacccagtaaagcttcctgggatagcttgtgtctcaacatcataagtgcctgagagagaagcacagaaaaaatgaacaacgcatgtataataaagaccaaataatttctaccactcgtatctgaatcgtgccctcagtttacaataataaaagaattctgtcatcatataacattatattctttatggaggaatataagaatgtaatatattttaaattgatatcacccttctaagaaataggtagaaagtaagcatttttattacattatgtaatctcttaagagataatttttgcctacctccttattaacagcaacatgaaactgatattttattccatggttaaaatccaatatctatgttgaatgcaaattgtatgggctttatatggtaactttctaaagagacaaaagctgagataagactaatgaaaattctgtcccaccctatcctactcttgaaagatttccccactcacattaagggaaactgacagtgccagtaagagggagaagagagtacgaggtgtggaaggataagaaaaagattgagtcgtagtacatgtgataattactaatactagctgttgttactaacttgtagaaagctttgaatgcaagtcaatggttgtgaaagccattctctaattgtttatcatgtaaaataactgcaaacccaatttgctttctattcaattaaatattagattctcagataatttatgcatactttaagagaaaaggacacttggcaaatgtattaagtattaaaaatgcatatagccattggttttataatatattcacatgaaatcatacagagaaaaaataaatcaagatgtacatatttaatatttatggaaaatattcataaaataaacatcaaaagtaatcaaacatctgaaattaaggaataattaaaaacatatactagatgcatactatagcattacaataattttatcaataaaatattcagttacagtcagctataatacaagtaaagtgaggtagaaaattataaatattacaggctgacacgttttttgtaggaggaaaaggtatatacaatcagaataaaattgtctaaataaacgtcacaagtgtacattgaactataaagatagaacaaaagccatgatgaaaacatatgtagtttacaaggtgacatctctcgacaaaaattttagaaaaaaaattattttctttttagaacttgcactacttctataaaataccttacatacatagtgtattattattttaaagttgtcacagaatgggaaacaaccagtccacatcaataatgaatcccctttagggattatattactttaacactgggtggatgaaggcggctctggacatcaagccactgaaacaaaacactgaacgtaagttacatcaaatgtggctacaggtaactgcaattacgcacaatacctggatatcctatgtattaccttgaatagcagaacaatgactctaacatcattaacactgatgtcttaagattaaaaatcatattttaaaaaatgcttagccatatgtggtctgcaaataaacatttggaatcttttttctttgttttgtagagaacacttaagaaaaagttttaccccaatgattaaatctgaaagtatttaaatttcaaaattggcgtacattggggaacacaggtcagaatgattcccagtaaattccagccaagtacatcttcactaagatttttatgtagtgtgggtgatctactcaagagggtgaccaaatctctgcagaaagttctggcagtctctcgcattctggtgcaagtgctgctgcctctgagacacagcaaaatgatgatgagaattcctcacatgcagttataaatagcacatcaatttaacagtgtgatttcagggaaaaattgttccacttaaacaatcacctgaaaaatataatcattcgaccatgtaactacatactgtacgattctgtattacaaatgagaatacagaattatttatagaaatttatagaaattccaaaccacaacagcagactccataatgtcagtgattcttaaccaccaccttttacagctacttttttttctcttttgaaaaaagactggaaaactctgacaaactttaagtgaagtgtaaaggattatagaataagataaatgtaggtttacgtaatcccagctgtgagtaacttttcctcagtgctcagagtcagggaagtcaaccactaatgacttcaaactaaaataattctgtagaaaacctgcctaaaataagcatatgtgatttagcgagcaacaatatagcattaaagccaactggtgccactttaaagaacctatattagtacttataatatgataagtgaagagtttgggtatctcctcaaatactgtgtaataactctatttcatttctccctttcacaaacgcacacacatacacacacacatatttacacaaagacccttaacagaggcaacctatctcatattatacatattgcaaaaaaaactgagtaattgagtcagttaaaaaacatcctttactccaataattcctgataaaacttgattttctctctttttataacaattctttcacagtgcttgctgtgctgataatctattatgatagaacaaattcttttttttcacaggaaatggaagagtttgtccagagctctggagaaaatggtgttgtggtgttttctctggggtcgatggtcagtaacacatcagaagaaagggccaatgtaattgcatcagcccttgccaagatcccacaaaaggtaagataaaatgttttaatggtgtaaaaaactactgaaagaggctgttaaagtttgtaaagaacccaattgtagaaacttcctgcctatatattcagctgttgggaaagcactaattatctcagatattaattcaaaatcaaaaatatgtatggaagatgataaactcatacagaaggtgtttttcattggtaattaatttggcattaatattgtgatcaggaataaatacaattaagagttgcaggtaaagttttggtattatcatgatactggggtcaggtaagagctatcaccaaattctgcccctgtgatttgatccttttgtttaagaactcctgagggcgatgtacatcctacaggtgttagaaaacgttacattttaatgagtaacttcactagcacaataacaatagcaggtatttcaaaaaggctgacatgcatcatgcagtttagtgttgccatgttacccagcctcgtgtacttcctgtacattttggaataggcctattcaagtgatattcagggtactattcagagaaaggaaggcctaggctgtcagacaactagtgtaaggatccgcagagctaggcagatttggagaaagagaaaaagcagcctgctttgctggactggacccagccaatgtctgaagtaggcagatgaaagagaaagggtggagatggatcctgctctgagggtggaccctgtgtagtataaaatgtggccccacaaggacgctgcactatgagattaacaactcctcccaatggaggcagcagaaggaaatatagaaaggactcaagcagaaggaagccaggcaggggaacaggttcagatgccccctccatagaacatagtaggaacatattttcttttatatagaataaaatgtgtatttgtcaattactttttagttccctgcctgacatatccttcttgtaatgacctatgctaatattttgccaaaaactcaaagttactttaacactgatgtaacaaatagaacttaaacaccgtaaattatttttttttaatttataaggattccttgggggttccaaaattagtaacttaaacataaaaatgtctcagctatagcaaaacatacgaatcactgttgtcaaaattttgtagcacattttctaagtgttaacaatcaattgaccaaaattcagcaaaatgcaattttgaatttattcaagagttgtatttttatttatggtaccaacaggttccttatttctacattgacaaaatatccaaaattagcaatactgagaatactctgaatttgtgtcaaaaattgtcacttgaaatttttcttggaagtagttcttgataatttgtaatttccaagaagttatacatgctacctttgcagcattaattgacttcttccaagtagcttattttatagacttgcatttttgtcaatcaaaggacatcaaactctgttaaaatgacttatagataagtagatataagtgaactacttcccatattactcaaaaaaatgaataaattaatattaaatttggtagatgaaaactcataaaatacattaaaaaagcatataggtcattagtaaattgttgttgctttttcacactagaattatgactacctaaaatttttaatgcatataattattaaaattttttatctttttaaaattaagttttattttttaacttttaatttcaagggtaaatgtggaggtttgttacacaggtaaacttatgtcttggggtttgttgtatggactgtttcatcttacaggtagtaagactagtaccttttagttatttttcctgatcctttctctcctcccaacccccaccctccaataagccccagtgtatgttattcctctctatatgttcatgtgttctcatcttttagcttccacttataagtgagggcatgtggtatttggatttctgttcctgtgtttgtttgctagggataatggactgcagctcacttatgttcctgaaaaatacatgatcttgttcttttttatggctacataatatttcatggtgaacatgtaccacattttctttattgaatccatcattgatgggcatttagattgatttcatgtctttgctatggtgaatagttttatatagagtaaaatgtatatttgtctgtagtaaacatacatgtgcatgttctaatttgcagtcctttagatacatacccagtaatgggattgctgggttgaatggtatttctgcctctaggattttgaggaatcgccatgctgtcttccacaatggttgaacttacagtcccttcaacagagtataagcatttctttttctatacaacatcacaagcatctgttattttttgagtttttaataatggccattctgactggtgtgagatggtatctctttgtggatttgaccagtgatgtaaacctttttttcatatagtggtttgccacatatagttttcttttgaaaagtgtaacaactttttaaatacttgaacttttcattgattatcttatttgtctaagctactattttgaaaaatcatgatttccttatatacctaattatgaaattaaggaaatgaaatatgagtattctatttacatcagtctgagtagttcttgttacttaacatcccttgttcttctcattgttaatctctttagatttctaacattctatgacttttgagttccactcatggaataagatattttcttcactgtaacaggttctgtggagatttgatgggaataaaccagatactttaggactcaatactcggctgtacaagtggataccccagaatgatcttcttggtaagtctctgaagaacaaatactgaatatattagtaacagattattaaagtgttaatagttatcatgaaacaagcttactgaacatttgttatggaaaaacttaaaatgaaacttctttatatttattttccagtcccgggggaaaagaataaatgataattgttggcattttatgatatgcacccacattctttacaatcagagtcagagtatctttatttcaggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagctcaggagttcaagaccatcctgggcaacatggtgaaactctgtctctattaaaatacaaaaaattaactgggcatggctgtttgtccctgcagtcccagctactcagaaggctgagtaggagaactgcctgaacccaggagatggaggttgcagtgagccgagattgcaccactgcactccaccctgggcaacagagggagactccgtctccattaaaagcaaaaaacaaaaaacaaaaaaacaagaacacattctttcatgtccatcccttttctgtgctttttttcttttctgcacatgatgtttccttatctaaattgcacctttttgttagttcaactggtaatcttgtattaattttttcagtctgaagttaaacacaccacatagccttcacttacatctccagcagaagtaggggttccttcctctgaagtctcaaaaacaattttaattcagttcagtgtgttatctaggaaacaccgtcacattcagattcttccattgtgcatttctcattttattcctatgaataattttgctaaaattcatccaatcctaggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttgtgagtataactttttttttactcggtggtctttatagataggttcccttgtgaatagtgagtatgacttttatcctttttataagcgactgatttcgaaagaatttaagtgatttaaacaatctgaaatctgcttttatttttgagtggttatttaaaaattttatttgaaccacatacatttaatgaataatcaattattgaaataattttctacacaaaaataattttaaagtgatatagataagaagacattttaaaataaatttgacgtaatcaatccacagtagaaaggaaagataaacttgacgtaatataataaaatattttaattcaatatctaaaatgtctcaaagtatatctgttttctcactgaaaaatttatttttattatcattattgtaacagacttgataattaaatttaatttccatagcataaaaccgacctatttaagtataaaatccaaatatatttagtatgcttacagtcatgaagccatcaccatcatataattttagaacatttgtatcaacgtaaaagaagccataatggtatagaagtcactttgcatgaccccttagccctaggctaacaccaatttgctttccttctctatagattattctctctacatatttcatataaactgaatcatataatttatgatgtgtaaatgacttcttttaccaagtacagtttttgttgtttttttatggtttttagctttatttatattgtgtgtattaatagttcatttatttttgcagcaatatattttataatatgggtatgccatattttatttgtctctttattagctcattcaccttttgattgtttccagttgtggctattaggagcattgctacatgtttttgcatgaacgtgatttcatttcttttgggtagatactagacgtggaatttctggctcttgtaggaactgtgtgtttatgaaaattgccaaactgttttccaaatgcttgttccatttgtcattaccaccagcagtacaggagggttccagttcatccacattgttgccaacacctgttattatttgtctttttgttataccattcttggtgggtgtaaaaagacctctcattgtagccttggattgcattttgattatggccagagatgttgatgttctttatatgtggttactgaccatgcatatacattctttggaaaaatgtctattttaatctttgaaacattttaaaactttgatatttgtcttattattgagttttatataagaactatttatgtattatggatacaatcccatatgagatatataatttataaatatttcgtctcgttcttggtgcactaacattttacatttttgatgatggtctttgaagcacacaaattttatttttagtgagtaaaatttttgataattgattttttcatactccaaagaaagcaatgcgcaaaatgccttgcccaacccagctactatcaattcagcattcataactactattaataatgtttttatgtaaaaggggcttcacctaaaggaatactttaaaagtactttatcacaaagaaaatagaaggataatgaatgataaagctacctttaaagaatacaggaaataattggaaaagaaacataaaacaggttagacaaatagaaaagaaatataaaataaggtagtagatttaaatgtgaatatacagatacttccattaaatctaaactgacctgaaaaataagaccaaataatgagtaaggacataaaacaattgaagaacacaattaacaattgtaatgttgtaatgtaacataacacacacacacatatataactcatacatatgtattctatatatcaactggaaggcatagttttctagagcatgttgagtaggtaatagttatttgaagttacatggggagggtcataaatcaagattcagtatgtatgaaaagattcaatatcataaagagtataagatccagccatagtgaatgtgagaaattataaaaatgataactaaaaaatctttaaattttgaatattaaatacactttagaatattttaaagtaaaaaagtaaatcataattatgcacacacttttatttcaacaattccactctcaattatataggaaaatatatgtataaatttgtaagcctattgctatatacaagaatgtttatgacagaattattaatagtgtccagaaattgttggcactcaaatgtctattgattataaactaaaaagataatctgtggtattctcaatcaatgaaatactacacagcaacagaattaaaccaacaactgctacattaaaaaaaaaagacactttgggaggctgaggcaggtggatcacgatgtcaggagttcgagacaagcctgacgaacatggtgaaaaccttgtctctgctaaaaatactaaaattagccaagcatggtggtgcgcacctgtaatcccagctactcaggaggctgaggcaggaatattacttgaacctgggaggtggaggttgcagtgagccgagatcatgccactgcactccagactaggtgacagagtgagactccatctcaaaaaaaggaaaaaaaaaggagtatatattacataattaatttaattacataagcaagtaaagctgaagtatgacctttgaagtcaggttaatacttaattggaggacaaaagcagtgactaaaatggtccaggaaaagagagttcttctaagaagattctgataccctctatcatgatctgagagatagtggtatcttcacttcgaaataatgtttaagatgatcttaccttattgggctgtttcacttagcgtatgtacacttatgttatgtgttttatgcttaaatgtgtattttagaagacgtacaatgtattttaagattataggaatcaaataagttcaaaataagcacaaaaagtagaggaaatcctaggggttctatcatagtgtggccaggaaaagcctctcttattggtaacatttagagggttgcctcaaaaagagatagaagcatgccttgagttgttgcaagaaagaatactccaagtgtgggtagaggggacgcaatgtgtaagatgctaggacaggagcttaaagaaaaatataaggccaatgtccctagaagacctagtgtgcatgggaaagtggagaagagcttgccagtgtctgataatgcaggatcctgaggaccaaataacagagttggattttattcttgatatgatgaaaagtcaggcaaaagtcttaatcaggggagtatcacaatctgacttttatttcaaaaataatcattctggctactgcgtgggaaacagtaggacacaaagagtagaatagaagcagagcatgtggctatgaggcatttcacccacatgacacaattcctctttagaaacttaaagatgataattctcaaattgtattttaaggtgtatatcttttaccacttaaaacggctcatgatgctgaccatgattttatacgcctgctggagaactaaaggagtgtaactggatatttcataacacaaagataaatgcttaagcaatgggtagcctttcttcatgatgtgattatttcacactgcagcctgtatcaaaacatctcatgcacctcatagaaaaatacccctactatgtaaccacaaaaactaaaaattaaaagaaaataaaattgctcatatgttctctgcctcaaataattaactttctcacctgaccctccatttttactttaaaaatatttgtcaattatgaaattccaatttaaaagccaaactttctatgatgactcaaattaaaatacacacattctatgtcaattctatgacatttactttgaatgatctggcactttaaaaacctttcgtggacttgatgtgctcaggcaaattaacttaccttctctttttttgagagggaagtctcactctgtcaccaggctggagtgcagtggtgtgattgtggctcactgcaacttccgcctcttgggttcaagcgattctcctgcctcagcctctcaagtagctgggactacaggcacatgccaccacgcctgggtaatctttttttttttttttttttttttttcatatttttactggagacggggtgacggggtttcaccgtgttagccaggatggtcttgatctcctgacctcgtgatccgcccgcctcgacctcggaaagtgctgggattgcaggtgtgagcctccgtgcttggccaaattaacttactttcaatgttgatacttttctgcttatcgtttagatataaagagaatgctatgaaattatcaagaattcatcatgatcaaccagtgaagccccttgaaagagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgtatagaaagtctcttcctcttgatattttgagatgattagtgctgcttggcttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttgaaaatattcatctttttttattctttgttttttaggtatttcaatagcttttgggtgacaactggtttttggttacatggataagctctttagtggtgatttttcagattttggtgcactcattactcaagaagtatacactgtacccagtgtgtactgttttatccctcacatccctcctacccttccctctgagttccaagagtccattatatcattcttatgcctctatgtcctaatagcttaggtcccccttataagtgagaacatacattgtttggttttatatttctgaattacttcacttagaataatggtctccaactccatccaggtttattttgtccattttgatggctgagtagtgtatatatatatatataatatatgtgtgtgtatatatatatattccccaactagtggctaaagtaaatgtgatatttatatataatatatattagatatatataattatatatgtatgtgtatatatatataattatatatgtatgtgtatacaaacacacacacacacacacacacacacacacacatatatatatatatatatctcacattttctttatccacccattgactgatgggaatctaggctggttccacagttttgcaattgtgaattgtgctgctataaacatgtgtgtatatgggtctttttcatataatgacttattttcctctagatagatgtccagcagtggaattgctggatcaaatggcagttctacttttagttatttaagggatatccatattgtttgccatagtggttgtactagcttgcattcccaccagcagtgtaaatgtgttcccttattactaccatgccaacatctattatttttggatttttaaactatggccattcaccatttgtatatcttcttttgtaaattgtctattcatgtccttaagtcacattttgagggattatttgtttttgtcttgctgatttgtttcagcactctgtagattgtggatattagtcttttgtgggatgtgtagtttgtgaagattttctctaactctgtgagttatctgtttactttgctgattatctctttcgctgttcagaagctgtttagtgtaattgagttccatctatttaactttgttttggttgcctttgcttttgggttcttggtcatgaagtctttgcctaaacaaatgtctagaacagtttttatgatgctatcttctacaatttttatacttccaggtcttagatttaattatttgattcatcttgagttgatctttgtataaggtgagagatgagtatccaatttcattcttctacatgtggcttgccaattatcccagcaccatttgttgaataggttttcctttccccattttatgtttttgtttgctttgtcaaagactagttggctataagtatttagttttatttctgaattctctattctgtttcattggtctacatgcctgtttttataccagtaccatgctgttttgttaactatagccttgtagtatagtttgaagtcaggtaatgtgacacttccagatgtgtgttttttttgttgttgttgtttgtttttttgcttagtcttacttgggctatgtggacatcaaagctgagaatcaaataaaaacctcaacccctattaaagcatctgcaataataataataataataaaataaatacttacaaatatacttaaccaagaaggtgaaagttctccacaaagaagaccac

SEQ ID NO: 12871 - DNA, 100836 bp, Human
  misc_feature (1)...(100836): n = A,T,C or G
tgatcccaggagttcaagaccaggctgggcaacataggaagaccccgcctccacacacacacagaaaccccacaaaaattagctgggcttggtggcacacacctgtggtcccagctacctgggaggctgaggtaagtgaatcgcttgagcccaggggttccagggtgcagagagctatgattgtgctactggactccagcctcggccgagcgacaccctgtctgtttctttccttttctctctctctctagctctggatcgtacaagaagggagacaaggaccactgacaagatatggtatgtgatactaatcagatttggcttctttctgtcctgcttcaccagaggctggactctccttgtttcagtttctccgctttccacagataaatcttttgtttcccggatagccacttggcctgtttgccctttgctcccatttttccttgtttgcttctttgtctgaaaatttatgctgtcctgctgcctccgctgggcttcgtttccacctttgctggaggagatttagctgacaacctcacagatcttccccgccccttctgccgagctgatctttctcttggaaatcttacccgcagggaagggcgagtgtccgtgcctgcctgcctgcctgctgcagcccgcgcaaagctgagcggccagggcgctgctgttcctttaaagtattattaaaaataatatttcagcttttaagtaactccttgagtttgaatcaaaagctggaagaacctcctgggctctatgagcacctctgaatatgtctgactctacattctagaggcttcaatatatttataattttggctcatagattctccacatcttttcagcttcaattcttgcttttcccagaaacaattttcaagcaggagagaatattgattggacttgattttctcagtttgggcagaggtttgcagacactttgcaggttgccagacccttcgtccagccacctgtcagctgggggtcatatggtatagaaagcagtcatttctatgcaaggtactgcttgggcctgcctccctcaaaggggtaggggatgcgggctggacaaagggctcgtgatcaagtaaagcactgtgatgacagctgctatttctatatctccctagacttgtcttctaaattaaaccttgactcctcccttccaagctggagccactgctaactactgggagagccttagcagataaagtctcatgcctccaggcgtttgtgcatcccattttctctgcagagtagaatctcccttctacttttgtgctcctggggacgtcctactcttcttccccagttggctctaaggttatcacatcggtgaagtgtttcattatcactttttagaagaaactgagtcttttagagaagttaagtgactttctgcattcatactcatactcaagaaaatctaactccacaataaccaaaaataaaaagtagaaaaaaacccacaagtgatgagaaaaaaaaaaatcaaaagttataaaaaataaatgaaaaaatgaaattaaaggaaaaaagattttttaaaaaagtaaaaaaaagaaaagaaatctaactccagagctctgacacaaaatgccttaggtgttattctcaatgagagaaaagggacgtgaatctttaagtgattaagtgaatctttaagtaaatctgtcgtactagtgtttcaggcggctcaaacaccacacgctcccgactacggcggaatggagagaatgtgcgcatgctcggcgggaatctgcgcatgctcggcgggaatctgcgcatgctcggagagaatctgcgcatgctcggccggaatctgcgcgagctcggcgggaatctgcgcaagctcggcgggaatctgcgcatgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggtataaagaaagccatggacttgggctttacccggactggggatccggagagggtggttcggaagcaggaatcgtgggatcgcggtcaagacaaagaatggggcaagagaagatcatggtggtgggctcagtcaggagggccgggaccgagggatgcgctatgagaaaagctggagatttggggctccaagacctgaatttgagcctcgctgactccacctcttccattacccacccatcccatccctcttctccctctctacctgctctttgtctcacctgcctccccacccgcctcccctctctctctctttatcccattccactccctagccccacttcctctattacttccgagcctgggttcttaagatctctatgagaatgaaaattagctgtgataaagcaactatcccacagggcttgttgtaaaacttaagagagggactatctgtgactaaaataacttaaactgtaaagcgtcgtattattagctttataataacgtagtatcccgcatttattgaaagcccactctgtgagggacggatctaaaccttttattcttatctcatttaatcttcacaaccccttgaagtgaaaactatttatccccattttgcaagtgggaaaaccgaggaataaagaactgtgggcttttcctggtgaaatccggatttgaatccaagctgtctggtttcagggccctggagaacccctgtgttgctagaaatctatgaccattggtgtcccagatcagtaacagaaattacaatgaattttaaagtgattttttttttcaacataaaagagtggtagttgtctctgaagggtcactagagggagatgtggttccagggattaatgaatttattcaatacagataaacaagatacgagtttgagcaactgatccctagttccctcaactcctcattgagaaatgttgattaaaacgatcatgaacttttaataatgccactcacctccttttttcgtcctctttcagctgctgaaaactttgtagctctagtggaggagctgtttgttgcagatgaactggaagtaaaattctaacagcctgtattgcttcggtatagaaatgaagagttgctatgctacccggtttctctttctcagttttcttactgctgccagataggaactcagaaatatagaccattctgcttccagacaataagttccatatttgaaaccctttgatggcacttactggatacctaattcatgacaaaagtgctttagtcctctagagttttctggtttaaaagtagcttttgtgggtgtgtatcaaataagtgcagcagcatattttgtgactcttaagtttttttaggttatcatgccccaggcattgaaactgggatgtgcattttactgttctcagaggaattttgtggtttattagcacgttttttttttcaaataatctaattttacttcagaaatctcttagtgcattgtgttgtttgtaaactagtgaaaaataatcttttcttttcatgtgttgcctgagatataaccacatttagaaatcatctataacttccctgataggaattcattcaggtttttaaaacatttctagggtcaagagatcacttaaaaaagagtagtttctttattgatcacttctaaatgttattttttatccctcgtatggagtcgcatcagtctccctgtaacttccatctgttgatcccgttgtctttcttggcagaccaatccttttatacaacagttgtcaaatatctggggggaggccagacacggtggcctatacctgtaatcctagcactttgggaggcggaggtgggaggattgcttaagccaaggagtttgagaccagcctgggcaacacagtgagaccccaactctacaaaaaaaatttaagaattagctgggcatggtggggtgcaactgtggtcccagctatttggaaggctgaggtagcgggatcacttgagcccgggagatggaggcagtagtgagccatgatcatgccactgtactccagcctgggtgacagtgagaccatgtctcaaaaaaaaggaaaaaaaaatggtggggaggaaaactgttatgttccctttaatcttctcatctgacttaaatatctagttatttccaactgttctttacatcatgtattcttcagattcttccctaagctgctcatttcatgttcatttgtaattaattttcctggtaagatgttagcccagaactgctcacagtttgtttgatcggtacaaagcactgcgagactatcagtcagagtcaaggaatgtgaactccagaaaggaccttaaacctcatctagtccaacagtttcctaccttttagtattattaacagtgagattaagtgacattcccaaggactcagaactaatgggtaggagagatgggactagatcccaggtctcccgattgctattatcttttttcaccagaagacccttcttttctcttcttgaattcactacactgttgatacagaccaacatatttaggcgatgaagtaagataggtgtggggaatgtggtgcaaaagacatttcacgttgttgattgattttataattcacactgaaattgtgagttgccatcaatccaggtctcttccagcttgtgttcaggtaaaatttggaagccaggtataaataactttacatgtattccttttaggttatgtttctcttattttcttagtctcctacatacgtgattgctatgtaatggcttgtgccttagcttatgtgattccgtctgtcacttacttgttcacatgattgactcctactcattaagactcacccaaggaaatccacattcaggaagccttttctgccccttcaccgctctggtatcccctccaccagtcttgagtggatgctcctcctgtgtctctcagtgcccagtgcatacttctatcatggaacattgttctggtattatttgttatctgtctgtgtcctctactagaatagatttggtgtctttattttagatcatcagtttacaaactgactcaaattgtcagggtatacctcttagcatatatatagattctagcagtcacttcttgtgacaaaaatgcttcataacaaattatgccccgaatcagtgacttacagtgaaagcatctgttctcatgtttgtaggtctgcaggtcagctgcagtttgtctgatgtatattgggcataaatgggtttaactctggcctgcaggttggcatcatatgtactcatcatgggtttattctggggcttaggccaaagaagtggcagctatctggagcatgttcctctcctggtagaaacttctgtagcttttagaaagtatcaggactatttaagggttttccatagtgaaaatttatatgtcttacacacattcttatgtagaacacatccctttttcacacctttcctaaatactgatacaggttcatgaatacaataagcaagggacattcttacagtcttttcttacgacttattttctcaaacactctttggaactttgtttccaggcagctgttgtgctgtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttccttacatgtactcacatacaacttcacctaccactagagtctgatattttttcttccctcgttttggccccttcactagatattacagtttttatcggaaacaagaggcagtaaaaagtaatgtttaaaagcacaatctctagagacagatggcttgggtttgtatccttgctctgccatgtcatttactaaccttctgatgttgaacaagtccctcaacttgtttgtgactagttcagttatcttttgctgtgtaataaactaccccaaaatgtagtgtctcaagtaacattttaaaaattcatcattcatggttctgtgggatgactgggttgctcagttgggtgattctctattgaggcctcttacgcagttgcaatcagatggcagctggggctggagtcacccaaaggctcaactggaccagatgtccaaaatggctcactcacatggctggaagacgatgctttctagtggctgtgagctcagttggggctgtccgttagaatctctacatgtggtttctgtatagtttcaattttcacatgaagcagctggttctaaggagtatcccaagaatgggttttctatgagaccctgcctatgtggcttcttaagacctatttttagaagccccagaaagtcatttctgttttctgttagtcaagcaagacactaaggttaggtcacatttaagggaggagaattagactccctctcttgataaaaagagtagcctgcaaatacaaggagagaaagaacggatggtggctatcttggaggttagctactacagtgcctcagtgtcccatgtgtaaaatgagaataatgatacctgtcacatagggtagttttgaagaataaaagaattaatgtagataaagtgcttagaatagtgcttggaatattgtaaacactatgtaagcatcagctgtttttatttctgccccttctacttggtatgactgccacttttgctaagtccatgagttcctgcttctttcattgtctactgctgctcctcctggacacttctgtttcttctgtgtgtttacacttccgttgggcactagtacttcccacctgtcattctagatttttaaaaatcttgatgacctggagtccttgaggtgttgtgtcaaggaaggtgctctaaccctgttcttggttatagttgtgttggtggaattcaagtagtgtggctgtcccctggtatgctgttagagaaggtaagtagacatgagcagggcaggagagagggcccccgagaatgttgggcatttgtgaagccatggttaggcaattagaaatccgtccctctgaagtgatgagcagggcaagggaggggccccaaagctgtcaggttatcatcgaggggaagacaggcgggcataaaactatcactgtaaggtaataagtggccatgattggtgtcaggaattacaggaatcttaacagacagaaaacacctggagttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcagtagcagggctagtgcgcatgcgttgattaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagattactgcggagtcgccactccggagtttctctggataactgccgacttacaccccagtaacaagagtataggtgtttttttgtttgtttgtttttgttgtagagagaaagagtcagaatcaggaagtcagaatcaggaacttagtgccagtcccatactacattcagaatttcctcccctcccatgactgagattttgtctagggcaagattaccttgccttaagatggatacttgtctaggcggcagatacctgcccagccagtatgctacgcatgcttgaatccagcagcaggcacccagacaccgttagtccatgtacaactgggaattgttgtgttgtttacagactaaaggattaaacagaccctacaaaaatgaagaatgacagaattccattatctctccatacagcactcttccccatcaatgtaaaaaggcttatgttaataattagacaggactgtcttttgtgtcagatactattttttgtttttatatttcattatgaaatatttcataaaataggcaaatatggagaatatacaggtaaccaattttcccattgtcttatgctgtaaatcctaatgtttcatatttgtttgattttttttttaataaagtgttacagataaacctggaggcccttccttaccctttttttctcttctccttttctcaggattttggtagttattaccatgtatattttatacttggacataagtatatattcataaatacttagtattgtataaagctgtcaaaagtgtaaatggttttatatgctacatgtaattctgcagcatatcttttatcaacttattttagatctattcatgttgatacgtgttgcacaaatttattcatttttactggagtatgatatttcgttgtataaatattctgcaatgtatttttgcattctcctgtttgatagtttgcttccagtttttgccctatcataaacagtgctgaagtgtaaacttcctatctgtacataatttttctagggtatactgtatatgcctgcccctgaaattgctgggatataggctatcctgcacttttttttttaacctctggaaaatttaaaccttagacattccataaagacatactaaaatcttttcacattacccatttttggttctctcattgagaattagagtttgatttcgctggaaatcatcaagaacacttactaccctcctatttccacacctcaacttctgctgaaatgaagggtgagacttatggtcaatgaaaaacatctgttcagaacctaagaattgtcattgtctgtaagtctcatgtttcatcccgcccaatactatatggccccagggacctgccatagggaggtctggttgtcctgctccctgaaggttaggtattttattgcttccagattgttctaatatggttttcagccatctgacatttttttctaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgactgtatcctttttctgccagagaagactttaagaaatttcctttattctgggaatcgtacagcagtttgatgagacacccccagagtttcagctatgagtatatgggtatattttgctctgaggagggggaggtaatgtgttaatagggtttaatgtgaaattaatcagtttaaaacagtgcctgggctcccagccctccactcacttccctgttctctgcatgggtgatactgagaggttgggaggcataggaagggggaagatcctagggagtatatgtgagcattgactatatgcagagggttttagtggtgctcgttagaaatgtttggaggcggatagaaaatatttttagaagagcatcctcccaatgttctctcctttttttctggatggaagatgtttttgtgccagaaatcagattgatacccaaagtgagatttccagtttactccacaggtcccctaattttaagggatcatcactcttgttctttttctaatcagttagtagtgctattcctgatcactgggaagtgctgttgtgttaggagtgacttgcaaatgctacattatggttcgcttcatatttaagaatggactgtggccaccaagaatgggttctagatactattaaatgacataatttttggttaaatgaatgcaatgtgttagattaccttttgtttatatttcttggttgtttttggcagaatatatagtttgatatatagaatgtatgaatatatgttagtgaactttggaagaagggcactcaggcaagtactttaagtcatcacatagttcagtgtccacaatttccagcacggtggacttcattggaaagagttgcgtgttcacatgaagagactgtttggtgatatccctatccttaactagctgagtcctggatgcactaatcgtgagcatggatgtgattcaacatgaaacaatgtaagtgttccaaggaagagagctggaagagaatctttttgcaaaaattgtatgggttaatgtattgaatgtattttgtgattcattgttaatcaagctgcatgtttgtgtgacaagagaaacattttatagaattgaatggttcagtccaacctctctgttttttaaaagttttaaaaggggaagggctgtactcggtgattatttctctggaagaaataaaacatttggcttatttcagtttacttcctattagacttaagctgattaccaggaattttaaaaaacactaagtggtataagccatatgtcattgatattaagtgcatggtaactctggccaacttcccttttttgttgtgtgtgtgtatgttttttgttgtttttttttttttgagttggggtcttgttctgtcacccagactagagtgcagtggtgccaatatagctcacagcaacctcagcttgatctcctgggctcaagagatccttgcatctcagcctcctgagtagctgggactacaggtgcacacccaagtccagctaattttaaaatttttatttttgcagagacggtctcactattttgcccaggttttctcagactcttggcttcaagcagtcctcctatcttggcctcccaaagtgttaggattacaggcatgaaccaccatgcctggcctgcttcctaattcagtatttatttaattattgtgccttggaagtgtatctctggagacatatatgtgcatgtacacatacctcttgcctgtcaggaaaatcatttgcactaaaatcccagacctaaatctgtgtaatcatttctcaatctctgtacatcctctgccaaatcttgccacacaaaatctgtgcatggagtcagagcaggatatttagaaagtgaacctgagcaaggctgaagttagagtatgctgggagaattctttgtttacattctgcctatgtggaggctgggaagggatattttttcatcacatttgagttcggaatccagaaacataacatttccataatacccagacattttggccaagatgttcaaagtataaagtgtatcagggttgattatgaatttaataagaacttaattggactactagaatgtaatcacatttattaactctagatccatttctaagcttctctcctcagtgaccaagtgtatttgaatttgtagaaaaataattcaggagaatgatttcttaatatgataactctctcttttagaggaaagaagtttgagaagaggcatattgaaatattcactgacctcagcagccgattcagcaaaagtcagctggatattataattcatagcttgaagaaatgtgacatctccctgcaattcttgtaagatcctaagaataatgcatgtagacaaatcctatgatttcctaatatagtgaatgggccctctgtatagagtacttggtttatgggaattttcgctttctgctccaaggctgaatctgtcagatgactgactactcagcaaacatttgctggttactctctgtgttctaggaactgttctgagtggtcgtgacaaaaagatgaaagtcagtgatccagaagaattgagcttagtggcagatcattgtttagtgttcttagactcaaagaattgaggattagaagaaccctttgaggatattcaatttgtctccttcctgcatagaaggctttacccaaacaattagcagattgatggatttttttttttcttaaacagctctagagaactgtgtcctatacagagtgcatgttttagggtagacaggaatgccaacttgggaatcattctaaatacataacatgtttatgtttaactcttttcagatccaaaagttgtggacacatatataaaatttaatttgcttctgttaattcagagatggagtataaaacttcaggggaaaaatatgtatttcacaatttattagggagagaattcctcctcaaaaagtaacttgaatattccctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaagcccagcacagcttctggtcctttttcataatctcaggatgcctttacatgttagaagcagactgcatttcagtgaatgtcattcgaaagagctactctttttttccatgagcaatacagaaaagtgcagaagaggaagcatagcctttgcttctatttgctttttatttggttgtatttttttcttggtaatatgctttcttcctgtgctacaaacctccagcatacaaagtagagttcatagttttactgtttggtgtattccatgtacagctgattgttgtaattggactaaaaaaataccagcagctcagagaagccctgtgttctgtttttaatttatttttaatttttttttttagaaacgtcttctgtagtggcatagttatagctcactgcagcctaaaactcttgggttcaagtgaacctcctaccggagccttctgtatagctgagactatagatgcatgttaccacacccagcagtttttagtttttcttggttgttgtttgtttttgagatggagtctcgcactgttgcccaggctggagtgcagtggtgcaatctcggctcactgcaacctccgcctcccaggctcaagcagttctcctatctcagcctccctagtagctgggatttcaggtgtgtgccaccacgcccggctaatatttgtatttttagtagagatggggttttaccatgttggccaggctggtcttgaactccggacctcaagtgatccacctgcctcgccctcccaaagtgctgggattacaggcgtgagccactgtgcctggcacagtttttagtttcttctactgactactgaggaagcttatttctgatctaacgcagaatagacagaacagttattatttctttttccaggataacttcctttctcttcacttttacgacatttgtccttttctggttattgctttgaaaacaggagtaacctgatgcaaaccctgtgtctcacactttcctccctggaaactttttacctgataaatgcaggacatgcaaattacatcatgctgtatttgctaagtatatgaagaaaaattgtaaacagccttattttaagtgtagcaaataaaatgagaaatcaccttaaaaacaaatttatttctcacagttctggaggccgggaagtccaagatcacagcactaacagatttggtgtctgctgagagatctttgctctcaagatggtgccttattgctgtgtcatcccatgtcaaaagggctaacactgttctcacgtggtggaaggacataaaaggcaaaaatggcaaaaagcctctcccttcaaccattttttttaaggtcgctaattccatttatgagttccccaccctcaggacttcattacctcctaaagggcctctgtcttaatagtatcatattggtgattaggtttcaaaataatgattttgggggacacgtgtagaccattacagtgtggaagaggccagtcggagagagtgaagccagcataaaggcaaatgaaggtaaaatagagacagagagagtaatccttgccacagttgagaccctgggtctggacttcctaaggccttgtgccaccctgccctttcagttacttggttatgtagtagccagtgattttccccttttacaaaccaaagaggtttcagtcacttgaaactgggagaatattggctaaggtaggtaagagtcgtttgacagatgagaaatttgaaacttgaaaaggttgactgatgtgctcattttctcatagctgatgagttacagttacaggattagaacactaactactgttgatctttcttaatagcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcaggtaagaattgaaaacattgatgggaatttttaattgtacccacgtaaatttctcttttgattagaggtctcccaaatgtttcctttttctgggccactctctaattagtcattgcttaatattctgagttttattaaagaaatagtacacccacccttaatcaccctttttaaagtttgtgttcttggcacatgtttctcatttatttccaggacctgtgtcagtgaagttcaggaatatatagataccatgagaaattaacaagtcaaattgcaaaagatgaaatagtagatttcttcattatgccaagcttgggatacattttttgggcccttttttttttacacatctacaaaaaacattattaattatagaaagtggtctcagatctgagatagtcagtatcttcttatcatcctattaaggttttagaaagtagcatactatggtatagtgattttttttttaaacttttgatcacaaagcagtttgattgagtgaaaaaaaaaaaaacctgcaatgtaaagagttcatagcctacttactttacgtgggcgttggaaaggcaaaatgatttaagaaaagtgaattccttgaagtaccgtataacaataaagcaaactgctttttcaaccatccagctagagactatggaagagaccatctcctttatccatcttattcttggttggaattggacatacatgcattttgagcaaagaacctaagaagaatcggtggcatctagaatagtgtgtgtcctatggggttcaatttggtaaaagtggcaatagagtactttacatagcagtatggcttgggtggttcaaattctcaggggtaatactgcttgatattcttgaattatttccagcttatcagtctgtacacaaaatactggctgtttaagcacattgaagtagtgattgaacaactagaatttttttaagtagctacagtgtatatctccttaatattttttctaaacgaccatttttaatatttctgatgagctataattgacaaaaattatgttctgattttctaaatacagacagccttgaaaaatgataggtaaatttaggaaacagaattgcccacgggattgccctaggaatcagtgaggaatcctgtgaggtgaagtttcttggcgtaatgtgttcttgtcacaatatttacagatatgtgttcctaagttgtttctctttcaaattttggaataaatgccttaagctaaacatattacccatgatatcacaaagaaaaattaggctggacacggtggcttatgcttgtaattccagcactttgggaggctgaggtgggcagatcacttgaggtcaggagttcgagaccagcccagccagcgtggcgaaaccccgtctctactaaaaataaaaaaattagctgggcatggtggtgcatgcctgtagtcctagctacttgagaggctgaggcaagtgaatcacttgaacctaggaggcggaggttgcaatgagccaagatcatgccactgcactccagcctgggtgacagagcgagactccgtctcaaaaagaaaagaaaaattagaggccaatatagattactctttaaaaagtgtttttgtttgttttttaaatttttctgtagcatatcagatagggaaattactgactatgcattgttttagcatttcgacgctactttgattttaggtctgccatgaaggtgtagaccagaactttgccatccagtacagtagccattagctacatgtggctatttaaattcaagttagttaaaattaaatacattttaaaattgagtcccttagtcatattatctgtgtttgaagtgtctattgggctagcatggttagaaatagaacattaccatcattgcagaaagttgtactggacagcactggactagattatctccatatagatcttaggaagagaacttgacatctacctgaggagattgagctctactgcagaactgagtcagttgttcttagattttttttgagacagggtctagctctgtcatccaggctggaatgcagtgacgtgatctcagctcactgcaacctctgcctcccaggttctagcaattctcatgcctcagcctcccaagtagctgggattacaggcatgcgacaccatgcccagctactcagatcttatatattggatgcccgtctttagaattttccctgaaatagaatctaaatctcatggtgattttaggccatgaggtttatattctgtttgactagtaatgttgtatgagacacgttagacctggttcagacccattcattcctcagcaaatccaaagccattgtgcaccataggctttggaagctgggtgtcaggtaagatatctactattcgttgtaaattatttctgaaaattggagtctcttgcgacctgtctgtccataactctgtggataatgtaaaataattctctttaccactttgtagatctgttttttatctgtaccaaggagttcagccagaaagtctggactgtatgctttgagtgtattttgtcattaatttctttgctgcttattttagtgaataccacaaattccacctatctcctatcatcttccctgttgtgtttgattatgggccagatgaaaatatgattgattttcacttttgtttaaatgaagcagcactccacaacactgtttgcacctctccccagcttttcccaccagtaagaaacctagagttaacgtgctttaccttgagactaaatatgaactaaattcctttattccttggatagtctttaactctcactattatatacatataaaaatgtgtatctttaatattcagaattggaattaatgaattatagagttgtaaacagtgatgataattataggatggtgccctccctttgatactctagaacagaggttcttttttttttccttttttcttttttttttttgagacaaagtttcattcttgttggccaggctggagtgcaatggcgcgatctcagctcaccgcaacctccgcctcccaggttcaagtgattctcctacctcagcctccctagtagctgggattacagccatgcgccaccacacctggctaattttgtatttttactagagatggggtttctccatgttggtcaggctgatcttgagctcccgacctcaggtgatccgcctgccttggcctcccaaagtgctaggattacaggtgtaagtcactatgccggccctgagcagaagttcttatcctcaggtccgtggttttcagggagttggtagtgaatcctttatattgtgtgcagactcattcatgaatgtgcttttatcacatcctcaaaggtgtgctggtcctgaaaaaatgttaagaacctctggcagagttgaaataaagtattgaataagaggaaaatagagctgttcattttcacctgttagtaaagtaattcagctcctcttcccttctaagccaactcactcttgccctggctatatctcccaacttgtggttgttgttttccggccatctcctgctgtttctctctttataattaacattagctcacttctcattgtagaaaatcaaatgcatcatccagcacaagttaacatttaaaaattgttgctttcattttatatttttctttattaagtgagagtctgagaaaactgtgcgtcttcaagaaaattgagaggcattccattcactggccctgccgactgaccattggctccaatttgtctataaggattgcagcctataaatcggtaagtggcaggtacacatttttaacagaaatgttaccaggcagataaatatgtgtatataaggaacagacaattcatgtgtgtgttactcggaaccataattactgcttttctagttgttctccctgctcatttaatctctgtttagctttttgtgtaaaaggcaggctaggagaggaagtttaaagaattgtctataatagagtttgatttcctcctcttttactttctctccattggtaattgattgttaatcataagttctaggcctgtctcttttttttaaaagaaagaaaatgaaatgcattaagctgtgttattgtagtatcatagcagaaatgtagataatgcaccaaagttaagttcagttttggagctcagtgacacctaattcaattatgaatgatctgatagtaacaacatctgtgaaatgtaaaaaaatgttttgttactgtaaaattgcattttataatatatgtacatttatatacaatagcacactttaaaaaatgagttgcttttggtgattatttgatgaaattctagtttgagtaggaatctgatgcgtgccttcatataagcctccttgcctttttcctttaagtgttcaaaataaataggaacattttagacatataaaataaatatacaaaaacatgtttttatgtatttagtttttttctttgtatattaaagaacttaattccaaaatacatgatatatctgtgagaaccttggggcagttctttatttatttcagcttccatcaaagcctagaatagtgtccctaggaatgtgaatatagtctccctcctcttttattttggcctgcttttcaaatttctttgttgatttctgacacagatatattgcttcttttttttttttctattggaaactatgataaaatgtatagtcctctttttattaaacagtctggctgggtgcagtgactcatgcctgtaattccagcactttcagaggctgaggtgagcagatcactttaggccaggagttcgaaaccagcctggtcaacctgtctctactaaaaacacaaaaatagccaggcatggtgatgtgcgtctgtagtcccagctacttgggtgtctgaggcatgagtatcacttaatcccgggaggcggaggttgcagtgagccaggattgcaccactgcactccaaactgagcgatagagcaagactctgtctcaaaaaataaaaataaataaataaaaatattagacagtctgaggttttgtatagaaagtgtgaatgtaaatatttgtggattacttttgggagaaaatgaaatgtagagaaggttatccagtatattttgtcatgaaataaactaaaattttcataataggcatgagcaaacaaaataatggagctagagtaattgttctggatttttgtctgtgccagagagtgtattaggttttcatcttctatcaattggaatcctaactttccttgttttccctttgtgttttggaatgtaagattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcaatacttggctttattttaaagtttgaaactcactagctaggagcatgtttaatatggttgaactaaggtttttttgtttgttttatttttgactttcatggtgattattcttctaagggccaacttcaggttttatgtcctaccagatatgcttccttaatttaggggctgaaaattatttgtatttattatattgcttcatattaaataggattttttaaaagttgtactcctatgttatacccatttggattgaatagtgtgtctagatggcatctttatccagaggacttagaaactagctgaggatatctgtatgttcaagacctaaaattattaagataccaaatgatggttaagatagaaacaagagtccttagataaatgttttgccaggctattcactacccagtatagttttgatttgcaagtcttgaaaagaattcttttcctctgtgacactgtatttcatcttacagtgtatatatttgtgtgtgttggaggagggggttgtttaaaggtggtggtggttatgattccttcctttctcctgatggattatatgtagaatataattaataccctacaatttctaccagttcttgaattcaattctgtagcatagaacatgaattttggaatcaaacctgggttagaatcatggttccatcattggttaatcatttgatcctagtataatgactggctcatagtaggaagaatagcatgattaaagccacaagacctggaaagtagggggacttctcagagatactaagtagtccacttgggttggtgtattgagcatatacaggttagtacttgagggtaacatctaatggacagcctgcattttctcttttaatcatcagcgaccatcttataaagcaggcactctttgttatttccattttatagataagggaactgaggctgaaagacactcgttcacatattcaaagccacacagttctcaactagcaggacttggatctaggcctgtactgcttcagagtctgtgcctgcattctattctgaatttggactgagtaatgaagggctttggataataggctaagagtttatgcataaccttgaaaacaacgtggagccacttacagttttgaggaagagaatgtcactggggctatattttaagaagattaatatgacaactggttgtaggatggattggaaggagaaggatctagtgataaggatggatgccagttcttttggttgtcagcaaggaaggcatccctggttatcttaggcaaaaaggaaatttattgctggggcaatggagagggaagagttaaaaactgcttgggttcaaagagcgtagaagtgcatcttttctcctgtcctccagtttccagcccctaatcagctagaggtttttgctttttgttttttgttttttcttgaactaagggaccagtatacacatgtgggcaaaggaatctggttaaatgttgtagtctattgtaagtatacaatgtacaaaagttggagttatatgccatttcagtagatgaaccagaaaacatgaaacagttttagttagaatgttcattacaagttacacaattcacacgattcaagtaagatgatgactgatgacagagattaagacaaacatttggtttaggtaccagtcttaatcatgtgccatacatttccctgttaattttttgttggaaagtttggttttgtcactagctttttaaaaaagacatacatggaaataaaaatgtgtttctattttgagacggagtcttgctctgtcgcccagactggagtacagtggtgtgatctcagctcactgcaacctccacctcccaggttcaagtgattctcctgcctcagcctcctgagtagctgggactacaggcgcgtgccaccatgcctggctaatttttttttgtatttttagtagagacagagtttcactgtgttagccaggatggtctcaatctcctgaccttgtgatccacctgcctcggcctccccaagtgctaggattacaggtgtgagccactgtgcctggcctaaaagtgtgtttctttttaataaaataaatgtcatcaacagactaacaggaacaaataaacactagatcacagaatctgtccctggatatgaaagttttattgtgtcttggggtaaagatgcatgtgcttttcctttgcatttgtccaaggccagaatccttggattttgatgctccttcttcccacaaaacatagaagatactgtgtattgaaagggtgtgatttttcatagaatataggctacagaacagggctggacttttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattggtcattttatttataaggtatatttatttcacttttaatttttctaaaatgtagtctgggggttaatgttgccatggtatgtattttatacattgggaaactgaggttcagagccgttaagtaaatctatatgagcatagcaaactaaaaatacaggatggtttttgaatggggaatggaagcggagatgaggggtatttgaattatgtgggcctaaccctcatccctttgaggttcagtcttcttgagctggtattatggtgaaagtgctcataatgtctcaactctagaggtgggagggcataaaaatgcatgagaaacattgcccaatacagcacattgcatgttcttgaaaataaaccgcaggctccagatttcatagatcagacaaagttgatcttggtagataagtgcaggtggttatgattttcagaactcttcaatactcattttctaatctggtattagtagagctgtcttgacccctcttgatactgtgctagataagttaattgaatttaagggggtggggggagagacatgcagtacttatttttgatttaatttctctttctttcaacccttcccctctaagtcttcactcaagcctctactgttcatcagtgcctcagtgttactcttaggaggaaatgcaaaccacttagctttgtttttaggagacttcatcatctgatctttgttaatctctgtaatctaatttttcacctttcctctcacacagtggcactgtactactccaagagcagttctccaaatgtaccatgcttttacagcactccagacttctattgatactgttttctctgcctggaacgcttgtgcccagacttttctcttagttcctatttgtccttttaagtctcgacttaggtgtcaccgtttgcagaaaccttccctgatccctcatgaccaggcttggtgccctccttatgtgctcttaaagcaccatgtaaccctggaccataatactacactgcagttaatttcatatttatctattgaagctcctcaagggcaagattatgttttgttcactgttgtgtttacagtgctcagataatcttgaacgcatgctgggtgctcagatatttgttgtgttgtattgaattaaacttcaggtaataaggtgtttttagtatctgaatgtttttcagtaagaggattttgaatggaatttcttggcaatgtgtgtcatggttatacatgttacttattttggatcaaaagcaattcttttcctctcttgtaggttcagagaagattcttcatgggaaatcaagttctaaaggtctttgcagcaagagatgatgaggtgagttggcagcaggtctttgaggtagtgctacagaattgaattgtaagtctatgaaagcaagttgtttggggcttttatagtttaaaatgacatgaattcttgcaataggagtggggaaatccactgatgtttaactgaaaatggagatgtggtaaatggatttgtgttagcatgagcacaagacccgaggacatggagaccaaggaagtattaaaaacattttgaaccactgcatttaggaatgggaatttcacagtcaaatgttaaggagggttggggtcaggttgacattttgtgttgtcataagcatcctggatgtgcacttcagtgactcactagactgcttttgtcattgaggaaatgtgtcttttctctattcctctctcttggtactcttcctgcctccccaagatactctgttttcaggctggtttttctctagctaacagcctatgactgctgcattctatactcacatctgccctttctgtaaatatttactgtttgatctccaagttagaactaactttgttggagatactgattttaactggaagattgcaatctactatctgtttaaggcagctcaagcaggtttccaagttcctgaagtatttgcatttgtaattaataaactggatgtagaaggcttgtttggggtgggggtagggtggtggtataactagtatagttctctttttctcctcacttctggaaggtagctggttgctgatatagtggatgggtatgccattattatctcagaacagttaagggaagaaaatgtttggcttctaccctgttctgaatgaattattagagcacaatattagcatacatgaatcttcaaatttgagaatcctacttcatggatttctcttgaatcaaatcctgttgggaatcatggaagtctagtatatactgtcaaaccacaacttagctgaagttttattttgttttgtttttttaagagacaagatctcatatgtttcccaggctggcctggaacctctgggctcaagcgattctcctacctctgtttcccagatagctgggactataggtgtgcgccaccattccttgcttctgctgaagttttaacttccacttactgtctctttatgcaaagaacattctgatcacttcatgagacttgctgggtatgcagtgaggaatcacaaagttgtgttgagacacacgtgttgggtaatgatgtaggcttgctagctaagggcagccttgtggattgtgtaattcaaatctggccttatacaacactaatttctgtatatcataggatcactttgagataactcaagaaaaacagatttatctcctaatggcaaagggatactctctagtgtcagtttttgaggtagtcaaaaaatgataatatctaattggagcttctgagataagcaagggagtaaggaaacaatgtcatatgaggacttccagtaaaacaaaacaaaagaatgcctggagaagacttgtgtaggtaggcaggggtgtaggagggatggcagacataatagcactcttcatgcatttggagaattatcttgtagaatagaaattaaactctgcttcgtatcagaggggtgaactggaaacagcaggtggtgctttttgttcaagatgaagaattattttgtcaacaaggattactgtccccactggattgttttcttgtaagatgatcagatccccatttctgtaagtttacaataaaagtctttatcaccactagtcagatgtacatgtggattgttaaactagatgaatactgttgttttttagctcaaatattctgattctttggataattccctctttaaaaagttttctctggtcattagcatataattttttgtattgagaatctatactttcatgtgctgatttgcactgtgtgtagaaaacaaggagggaaaagaaaggaaggaaatggagctttagttaagttatacacagctgtagtactgtttcaccatgtagcagtcattcacagccccatccttccttcttgtttttttttttgttttttttttttgagacggagtttggctttttgtagcccatgctggagtacagtggtacgttctcggttcactgtaacccctgcctcccgggttcaagtgattctcctgtctcagcctcccgagtagctgggattacagatgcctgccacaacgcccggctaatttttgtattttttgtagagatgggggtttcacgatgttggctaggctggtcttgaactcctgacctcaggtgatccacccccccccctcctcggcctcccaaagtgttgggattacagttgtgagccaccgtgcccagccccttccttcttttaaacatcctaattggtcctgtcaaagacatataaataaaaacttcaaacaaattggaagtaatctcttcctcagattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcataggttttttgtttgtttgtttgttttgtttttacaacagcatggctgggaggtcataggtttttaactttgataaggttaaccgtgatagtgagagaagtacatagtgtttggggagtttctgcagagagagagagagagctgactaaggtaaatctggaatggagagggtatcaatttactaagcctagagaaaaggttagaagctggagagccagagattagtaaaggggcattctagctaggaggtaatggtatgagcaaaggccaagtatgagacctgcccccagtcagtgatcagctcagtgatgccagaatagaggaacgactggaagggagtgacgtgatgagctctgggaacagaggtggctgtcagggaagagatggatttgagagacagtatagaggtagaattggtagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaaagtgaaggatgagaatggtgcggtggcattatcaaagaccggggtttccagtgtggttgattaggcaatgatgttaatggaaatagggaatccaggaggagaatgagggggaaagatagtaagtttaggttttagtcttgtcgtggtgaatgtgaacagttcatactgaacagtttgagataactgaagatgccatgtcagatatccaccagctagcaggcagtctaagtctagatcttaggagagttttaaaaatgaatgtacaggcctggtgcggtggctcacgcctgtaatcccagcactttgggaggccgaggcaggcggatcacctgaagttgggagtttgagaccagcctgaccaacatggagaaacctcgtctctactaaaaatacaaaattagccgggcgtggtggcacatacttgtaatcccagctacttgggaggctgaggcaggaagatcgcttgaacctgggaggtggaggttgcggtgagctgagatcacgccattgcattccagcctgggcaacaagagcgaaactgtgtctcaaaaaaaaaaaaaaaagaaaagaaataaaagaatgtacagatttttgattcatcaactcatgggactggatgaaataatccccaagtagaattttagagtgagaggaggagggaaaggtctaaagtagaatttacaaattggtggagaaaagagaataatcaggggagaatgttgtttttgaagccatgaaggagaaagtatatagagacagtggaatggtgagatgctactgtcaaacaaaaaaatcgagaaccaaggagttggcaattagaaggtgatgggtgacttcagaggataatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgatatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctttggatgacttagacatggtggccatagttcgatatgcttatgacaaaagagctaatcctcaagtcggcgtggcttttcctcatatcaagcataactatgaggtaaaacccaaagtcttaatgttattttttttcttcagttcctttattctaagcagtgtttctcagctgttaatgttcatgacaattacttggggatcttgttaaaatgcagatcctcattgtgtagttctggggcagggcccagattctctgtttctctcgagaaatgctgatactggtctgtgaaccacactttcggttggaggaaaaagtatacgttataaaaataatataagaatcttttaattataaagtatcataagaatctttttattaagtattatgaaaatcgttttagattaaaagaataatcaataaaggttcaccatggccttttcttggttctcatccttcttgacttattggaaccaaatagagaaattacctccatttttacaaatgagaactatgaataaaggctgaggatatgattttgttgtgatctttgtgaaacggtttatttagggctctcttgtgtaaaatacagttctaaattccttatcatttcctctgtctcagagaacttactgtggccgaactggaaagagaaggcacatatcttgacttccaggtcaaccttctggtcaccccagtcttctcatttgttgtattggtcatgcatttgatagcagtcctttagtattcttttatacatttctcttatgcttaatattctttatactgtttgcagttgtgaacagccagtagcagaagtcaaaacacttcacttttcatatgccagagttgggctgtccgatttttgaaatatttctgttatgctactttcacagaatttgggatcagttttatattttttcattaatttcatcgtttctgcttttaccccctttctttctcattagtgtttagtgtatgtgcagctgcctttcatggaagacttgcggcaatacatgttttcatccttgaaaaacagtaagaaatatgctcccaccggtgagtttgttttcatttagatcactcattgactacacacactgttcttgggaaatcacctgtctgctagttgttggttggggctaggtatttatagggtgcaattagttggatttccaatcatacacttagacacagtaatgatgaaggtggtttacttggtgtttttccagtagtagggataggtttgccttaaactcacccaacactgtctagtttttgccttggagcatgtacctaggggaaagcctgatggtaatggatgtccatctctagttgtgagcagagtttgcccctgccgaagtgaatctgagcagtatcaaacctgtgactttagtgttctgtgtaaagtctgatgtagctttgaaatgaaaagtgacagtgctgaagattaacttttctctttgccctgtttttgtagtttgcaccaacagtccaagtctcattgttacttatttctggcttttaggagttacttcaggcttgatgtgaaagctcctgattgagcatctggctgcaaatgtcagggtcctatatagaattattcttagagccacaggtccagtcttccagagagcctgtcatttaaaacaattgtaataaaatataatagggggcagaagtagaaaacataccaaaaagaacaacaaatgatgagtagatgttttaggttacaagtttatatataatgtctgtgtctgtgttaagattagggaattgtgaggtgagtctcggaactcaattctttctgttattttggctagaccctttggaagtagtgtgctatagaaaggccaagaatcagatgggtccctagggcctgtatctttatcttccttctagaaatgagtctgtctgcatcacggtggaggcaggcatggacctgattatatggaagttgccactgtattacagtattactctgtctctatttcctgataattccaaaatttaaatgagtagaatatttaattatttatttatttgagacagggtctcactctgtcacctggctggagtgcagcggcgtgatcatagcttactggagcctcaaactccctgtgtattagttcattttcatactgctgataaagacatacccgagactgggaagaaaaagaggtttaattggacttacagttccacatggctggggaagcctcagaatcttggtgggaggcgaaaggcacttacatggtggcagcaagagaaaatgaggaagaagcaaaagtagaaacccctgataaacccatcagatctggagtgaataaatctatagacttattcactatcatgagaatagcacaagaaagaccagcccctctgattcatttacctccccctgggtctctcccacaacatgtgggaattctgggagatacaattcaagttgagatttgggtggggacacagccaattctggctcaagcaatcctcttgcctcggcctcctaagtagttgggactacaggtacgcgccaccgtggctggctcatttttaaaattgtttgtagagatggaatctcactatgttgttgtggctggtcttaaactcctgggttcaaacaatcctcacatctcagcctcccaaactgttggaattatgggtgtaagccatcacgtccagcccagaatatttttaaaaacccagtttattgataatttattttgtcgacataaatcactcaggatctgaaacattaaatatcttctgttatctattttctgtgagttaacatttgtttacattttctccattggaaaaatggaacattaaagttatttcatgtatttcccagtagatgtctatgtaggaatgcaatgccaggatgatctggcctcctgctaccttgtagtagtaggtgaaaatcactgaatgttcacatgtacaagtactgccccctacctgttgctgggagggccttgaattagcaagttcaagatggtgttggctgtgccattgcctgaaacctccatggtttcaccatgaaaagtccataaatgggtaaaaaagaaatatctgatgataaatatctgtatgctcttttattttgttgtagctgtacaaaagggatatttgaaaaggtgcagaatagaagtataatgtactttttaggaactacttactcttttccaccttttgcctggtgactgtgaatgttccagaaatagtgcctcaggttcaacagctgaactgctgtatgaatcagtaaaatgaaagttacacacagtagtttaggcagaagtatttttgggagaattgcctttcgtccatattgctttgggctgtaccatttttattgactgagtagatttttattgaggagcacttgttttttattagtattaggagagacctaaggaaagaggatgtcgtatttctgctctcatggaacttgagagtttgaatggagtagggcaagacatgtacgcaggtgtgagtagtgtcatggaggcattaagagaggagagagcttattcagcctcagtagattgtgaaggaatcagctcaccctgatccaatggtgtcttcctgttaaggtgctgtactctgataaaagttatattaaagtcattaaaatgcttatgcttcattaccagagaggttttttctttttaatgtttttcttctttagctaattactagtttttaaaatattagctcaatggatactaaatattttgttccagtctccttatagggattggtttttatatggctgtattcctctgaaacaaactttcttgcttttgatctgatactccattgtcagaggctcactgaatggtagaactggaacctaatcagtcagtcactctaaatcgatcttttcatggataagaaaaccaagacttgggttaaatacgtgcatagctagagaatactttggcagggccaggactgtataacctgccaatattgccgtggatatctctacgtagaaagcatttgttttagtggagaataatggaaataatcatttttctttcggcttctctgtttaagaggcacagttgaatgctgttgatgctttgattgactccatgagcttggcaaagaaagatgagaagacagacacccttgaagacttgtttccaaccaccaaaatcccaaatcctcgatttcagagattatttcaggtaagagaagaaggatgaacaagtcatatttcttttaaatgaaagagagctaagtgcaaagttgcggtaattggccagtcctaaataaatgtcttttttctctgaaggccccatttgctctatttaatggaagaataacatcttcctctcctacttcagaaggtaaaaatattctgagctcttaaaaagaaaaataaagttggaatgctttctttcttttcttttttttttttttttttttttttttttttctggaagaagcttactttaacaaaaaaaatacaggaaggccagttgcctatgctggagtgcagtgttgtgatcatagctcactatagcctcaaactcctgtgctcaagcactcttcccgcctcagtctcctgaacagctgggattgcaggcacatgccaccatgcctggctcatttgtaaaaatttttgtgaagacaagtcttggccacgtgcggtggttcatgcctgtaatcccagcactttgggaggctgaggcaggtgcatcacttgaggtcaggagttcaagaccagcctggctaacatggtgaaaccctgtctctaccaaaaaataaaaaaattagccgggcatggtagcacgtgcctgtaatccgagcttctcaggaggctgaagtgggagaattgcttgaacctgggagatggagagtggagttagccgagatcacgaccctgtactccagcctgggcggcagaatgagaccgagtctttaaaaaaaaagaaaaaaaaaggttcctaggctggtctttaactcctaggctcaagcattctgagtagatgggactccaggtgtataccattgcccccagccagatgcctcttttatattttttcaggcttttctcctgtattgtatgtaaataacacttttcttcgttttctatatcaaaatagtaggagagcttatatgaactctataataatataacattgttagagaagaagtgttctaatgtcacatttctcaaaaatttcataattaaagggagcataggggtcagataaaaaggttatattgtgaaattattaaagaataattaaaatacagaaaatataaaaaatcttctgaatctgagtccaaaggaattggaaggcagagattggattaaggtaaattggggaagttgacaagagagctgacttatgctgaggaaggggagggctagaccaaggttgaaggagaaaggaatattccagtcctggattcagttgatgacagcaggacataggcttctctgacccccacaaaactgaaaaaaaaattatataagcagctttttaaggcaagctgttgctcacagaggagtagagggcccttttctgcaggttgggggtaacagggcatgtgctgcagagaccacagattctcccttatgactcacttcatgaaacatctgtaactaacttaagtccatattggggcttgtgatttgagggatcctctacttgaaagaaactgcctgtttttttgatgcttgtaattcttttaagtagtgaaaaaaatcttttgttctaaaattagagatgtgaagcttaacatgtgaagacttgactctgaatactcatgcccctcagtttatgatggggatacacgcctataaacccatctaagttgagaatataagttgaaaatgcatttactacacctaacctaccaatcatcatagcttagcctcacctactttaaatgtgctcaaaacacttcacattagcctacagttgggcagaatcatctgacaatatcatgcactgtaaaggttgtctacccttgggagctgcagcttgatatcactgcccagcattgtaagtgtcctactgagttctactgaatgagtatcgctttcacactgttgtaaagtggaaaaattgtaaattgaaccatcataaaccagggaccatctgtactctagcatgctaagtgtaatgaagtataaattacagatataaaaatcctttggtgtttttttggcaaatgtacttgaagacctaaagccttgtgccatttgtaggaaaggtaggagcagaccagttcaaagcttaccaaaatggttcactgtggagaaaaagagaaacttctattaatactattttgcacacttatctacagtaggttgtatttatctttaataaatgcttattggaataacaaacagatacaagccataaatgcaggcatttttatattccaaagctgctgcaagcacgggctttgatttttattagtttgttttgtgggggagagtttttaatgtggcttatctatataaagaagtatcttcactaggatacataaacttaaaaaaaacttatttattgagtactaacaatgaaccacgtgcgaaagatactataagctgctttttttttttttatttttattttgagacggagtctcactctgtcacccaggctggagtgcagtggcgtgatcttggctcactgtgagctctgtctcctggttcacaccattctcctgcctcagcctcccgagtagctgggactacagatgcccgccaccacgcccggctaattttttttttttttgtatttttagtagagacggggtttcgctgtgttagccaggatagtctcgatctcctgaccttgtgatccgcccgcctcggcctccccaaagtgctgggattgcaggcgtgagccactgcacccggccaagcttacttcttttatggacccctctagaagaatgagaaaagtagagagagaaaaaaccagttgttaaaacagtggtgggaaaacaccatgagaataagaagaaaaagatttttgcaagtgggtgacttagggaaggctttgctgaggaattagcatttggacagagttctaaaagaacaaaggcggtgcatgtggtaaggagggcatgccatgcaaaataaataacatggaaaagcatgaaaatatgaagagccaggatgtggatccctttggctgcagaataagttctgtatggggaaatgatggaaaacgtgacagagaaggtaagtagtaagtaggttgtgaataccttgtatgccatactcagtcatttggattttacagcagtgggtaattaaagaattttcagtggcccacttgaaggcttaagagttaaagcagtgatggagagagtggagacgagaatcaattcttaaggcatttagaaggtatagatagaacttgagtgattgatggaaaataaagaggacttgaagataacaggatcctagcttgggtgactgaaaagatgatgtcaccattcaatatgataaggaatacagaatgagcaggtggaaaagataattcatttattttcacaagtgttaaatttgagaaaatctattggatatcctggtacagacactcattgggaagttacaaacagggttgcagagcctagaagacaagtcaggtctaaacacagatttgagagtcctcctcattgaggcagaaagacaagtgagtaagattgtctgggagagcacactgggtgagtaggagagagaacaaagtagagaactgcaacacgtgagtgaacaattagacatataaaaaagggttgttacaaaaccaaaccaaatgctcctacctccataccccaataaaaatcagcgaggtagaaaactaggagaaatgcatcttggaaggcacaggaagagacgagttggaaaggaaggaatcgcaagtcagatgcacaatggggagtagaggtgagcttagcaaagggtctttaggaatttgtagtccagtttgaggactttggggacacagaatcagttgagtaatggtgtgcaagccaggttacaatgcctagatgagaaagactttctgatgaagggagagagaaagagaggacacagtaatctataggaggttgtgggatccaggaaggccacttttttctttttgaaatacctacagttaagggtaaatgagcttggagaaggagagagagattaataattaatttgttatcaagaggttaatttaattctagttttggaaagaaatgctgaaaatatatcttgtcaagtatacagttaaaaccactttttaaataattgatacaatggtgctaaaatcagtatattggtaacttttgagctattgtggtctgtaggtttttcctctaatctttttcaaattgtaaaaatcacatccagtaacagttgcttaaaagagaaataaataggtgatctcagcttcccatctactcagaaatgtcactttctcataatcccatttttttagtgcattgggaatttttacctgaatgaattttgtaagtatctcgcttagcttaatttgcctaaaatgtgacctttcagaaaatatgagagggaggttggtacctcagaacatctcttgtagatcctttattattgacttaacggatgatgacactgaaaagattgcctggggtttatgctgaaaatctggaatgttttacagtaggaaggttgggtaggatacttgtccattggttgttctagcccttttccaagaaatgtcaattggatatcacagatagaatcttcaggagtttatgagaggtagtctgctatgttgggtgtttgattactgctttacatctttaggactttctaagctgttcaggtattttaatgaaccaagggagagcactgtgaataaaggattatgcataataagaaggtggtgagggggtagattcacagagtttgggatcttttggatttgcttaaacagtttggggattaccttgctttacattgaataggcctgatgttactgatgctcaagggaaagtcaagtaattaggaaagaagaaagcaggcatcaaactcagacaaacaaatgaatatactatggagaaggaatagttgtggttggtggttgaaatggggaagggagcagggagaagcgcatggaatttctggaggaaattggtacttaattcctacttcagggttttcgaaacttacaggacattgactcttggatgatactattaaacctaagcatcttttatttttttagaatagaaactttcagcttacattttcttcagtgtaggaaaggagtccaggggaccaggggatagtataaatcacatgctttgtgataggagcagtattttgaaattacaggagctcttcagctccctggtgttttgtttgttttttttagaattaccaatttataagttgtttaaaagtgggaatagttataccttaattttggaattaatcttcatcgaaggaaggaaaacatcaataaactgatagtttcatttctttctttgttttttaatgacatctaatcttactgctttctatactccttttagagcatttccttttctgggcaggccaaggcctggcccagtagacttgaggcaggataggtggttgaatgaggtggcatgctgtgtagaacttcactcacatgggcagtggagaatttgccctggccttgatcttggcgcccctcccccttggtgttgcttcttgacaccgctgtcaacaactagagccctggaaaagagcactttattccttcagctgttatctgccaggtgcttattatgtgccaggtagtatttttggtgcttagaattcattcagcagtaaagaagagaagagccctacttgtaaggaggagggttagataataaacaagtaaactaaaaaattgataattttagataatgatggagcctataaaaaatataaaataagggaagtgacagaaaatgactggggtggtagaataggggtggaggggctacttcatatagagtgtcagggaaggcctctctgcggagatagtatttcagcaaagactaaaatgatttttaaaaaaagggcaagggtggagctgactcttgaggtttagggaaagacagaggaggcagaggtagtgttaagcccaggccccaaagttaggatgagcttggtgtatgagcgaagcaggagcccagcctattggggttgtgagtgaggagaacaagtggctggtgatgcgatcgaggaggcaagcagggctgcatcataggaccctagggtatggtgagcagttcattctcggaccacttccagtcagacagtggaaagagaagctgggaaaccagttagaaggtgactggtaggccagggatgaggtgatagggcttgggcaagaatggtagcagtggggagagagaaaggtggatggacttgtgctgaaaagtgcaaactcagcactcagggacaactcagtattctcatctcttttgcagacctctctctgggactcactgagcatgggcagcttccctgtagccacctgtttcatccaccacatggcattctctgagattaagtgagggagaaagcacagcatgattaagagagataaaaggattataacaagaaagttataatcccagattatcaggtcttagaatcaggtattttagggaatcttgtatattccccaagtagtaaaaacaacagctttgatttataaggtgaggctcctttccaggaggtccagagcagaagatactgttgctaggcttggatctatttttacaattggttttaggtattgaccaatatcctgccaacaaaggtggttctaggtgaatcctcttgattgttttttacatgtggtatgaatcacttagccctcccacactaaagatggaggatccctgatcagaaaatataaagaagccatatatgtctccatctgtgttttaaaatccttactttttccaacagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaagtaagtacttggtatagttgcatttaacattggggtacataagagttgtggtcattttagagtggctctggaagtgtcacataggggtctatggaatttaaaaggtgagaggaagaagccttttgctatttggcccttatattgaaatattgatttcttatatctgtctgctgtgatcatattttatccttgctgttcactttggatttagagctaccttctgggctgatgactttttgatcagcatcagattcttggtgaattatatataatgtataattcagataagtttctgaatatctaaggctaaatgtcaccctttttaaagtaaagtactgagaatgagtgtgttgaagatcataggttttttgggttgggaggagattagatgttggggatgtcaatgagatttttggaggaaaagtgggaacaagagtgaaaaactatcaattcttcagccgttctattagtgtatcagtgatgtatttggttgtgctattggggaggtgtttgtagttttaagtattgcaaaatgcttttcatatacacttaaatcaagcttacaactggctattaagttttttccctcttctgttcacaatctgtgtcagcttccattcaaaacaaaacaaaaataaaacaagaagaaattgttgttgcttatccagaattatttgagtatgtaaaattgatttttaccaggtttaggtcaaccagttattggtgacttttttttctcaagctggaataatctatacatttcttttggctgtattttgaaatctgattttaaaccatgaatcttttccccttttttatttgatttttctctccacaactatctttattgacaaagcttcttatttataaataccccagtggagaagtattgagtaatttccggaagtcttcacaggtttctataaatcattgatttagagaattactgtctaaattgaatagaaagttgtgcacattctgtgactttctaaaggttaacatccaagctttgtcagaattgaaaaaaaaaatcatgtacttggttccgccgcaccaactgcccgccccccataagaccatctctcaaggaaattgatagattgtttcttgatagattttatgatgtgcatttcttacacatcctggagaggttttcatttctgtttagtctatcgttctacacaagaagactgtccctaaaaattcactttccccctgctatccttatctaccttctggatttgtattttaaaacagttcaataaaagtctgcagccttttctttctatgacaccttgctgaagtctcactgcaatcacagggctattctctctctgtgtgttaaatctccagtccgtgatcttgattaccttctggtgttgtgggaaagaaatgggccattttctgctcttccctttgattaaaatgtaaattagctagttaaaaaagcacaccacccagacccagaaggatgcagttctgtcgtttgatccctgctatgatcacacctttggctctggtcctgctgggcactcttctggaagcttgggtgtgctgagcttcttgttctttgctcccataatggctcgcagcatagctaagttaatcttgcaggggcctgagaagtatcttactcacacacgcttgctcacgctcctattctctctctcttctgagaaagcttagtttttaagaattgtggaaatgattcatttagcaaatattgagtaccacctgtattcaagaagaatggttcagtcctttctacaaggttctaaaacccctcaattttgatgataaagctccagtcagttctagaggtagtttttccaaggaaagaaaaaattgccaacaattcgcaatgtttttgtatatattcatcatctctggatccagggtacatatttctagtggaggggagaggggctaagatcaggagtggacaaatgtctgttcaggaagtttaatcatcttaagagctgggaatcattccagttttttcacttgatatgattttggtgaaataattttacctttatgagattttcttcacctaaagaaaaatctcaagagatactataacaatgaacaaagatattaaagcactttgagcaactgacatccttcacttaacgacagggatacattctgagaaccgtgtcattaggcaatttcgttgtgcgaatgtcacagagtgtacttacacgagcccacatggtagaatctactacacatctaggctatgtggtatggccttttgtcctcaaggtacaaacccgtgcagcgtgttactatactgaatactgtaggcatttgtaacaaagaggtatttgcatatataaacgtatctaatgatagatgcctagggaggctgaggtgggcagataaccgaggtcaggagttcgagacagtctggccaacatttttagtagagaatccccatctctactaaaaatacaaaaatgaactgggcgtggtggtgtgtgcctatagtcccagctacttgtgaggctgagacaggagaatctcttgaacctgggaggcagaggttgcagtgagctgagatcatgccactgcactccagcctgggcaacagagcgagactccatcttaattaaaaaagaaaaataaaagaaaacgtaatgctttgcgctatgatgtcatgacagccctgatgtcacaaggcgataagaatttttcagtttcattataatcttatgagaccaccattgtatatgtggctcatcattgaccaaaacgtcattccgtggcccaggaatgtatttggagggaaggcaatagtcaaaacctaaagcaataatagtatcattatctataaaaacattgaacctttgagaagatctgatatttgtcttggacttgttgaatacctagtgttagaagtgatttcatttcaagaggataagagcaccatttgacactgtagacccaaaatatactaaatattaccctcatcatataaaagcattgcttccatttatgttgctgtacacccttgaaatgaaaatgtcatctcttggacggggaacttgcatgagaattcggacatctcaggtctaatcctgcttgtgcagctgatgtatacgtgatcttgatttctgtttatgcaggtggtctaaagctttctgctcttttcaggtccacgaagactccttctcacttactctcagcagacatcctcacttggttaatggttaagacttcagactccagagtcagccaatatgagtcagaccccttgctctgcagtgtggccttaggcataggttacatatcctctcaaagcctcagtttcctcatgggtaaaatagggataataggaatatctgtcttatagagttgtcatgggggttaatgcgagcagtgtatgctgttcactcttgtatccctaggacctggcaaagtgcctagcaaatagtaagaacacagtgtttggagtaaatgattttaaaaatcctagtaatatgcctggcatgttagtagtgacaatgacagtagaggccaataggtggtgtattagcatcactcatgctgctataaagaaatacccaagactgggtaatttctaaaggaaagaggtttgattgactcacagttccacatggctggggaggccttgggaaacttacaatcatggcagaaggcgagggagaagcaaaggtgcatcttatgtggcagcaggcaagatcgagtgtatatcagcacagaagaaactaccttatataaaaccatcagatctcatgagaattcactcactatcacaagattagcatgagggaaccgcccccataatccattcacttcccacccgctctctccctaaacacctggggattacaattcaaaatgagatttggggctcggctcagtggctcatgcctgtaatcccagcactttgggaggccaaggcaggtggattacttgaggtcaggagttccagaccagcctggccaacatggtgaaaccctgtctccacacaaaaaaaatacaaaaattggttggctgtggtggcacaagcctgtaatccagccactcgggaggctgaggcacgaaaattgcttgaacctaggaggcggaggtttgcagtgggctgagatcacaccattacactccagcctaggcaacagagtgagactgtcttaaaaaaaaaagagagaaaaaaatttgggtgggaacacaaagcgtaaccgtatcaggtgagaactccgcagttttgtggcccatcttatctcaaaacatacctgtttttgcatgtacctcccttcttttcctgtctcagtgaaatagggtatttatttcatcctgcctaaagtgaattcctttacctgtgccctggatccttttttttcttgtttttttttttttaattttagtttttgagacagggtgtctctctgtcacccaggctggagtgcagtggcagggtcacagctcactgcagcctagacctcctgggctcaagtgatctcccaacttgaggatcctcagtagcctcctgagtaactcacgccggctaagttttttatattttgtcgagatagagtcttactttgttccctaggatggattcctttttctgcttcatctggtaccttaggccactaataatttcttctctctttctgtatttttagcttctccctcgctaccactaactcctttcttctctcatgttaaatttctttcatttaacacaaaatagtccccctagcttcttccctctaattactacctgttactaattactaatctaattattatctttccttccagaagccaggctcttggaagaatagtctattctgcaacctttctcagctctcattctcaccagcttttgcccccaccacatccttgaaactcatctttcaaaagacactaactgctaaattcacttcggctttgtggttctttgctttcttgacctctttgaagcacttgacactgtcagttattcctgctttcttgagactcatgtatctgtcttaacttcagcttctccaaatttttctttttcaatctttggcagctccctctcagattcctgtgggggctgcttttgtgtgtttttgtgttgatattctgtaggatttgtcctcagaaacagcaaacatttattgaaccttatgctgaagataatgggaagccattaaagcaagggtttttaatcagggttccaaagattgatatcaaggaatctgtgaactacctgaaattacattcagacttcaaaacttaatatgttaagtgctttacatgatgctaagtgctttacacacattatctgtttggacccacgttgccatcctatgaagtagattcttctgttgacccccaacttaaagctcaggagactcaggattagagaagatgagaaacttgcccaagattgtagttggtaagtgttggagtaaggatttaagtgtaggcagtctgactccagagcttgtacttcaaactgtaatgccactttgccttagcaatgcatgtcccaagacctcttttttatttcagagcctcaaaaactactaaatacctatcttcagctcggatttctatcccatcaactaaatagcttaggtgcctgtaggcccctccagttcagtaagccagaaatggctttgttatctgctttcttcttcctgctcctttccaacccctcttcatgctattattctctatttcagtgaatgacacctaatttcttgggagtcttccttttcttttacattctatatgtaattggtttaccaagttgtattatatttacctcaaatctaacgctttcacttaaggttagtctggtggctaatggcattgattttggggtcgaatttggagctaaactcaagcatttccccttaaaagcagttgaaattggcaagttgctcagtgtcaagtggcaataacaaatgcctgccttccaggaggttggttaggagaatgggtgagtacaggattagttctttccctttactgtgtgctttaaacaagggatcaaactttcttcaggcttagtttgctcatctgtaaaaggatgctgataatagctaactcatagggttgttgcaaaatttaactgagataatttaaatgtgtgtaacatagtgactagcacatggtaagcattaaaaagaaacgtaagctcttaatagcatcgcccactgccactgcttttatgtaggccttctcattttagcctgcctcactgacataagctcttcactaatttccctaatttgtcttacccctttccaattcatgctgctacctgagtgagtttaaaaaacaaacctgatcccatcactgtcttgcttaaaattcttaaaagtagtgattcttaatcatgtgtgaaagacagagagtgcagtgaactcacttgatacaaaatctatgaactgtcttcccagaaaaatgctttaacatactaagttttgaagtttggatataatttctggtagttcacagattccttgatgtcatctttggacccccaattaaaaaacgcttgctctaatggcctcccattatccccagcataaggtcaaactcttttacacagataagagaatccagataagcagaaagaaaagaggcatctattcataatccaactatctagagaaaaccattttctttttttaaagtaaataaaaatgaacttattaaaaaaaaccatttatcatttcacaacacatcaataaccaagtagaaaataaaaaaatatataaaagcctgggcaacatagtgagacctcatctctacaaaaaatataaaaattagctaggcatgatggcacacacctgtagtcccagctactctggaggctgaggcaggaggatcatttgagcccagggttcaaggtggcagtgagccattattacacctgtgaatagccactgcactccagcttgggcaacatagtgagactcccatctcaaaaaaaaaaaaaaaaaaagacaaggaactaataattaggatatacaaggacctcttggcaaatcaaaaaataatttttcaatttttccatggaaaaatggtcaaagattataaaaaagcaaatcacaggagcagaaactcagctggcttacaagtgtatgaagagatcttcaatctcaattagtaatcagaaatgtaaatcaaagcaaaaaaaaacattggcaaatatttttaaacattagatgataccagttgttggtgagaatatgggagaaacaggaacttctgtgtactgctaagggggaatgtaaactgttacagtaggacattagaagcaaccagtgtactcgtcactaggggaaaatggtctgtaaacatggtagatccatatcatggattatgctgcaagtaacagccacatggacagatctctaaggtcaccactgaaggaaaattaagaaaaagaataagatctataatagcctatatcatcttgtacttaaaaagcacatacataaagcagtactgtgtaacttaataaaaatatatacacatctaagatgtatctgatatatcggtgggtacaagagggtaagtggggtgcagagggagtgggaaaataactatgaaggggaaaggtactaaaatacaacgagaagggcctggcacagcccatatttgataatgtgctaagaagtcattagaaattttgaatgactgaattccctatacctgaggtccccctttaaaaagctcacccttcttatagacgaagaagcgaagacactaagttacaatgatataaattaagctaccaatgacaaagtgctcagtcaaccttctgccttgtgttgataacactaatctgccctagttatatctaaagaaaaatatactttcatacagatttcacagcttttcaacatccatatatctggaaagataagaacatttgtatatccttccatatgagtccttgtgattcgttgaggccataggttaagtttcctttcagtcattccaaggagaatcagcatgaccaagcaaagcaggttccaaaggcaggaagcagaagcaatatgatgctgtggaggtacctttctgaaacagtctcttctgctgttgtggggtctttgggcaacccttcaatttaagtgcttggcaacaagtctgctgagataggctgaccttgtagcttttgtagtctctatcgtacagcactggtcagatctacataagcctcatcgatgctgacgcattcaatcacagcaaaacaagacttcctccatcacttcaacactggcttcccggtacttggtgaggttagctttcccatggtactcacgaacttgtgccagtagaagacctggacttaacttctttgcatcatctgcctacatatagtgaccccaaatgcaagagcttcataactcactgcaattattctaccaccttccatgatttgtactacacagctgcacaagatttattcctcaaatgaggattttgccgctgctccattggaacaaagtctatgtccatgagagtaaccacacaatcctgtccagtagccatttttcaaggtaacagacacctggccagactgccagcagtgggtgccgcaaatgctgggctcggtgcccactggaaggaaaatggaagaagggcttttgaatatcttttcgcctttctggggagagtttcgagagatttattccccgtgatgacagaggaacagagaaggggtcgtgaaggatcctgcccaggcgaccgtccccacagttcagcagggatcagccgagagcagtgtgcccagcaacaaagccaccagactgaggacagacagcacgcacgctgcctagagaaaaccattttctttcctcacgttttttaatgctcctaattaatgtgttttctagctccttctctcactacgtcccagcttttgcaccttatgctttaacccaatacaactattttcttttttttttgttttttttttgttgttgttttttgagacggagtgtcactctgtcacccaggctggagtgcagtggcgccattgtggctcactgcaagctctgcctcccgggttcacgccattctcctgcctcagcctttcgagtagctgggactacaggtgcccgccaccatgcccggctaatgttttgtacttttaatagaggtggggtttcaccgtgttagccaggatgatctcgatctcctgacctcgtgatccgcctgcctcagcctcccgaagtgctgggattacaggcatgagccaccacgcccggccaatacaactattttctatcctctgaaagagataggctgcctatcacagtattttgttaattgtctatatgtatacttcaatttttatttggctgaaggtgttgatggtatattaatttttgtatattgagagtttagagtctagcttagtggctgatatatagtacatattcagtaaatattaggctaaataagtgaattgcaaaattcatacatgtttgtgaaagaaaataagaaaggagaaagaacaaattacccatggtctcatcatccagatgcaccaactgctgacatttatatgtctactgtgatcttgtgtgtataaatttctactttctagagcttagcgccttcatagataatttagggaagagagtcattaccctttcccacttcacatagagattatgaatttagtgtatgcaaaattcctaataatgctgttaaatgatttggcctggagaatattaaccatactaaattttactgtgttgtgcatatgactggggctacttttacttgcctggtacgggaaaattgtgtatgtgtctgtttacccttctttccctagaacctcattttggagggttgaagaaattcttcatgtgattcaacttcatattcccccacaacttagctttttatgtgtaatccttcttaatactactatataagctaatctgtatttgtggaagagaatagttgatatactgatggtagttttcatcatagtgctttcctaaggagcagactgaagctcagagaggtttgtagcttactagactctaaactctagatagataaaaattagtacacagtgaacgccatcaagaaggtgtaagatttcagggctagtcagtggcaaaatcgagactagaatccaggtcttttgactccaactcttcagtagtttaatgttgttggcttgtctcttgggaagaactggcaaaggttaattgaaatgactggctctgacctttttttttaaaacagactcaacttctaatggaatttcattctaccttggatttctcctttttttctttcatttttccacgaaggctgtgtgtttattttttattctacttgcaagaaaagagttctgggtgacttaccccttgtaatgtttcctggttcccacccttctgtcttctactttgctcttgtctacttctcaaagggaaaacatttagtggtgaatgggaaagatgccaaatagtgaaaattttaattcatggatgtatggctgtgatgattactttagttcttttacctacctctaagaggaaattcattattgaaattgaggaagcccatatatgttttattttctcttggcttcattttatttttaaaatttatttttgcttcatttttaaaataacttcattttcaagcctcattgtctgaaggttgaggctttgagcaaaaaaacaacacatttagaaattctagtcctgaaaattgctgagaaattttaactgttctcataataaaataagtaaatgaaataatgcatatgataattagcttaatttagctatttcacaataaatgcatattttaaaacattttgtacatgataatatatacaatttttatgttaaaataaatgaatttttaaaatttctagatcttggttactaattctcttatcatttagccatttctgatggctgcttttgccctagattgcatttctctctgggagaaaaaaatcttaatttctttatgttcagcagcttaagggagattacaggcagagtctttggatttgattttcttctcttttgcaattaacttgacctcctcttgactttaagacaggctgttaaagccagcatgttgcttgaggcaagatgtttgatatacttttccttagcacacagatgctactggactgttagcatattgcacaaaacagaattaggtttataaaagaacaaattaaaaagttttcggggaagttttttttttatagtttacgacttctttaagagggaaagctcttgcatagttaattaaggattgtctagtaagttttgacagttgtaaacagaggcttataaagctctaacatacatgatagagaaaacgggttgttagacacaaaggtcttctgtgtacatggaaagctaatagctgtcaattctgagacaggaactagaaaataatatctgaagagtaaatggatttcttacttaaatgttaaatttccattatctgtgcttgcagtttcatcttttccaaggaccttatgatgtgattgcttaattctgattctcatactgctgtgaaacaaagccagggctgcctcaagttaggcccttaggagcccggtggctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggcttgagggagagtgcatcaatttttgttagtccgttcttaccactttcaagttaagatcatgatcactttctctggtccttgctctatagaagccaaaaagacccattccatacttctttaagtaattattatcatgaattgcctacagaattatctatatgatataaggtatatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaatttattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgcacccagccaaatagtgccttgttctaagcagcattagtgtgaatcaacaaatcttaaaaattggccgataactttttaacacaatgtactaggaaggatagtcagggaataaagggcatgcctttattctcacctcaaacagaaactcagaaaaattgaatgtgtgaaaaatgatttagatttcatttagatgttttatatataatagtaaaggaaaaagtcatgatcttgttctgagagcttttctgcttcctatatccaagcaaactggaagctttagtatattttggaaccccattgttttctttcttatgagctgagtggttcttaggccctgtgagggttggggccagcagattaaaaacataggtataatcagaaagttccatataatatggcagtttcgtctttcaaacttcctcacccagcactgcagtacatctttgtacataatctgcttttactttctgaggacatgttcaacctgggtatgctttgtatattctaccaaaacttcagtgccaaagggtcagcagcagtcccactaatgggcacttcggtgaatcaggcattaagctgtatttctcatgttatcttagtggggcaaatctattcgaaaccgaccccacactgcagaatcctcggctttctaattggttgggtgacaggatatacaggcagtctgtgctacacaaagccttccagctgggctggctggtggcttgagttgtaatacttttttgacccttctggaaagaaatcagctttcataaagcaaggtgagtgaaagcacagagggcagctcttggaccactgaaatctgccggcctttcacagagccctagaaatgaaaatgaatagaaaagcccttctctttgtctttggttttattttataagagcacacttattacattaagccatcttgtattgcctggggtgctgctaaaaagagaaataacctgtaggtttatcatctgttggtatattttaggttggaagtgtgaatcctgctgaaaacttccgtgttctagtgaaacagaagaaggccagctttgaggaaggtgagtggttgactttgcatttaggagaagctgtttagttaagctaactaatttaaagtctagattaagaactgtagccttttgttgtaacactttagcatttttctttactggcggatctttgtggttttcccttgttagggagctcactgaggcaacattatgagcacatgaaagtgaactcagcacagattttctcaaaaggaactaatttgtaggtctccctacagaaaaactttgggccaacaccttggcgcttatagctccacttcattgaagttttttaggattttgtcgtgagctataaataaaacacttttatgtcacatcttcctattttattttcttccttttttttctttttttttttgagatggagtttctctcttgttgcccaggctggagtgcaatggcatgatttcagcacaccacaacctctgcctcccgagttgaagcgattctcctacctcagcctcccgagtagctgggattacaggcgtgcaccaccatgcccagctaattttgtttagacggggtttctccatgttggtcaggctggtcttgaactcctgacctcaggtgatctgccagcctcagcctcccaaagtgctgggataacaggtgtgagccatcgtgcccggccacatcttcctattttcagagacacataattcttgttccagtcctaagagtttgtggcccatttatagtagacctagaaagaccttgatgctgcccctaaatttaatccttctcaaaatggctgcatggtcacttttccttatcaggtagtacctagaatctcatttaggctgtggctaacataaaaatagctttcagggatgcacagagggcctggaactaacattcattcacttgattgcattcaggtttctgttcatttaccctttaaatggtggcaactggcagttgttaatcctgcaggtttatatataaactattatattcattattgctggtccaagtctggcctgtctgcgagctgacttctacgtatgtgagtgtttatgtttgttcatgtgtgtatagaactttctcttccaacatcctgcagggagcaggggaatcacttttttttttttagtgacagggtctcgctgtgtcacccaggctggagtgcagtggcaggatcatagctcactataacgttggacctctgggctcaagtgatcctcccacttcggcctcccaaagctctgagattacatgtgtaagtcaccatgcctggccaaaaattactttttttctttttcttttttttggggggacagaatcttgctctgttgcccaggctggagtgcagtggtgagatctcagcttactgcagccttcaccctggcctcctgagtagctggaactacagttgcatacccccacgcccggctaatttttgtatttttagcacagacggggtttcgttatgttggccaggctggtcttgaactcttgacctcaagtgatctgcccaccttggtctcccaaagtgctgggattactgtgagccacggtggcatgagccaccgtgcccggcccaaaaatgagagttaaatgcctagaagcactactgcctgcagtaggtctaatgcatcttactacttgcagtctaggaatcctggcaagatccccagatctactgtgctgttgtccagaggcaagcatgagcagctgagcctcagagagagcttacagtctaccaggcttaaatcctgtcagcaggaatgccaaaggccaaaccatgagaatctccagaggaagaacagcttcgttatcacagtaatctgcagtctcttaagtggggtgtatatgtttttggttttgagatggaagaagagctttttgtcctgctaaaagttgccatataggagaaaaactttgagttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctgctgtgacaagtcaatgaactcttgtctatcaagactattgtgtttttgaaggaaaattgagactttcctagctttcaattgtatgtcgtcaattacctcagccagtcaaagtccaaggtcccccgtttggaagtgattggactctgtggttggtgtaggcatggtcttttcagggactgaatctagctgtcatcaccattatatggtagccactagcggtttcatatttactatgttcaaggcattgtgctagcacttttatgttattttaattaccctgcattagcagttctgcaaaatcttgtgaagaaatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacaaattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccattttactgatggataaactgtaaaattggaggagatgcattttcccaaagatcacataggaattcaaacacatgtctctttcaaatactggattttttacgtagccatattgtttcttttgattcctaatgacttcctttcctacgctttttaaaacaacattttaaggtcgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggattgcttattagcaactagttctcgtgattttaacttggcttccgttttatcccttctgccgttcttggtgccagctccagaattgatgtcctgttctttgttttgggcatcttgtttgtttgtttttccgctagggcatctttttactaacgccctttataagccaagactcacttctcttgcaggcccaaagagttctccctccctagtagtggtcttcttttagagagatttctgtccagagtcgggagacaggaatcccttccccttttctccagtaaatttattttttaaaattcagttgtcaaaagggcgatcagcgatagatagttggtaagattgtttgacccttaggtagaactcggctgttttacctatcattataaattaaaatatgggtgtagttactttttctcaggcctgatagtagcataatcaaactgagagtcttgtgattctgtccccgacatcagcagtctatatatagtaggcagctacacattttcttaacttctggttttcagtgtgagggatgtatcttgttctaagcttactggcagagaggagataaccaatgccctgaaccccaggaagcatgttctttctggctgcccttttcccagtccctttcctccattctccctacccatcaccattctatcaccacagagttagaatagaaaacaattttttttctcttttccttttttgtgaaggggtctcagtctgtcgcccagactggagtgcagtagcatgatcacagctcactgcagcctctacctcctgggctcaagtgattctaccacctccaccccgccaagtacctggagctacaggcacacactaccacaccaggctaatttttgtagtttttgtagagatgaggtttcgccatgttatccaggctggtcctgaactcctgagttcaagcgatctgcctgccttggcctcccaaagtgctgggattacaggtgtgagccaccaagtccagctcagaaaaaattttgaccacagctgtatatataataatcatctatcagttatgaaagtagggttgtttccctacatacactattcataagcacatcattgccatcatctgggatttgttacctgtcgttgtgggtttcagagtctccagaggctctttacattgagtttatccacttgtttggatatcttccacccagctaatcaacagagttgctaaggaggaatgccatgattttcagctccttgcgctttcccaacttaggaagaatgctaaaataaaataaaataataaaatgtcaaaagatagacagcaggttcaagaaggaaaagccacattacttctttcctccggacaattcctgcgcgattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccaaacagccttaacatttgactcatgtacaagagagcagtaatatgtacttgtccatttgattagaaggtgatcacttcatttttttcccctttcactttgtttggattacgtctcatcctagagtctttttgcctttgttcttcaaccttctttaatctcacttactagaaacatcctttcatttttaaaagatatttcctaaaattcactttttccaagcaatttcagcactagatagaatatggtacaattagtaataatatgatattcatcaaagccaaatagttttcagtgttggttttgtatggtatagcactatcccatttgcatagctgtttacttacatacattatgtgattttctgccaggagtcaagccctaaacagtgaaccttcgagaattgtgatctagcagaaatctctctcgtgtgtgtgtgtgggtttgtgtgtgtgtgtgtgtgtgtgtgtgtgtgtgtgtgtgtgtgattttttttaattgatcctgattcatgtaatcttgggtatgaattatataatgaattatactctgcccagatagataagaagataaaaatatggcgtttttctacacagcgctggtaaatttaagaaaaataagctctttcaaataccttgagcatcttaaagatgctaaatacaaacagtcactaaaattttaaacatctttagccctataaaagtttttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttggaattgtagagaatacttgctgaaagggtgtgttatctgacatcgtaattatgcaccattggcctttaaggtgttgttcatctttcatgtgggcggactgaggcccagagtagttaggatgacttttcacagataattgcaaatatgtgaaagactctggatcaaattccagagagccaattcttggcctctgtggcttaaacctttttactggttgtgtatatttcattggatggcacagcaccaccctgaagtttacatcttaatataatgaaactcagcagccaaataatttagatgaaatcattgaaatagagatgaaaagaaaaaataaaaagcacatgacgtagaaactaaagaccattatgcacacataatcattttaagtattttcatttttcagcgactcttcctaaaaggctttcatctattcttacccagcctttaaaatccttttaagttcctgtcaatctgtatcagaatatccctaattacaggatatagctcttgtaaaatgtagcctggctatccattaagaaagagaaatgtgtggtagcataaaaatgaaagcatgtttgctgtagttacattctgttaactgaaaaaaatcacaagatctataaatttagaaaaagagagctttatttcttataaagggttacagcttgcaaggtggaaatagcaaggccaagtggaccctagatcgcatataagttacagtaagtattattatccccattctactgatagataaactaaaattggaggagatacattttccccaaagatcacataggaattcaaacgcatgtctctttcaaatactggattttttacttagccatactgtttcttttgattcctaatgccttcttttcctacactttttaaaacaacattatagggtcacatatctgaaaccttgtgcctgttgataggacttttgatgaaagcctgggaaaggctattcctagtctattcaaaggctgggaaacatggcctccagccaaagcccagagacaggcactatgaaggagggtttggggtaagagcattattgctgacctgattgactaaacatacatattcagcaggttacaggaggagctatgaatattcatgaaggtggtcctgatgcatgagtattaaacatgcatgttacgtaatacccatgttcaccttgcagggaagacttgacatttaaatattacagttagaccctgtacatcaaaaggtcttttcaggacacagcatgcaaatgtgccatctttgtaaaacccactagaaccagtccgtggttggtggtcttcttatcaggagaaagttaccgaaatcactctcttgtccaatcaaagctgtagttatggctggtggaacaagagttcagtaagtcagcatctggtagagctgcaaattgttttaaaaacaatattgcttatcccaaggccagtgcttttttagctgcttaagaaaaagaaaaaccttttggcagttagaacatagtttattctttaagtttagggggtgcgacttaacccttgcctggcatggccttaggtcctgtttactacagtttgttctctcagtcttatgatacctattttaaaattaatgctggaaggttgtgtctaaattgcaaaaaggaggggtataatgaaatgcacctggccgggcgcagtggctcatggctataatcccagcactttgggaggctgaggtgggcagatcaggaggtcaagagattgagaccatcctgggcaacatggtgaaactaaaaaaaaaaaaaacaaacttaggtgggcatggtggtgcgcacctgtagtctcagctacttgggaggctgaggcaggaaaattgcttgaacccgggaggcggaggttgcagtgagctgaaatcgtgccactgcactccagcctggcgacagagcaagactgtgtctcaaaaaaaaaaaaaaaaaaaaaaaaaaagatgcacttgaccccttgtcgtgtcatgaccaaaaactcagttaaggttttctgggatcccctttgtcaagagggggtccatttcatcagtggggagcttaggatttctagtttacatttctcagtgagcacctgaatttcttcctgagagctttttaaaaagtccttatgaaatatatgacagtgttcctgttttctcccagtgttttgttttctcatgctacataggaaagttgcttcccttaaatgtgctgagtaatttttctctttttatattaaaaatggaaagaataatttcccatctggctgaaaatggaattcatgaaggctttctcagcatcataactagatgagcccagagtccattcaagcctttacttaatatactaaatcactcctgataccagtcttctatgaaggagagagagagagagagagacacttttaaaccatgagatatcaaaagaactcactgtcacaagaacagcaaaggggaagtcctctgccgtgattcattcacctcctaccaggctcctcctctaatttgatatgagatttgggcgggacacaaatccaaaccatatcatttcagcttgcatcaatgacttgggccatcagtgcaacaaggcaggtgctcacaattggttccgatggaaatgcagaactcttgggtgcttaggagaaagggcctgcagcttgctcttagaattcacccttgcagtaagtgctaatgagtatgatttgtgagacagagagcagttcaaggatttactcatggcaatttggttctttctttccacctcctgttaaattctgcagttcttccttccatggtaggtcattgtcatgtcatgtagggtattgtacttggttctccttgaattgggctgtcttcaagattgctccttaagcccagctggttgaaaaaggaaaccggtttcagattgtgctgatgtgcaaactgctttaatcaatgacttgaagtgactgctggtggcaaacaacagacgctcttaaccaattaagatatttaggaaaggatgttaggcttttgttaaaatagtcactaatgaactgaaatgtgttaagaggagccaagaaacagctaggagttccacttaaatgcaataaaagtgtttgggtcctcccctttcaaattgcatgcccaaggcaaaaaatatgctgacacagaaagaagtggcaagtgtaatttggtacagttagcctgtcagatccatgcgtgtctacataaaacctagaaaaatgtcgtgcttgcttctttggccagaaaagggaagggagtttaattcctttatagaacagtttcagcagggctggagaatattaccagcttagatgtctttggaaatgggagaaaatttaacttgtttttagaggttccttatgttttagaggttggagaaaaatcttcagttaatagtcataattaaaggcccgtttttattttcctctgtcagattaaactactgaaatctgtagttatctgttcatgtctctcagtggtaatgaggctcagccataacactcaggataatatggtatttcattggtagccatttgaagtcaggagccattgctcatataagaactacttttttacaattcccttgctcttggaatccaatagtgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattatagagttgtaaaattatcaccacagttcaaagaacatttctctcacacccaaaaattcctgggacctgttcatagtcagtttgggtctggagtgcacacaggtggtgggaggttgcaaggtgatgctggcctacatgacttgttctgataatcctgagttattgcaccatctgttgaatgggctggcgccatcttgggcctgacgagttgtaaattagctgcagccttcaagtaataacccggtggtggaacattctatagatacctggattgtctctggaacttctaagcaaacataattagacaagctagcaatgcagtggagtgtctggtggaaaggaggagagtaaaggttgttatttcataactaaaaagttaatacaaagggcctcagaaggaaaagtttaagaaaaaaagactaaaaaatagaatactcggatacactccaactttgttcttttctaaaaatgttttaactactctatgtcatttgcgtttccatggaaactttagcatcagcttttcttttctttttttttttttttttgagacaaagtctcactctgtcacccaggctggagcacagtggtgcgatcctagctcactgtagcctccacctcccgggttcaagtgattctcgtgcctcagcctcctgagtagctgggattacaggcatgaggtactacgcctggctcatgtttgtatttttttaatagagacagggtttcgccatgttgaccaggctggttgaactcctgacctgaggtgatcaacctgccttggcctccaagttttgggattacatgcgtgagctgccgtgcctggcccagcttttcaatttatatgaaaaacccactggtattttgatagggattttattgagtctatagaagagttaagggaaaattgccattttaataatactgagttatccatgaacatggaatagttactcatttatttagatcttattttttctccataatgttttatagtttttagtgtacaagctatacagctcttttattaaatttattgccaagtattctttttgatgatgttgtgagtggaattgttttttaattttatttttggattatttgttgctggtatatagaaatgaaattatttatttattatatcttgcaaccttattaaacttattagttcttgtggttttttaaatatacttcttaggattctctacatacaggatcatattgtctgcaaataaagaaagctttacttcttcttttataacttgtaagtttttctttctttttttttaattattgtactggctggaacttctggcacagtgttgaatagaaataagagtgaacatccttgccctgttcctgatcttaaggaaaaacctttgtctttcactattagtatgatgttagttgtaagttttacccagatttcctttgtcagcttgagaaagtttccttctatttctaattggttgaaagtttttattatgaatggatgttgagttttgttagatgcattttctgcctctattgagatgactgtgatttttattcttctgctaatatattaattgacttatagttgttaaatcaaccttgcattccaagtataaaatccagtcgttctataaaatcctttttatatgtactgaattcatttagctaatgctacagtttgaataatgtcacccaaagtttatgtgttggaaacttaatccccattctaacggtgttgagaggtgggacctttaagaagtaattaggtcatggaggcatcattctcatgaaaggattcaggccattatcacttgagtgggttagttataaaaaggatgagttcggcctgatttcttctctgtctctggcttgcttctgccttctgatgtggggtggtctcctccagctgccggtgtcatgctcttagacttcccagcctccagaactgtgagctaaataaatatctgttctttataaattacccagtcttgggtattctgttatagcagcacaaaatacactaagacagctaatattttgttgggaaattgtttgtagttttcttgttttgtgtgatgtctttggttttggtaacaggaaaatactggactcatagaatgagttaggaagtttccttctcttcaagatttctattatttattctttacatatttcatataatttaccagtgaagccatctgagttctttgtggggagcttttgttttgttttgttttttgaattttgagattgtttcatttgaaggtcaccttaatgctcttaaattcaaaaatatgctaatttaaataccaaatcctattaatctaaaacacacattgcaaacatacaaatatctcttctcttcacatgtcagtgcccattcatgtcatggtttggaaatggggacagtagattccccttgagctgcaagtcagcatatgtttctttatagttaactttagcaaaatttatacaaaatagtaattaacaataatcttctttatttgttaactcaaaagaaaataccttcaaaactgcattttaagtttctgtactaaaatacagaaaaactacacaaatattgaaaagttgaaagttctttaatttttttattcctgttatcactaccacaatttacagggcaatatacttgatgtaatgaaaaagaaacagacaaagctacaacagataaaagagctcaggaatgtacgtctaatcgacactatattgcattcattaatagctgcacttttgcaaactgtggctatgatagtcctgcacaagaagggttttctgtttaagctgcaataacttttctgaccatggatcaccattccttctgtggcagatttttacagttcctctaatgcatttgggatgactatctcaaataacctgcaacttttgtgacaactccttgttctttctcctgctaagaattgtagcccctctctgctgtttttagaaccttctgctaccatatccgtcacgtctaccgccagatccgtaaccaccaccaccacaggaactccccgagcttcttccaccaaaactgcaccctttaatgggttcataatttgattgtttttgtctgctaaaatttccagaatcattatagttcccaccaccaccatagttaccactgccagaatttcctccttcattgtaaccatcatatccttcaccactatccccatacccgccattgtggttttcatatcctggttcaccatctccatagcccccactactgctgtaggcaggcccaccaccattgttgcccaccgtcacctccacatccattatatccaccattacaccctccataaccacctctgctgccaccacctctacttctaccaccagagcctcctcttccaccaaagtttccaccacagccaaaattacttgcaccacttccagagtttcctccacaacccataaagttgtcagatccacctccatcacctctgtgatcctgcagactgcatctcttgtttagaaagggcctttttcactttacagttgtgcttgttaatagtgtggtgtttctaaacaacagttttatcaattgtatcatgatcatcaaaagttaaaagtgcacattctctctttttccactctgtcatccataacttgtatggtttcagtcttgctatagttttcagagtaatttctgaaactgtatctactttaataccaccagcaaaaatgttcttcactgttaggtgggcaccaggctttacagaatcctctctagaaacaactgtctttggttccactccacacccatcaaccttgtgtggtcaagcacacattgctgtgtccacctcttcaacacaagagaaagccataaaaccaaagcccctggaatgtttgcttggggttctgtcattaccacacaatctgtgagtgtgccccctttctcaaaatgttctcttaacccatcatctgtagttttaaagctcagaccaccaataaacaattttctcagccgcgctggattcctttggatcatggccttcctcctcttggcggcagtggcaatgacaacggccagagtcagcctaggggcaaccgggtagtggttttacctccattttaagactagacttgcctcctccaactcaagttcaacatggaactgtgaggaagaggctgtgggaagctttttaatactaattcaatttttttcttttttttggatacggggtctcactctgttgcccaggctggagtgtagtggtgtgatcttgactcactgcaacctctgtctcccgggttcaagccattctcctgcctcagcctcccaagcagctgggatgacaggcgcccgccaccacacccggcaaacttttgtatttttagtggagacgggatttcaccatattggctaggttggtctcgaactcctgacctcaagtgatccacccaccttggcctcccaaagtgctgggattacaggcgtgagccactgcaccgggcccaatttttaagctaataaatctggtcagttttaaaatttcttattgaatcagttttagtaatatgtctttataagaatttgttccttttgtctaattttttagtataacattgattattattcccttataataatatttttgagatctgttctttatttctgatttggggattttgtatcttccctttttcttggtcagtctaggtaaaggcttatggattttatctttttaagatcccagcttttagttagttttattgattttctccattattctcatttaattaatttctgctctgatctttattattccattccttcttcttactttggctgtaattcacttttcattttcttgtttcttaaggtggaagcttagatgattgatttgaaacctcttttctaatataggcatttaaagctatacatttcctgctaagcagttttttagcttcacaccataaattgcgatgtgttatgattttgttttcatttagtttaaatatattctaatgtctttcatgattgtttctttgactcttgggttatttaaatgtgttcttaaattccaaatattgaagatttcccaatttcttcctgttgttgatttttaattctgttatgattggagatcatactttgagtggcttcagtccgtctgaatttattcagacttgttcttatgtggtctcacatatagtctgttctgccagttgttctctatggccttaaaaagtacatgtattcacctgttactaggacaagtgtgctggaaatgtcagggcaatttggttgatagtttgttcaaatctgtcttttgactttctatctagttgttttccgtgacgttttgagtattgaaagttattcaccttgagaccttgtgtgctagtgagacctttatgattttggtctcacctagctaaaccagcttgggtcatgagatcctagtgaatttttacagggtgacactaaagaaaacactgtcaattcaggtaatagagtatatgttaaataaaagtcttcaggtattggcattttaggaaaaataaacttagctatgtgtgctgcaagactgtatgtgtttctgaatcctctgcttcgagggaaaaatcatattagtagaggataagtttactcagtactggaaaaattgtgtagattttaggaacttgttggagcagaaaggcgattaattgtgagaaatgaaagtcaattttagtggcagcaggtatatcaagtacatcaagtcttagttcaatgtttatagattttgaaaatttataggttcattattcctttcatttgtttcttcttttgtcccatttttgtcaagcatgtatttattttgtttgaatccttttttgtctcatggactgagaagaaaatataactaaggttggattatcccacaatttgctctgtgtctaattattctgaggtggattgtaatgaagccagcaagacttatacattggaattttaaatgtatgggattgtaaggagggtagaagctacaaaccaaagataagatatgcctgcagatctgcttcagatttcctgagggcagtagatgaaattatttctaagggcctttttcaccactgctctttaagtatatgagtaataaacaaaaagaacaaagtatgtggttcagaaggaataaaacaaaaaagaaagaaaaggatcaatgaaatagaagtattgtgtcaccccatgaaaattgtcttcctgttgagagctcactagaaatagaaacaattgttttttatctccttgtatgacaatctcttaactgtttcgagatgatttacttgcttcttaggcttccattaaaaataagcacatgcttatatgggggaaaatgcaaatagtaatataatagcatataaagttaaaaagtggacatctccttctttattgtctccctccctttgaaactctgcccatacccacattctgtgtcttcataggaataaccctgttcatccctactgatgccctgtattgtgatcaagatggttaattgttttagggtataataaattggggatatagtcagagacagtacattttgggagaaccctccattcccagtggcatcaagcagcttgatcaaagaaaagaaaaaggtgtacaccaagatgagatgaggcatacttagtaagcaataataaaacgtcaagatgtcttcatgcatataatcatgacaatgttggatgtgatatctcatccctgtacatctgcatatatatcttatatagcatgttattctttctgcatttcccccttcaatagagctttattgtaaccatttccatctctgtaaaattaagggagggaggggataaaagagagttctagactgtctactcccctaagtggcagccagtgctaaatacacagcttatgggtttaaactgaacgaacaacaaaaagacatgttcattccttaggcttttagaggaataaaccagtgaggcctacaccatttattcatccattcaacaattatttgttgaatgcctactgtgtgccagtcataccaagatacagacagtaaacaaataagaaaatatatgtcaaatggtgataagcatttgtgttagtgtcctagtgctgcagtaatggagttccacaaactgagtgccttaaagcagtggaagtttatccttgcagttctggagactaaagtccaaaatcacaggactgcttccttctgagaggtatgggggagaatctgttcaatgctctcttgtagcctttggtgacagctggcaattcttgcatcccttgacttgtagatccattactgtaatctctccttctctcttaacaggggagttcttgtatgtctgtatccaagtttgcctcttcttataaggatgtcagtcctattggattagggcctttcctagtgacctcatcttaatttgatcacacatctgcaaggactctctttccaagtaaggtcacgttgtgaggttttggtaaggacaggaatgtgggggcggggtggggatactattcagcccatgacagcactatagagaaaagttaaagcaggatagtgggatagggaatgctgggttgagatgggcttataattttatgtagaggatcagggaagtcctcactgttgaactgagaattgaggatagtgagagagagaacctagtggatatctgggaggagagctttgcagacagagggagcagcatgttcttgagaagctcaagatgactatgcttggctagaagcatcagggaggtccgtgtgactggagcaaagaaagtaggagctgagaagtcagagagctggctggggtacatatcacataaggcctcctagaccttttgcttttctctgagtgaaatgtgaaaccattgaagagtttgaagtagcgaatgatctggttttatatttcataccatgttgaggaaaagggcaaggttgaggtaggcagatgagttagaaggcttcggcgttaatccacgtgaccggaggtagtaagaagaggtccgatttttgatctgttttgaaagtagaattgtcaagttttgctgatcatttgaatgtagagtgtgtgagagagaaaaagtttaaaaataactcccaagatttttagtctgagcaactggacgaattgccatttgctgagaaggagaagatggtcatgcaggtctggacttcaggaaaaaggtctgagttgtatgtataaatcgtggagaaggagccatagagactttaagacatgagactggaagagatccttgagtaacggagaggcatgggatctagggcacaggtggaaggggtaacttagataacacacagacagttcagcaaaggcaataggatggaaggcagactatatgggtgcagatgcaggtaggtgactactttgaagaagaattcgtggaggggccgggtacagtggttcacgcctgtaatcccagcactttgggaggccaaggcgggtggatcacttgaagccaggaattcaagaccagcctagccaacatggcaaaaccccatctctactaaaaatacaaaaatcagtcgtgcatgatggcttgggcctgtagtcccagctactcaggaggctgaggcacaagaattgcttgaacctgggaggcgggaggttgcagtgagctgtgatcatgccagtgcactccagcctgggcaacagagcaagactctgtcttaaaaagaattcctggaggaggttggcataacctggtccattatggtaaaggtggataggagagggcccaaagaagggcattctaaggaaggcaaccacctaagtgatggcgtgtcctgatgttattaatgggactttctccagaaataagcagtgttgttaactgttgttttgccccttgagtatctttttttttttttttccgagatggagtttcgctgtcgttgcccgggctggagtgcaatggcgcgatctcggctcactgcaacctctacttcccaggttcaaacaattctcctgtctcagccttcctgagtagctgggattacaggcatgcaccaccacacccagctaattttgtatttttagtagagacggggtttctctgtattggtcaggctggtctcgaactcccgacctcagatcatccacccgcctcggcctcccaaagtgctgggaatacaggcacgaaccactgcgcccggccttgagtttcttcattggcatttctgacaactttgtatccatttctcttctgctttctaatcatcttctaatttacttctcaggtctgtcttttcctttccatcttatcactatccgaattcaggctttcattattttatcattggacagttccagcatccttcattaataaccttcaaagttctccttcattcctgcccatatgtttgtacagatttaagttcttatagcacagattttattctgggtcagcccttattaattactcccattcagtcccccattcaaggcttgccacaatctggtcccattctgccactcccgacccattcttatacagattccctctgtgaaccttgtattcaaaccatgttcctgctaatgcccttgcagcatcggctttctaaagctgattaactcttttaaaaaaatggccattcttatctttacccccaaatcctactctaaagagatgcttgtgatttgagaaccggtatatctttggatcccaatgccgcccgtagttttattgtagtatgactcattagatactgctgctgctttaccatcagtgagacaaaatgacctccatctggcttttttggttttcattgcgactttaataaaacagtgcttgggagtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacctaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagtttgatgacatctagtcaggtatgaagctagatagatactataaaattgctacagtaccaatcactattatcttacatttttcctttcccctactgctcatttggaatggaatcaagcatggtgataaggttcttaattcttctctatcaattttagtaagcattggcaagttttagaattctaggaccttggaaaattgtggagaccctcttcctctgccctccctagtcttcaccccccaccacaacacattctttcaggcatatggcatatatatttcctaaaaagctgaaagatatcatttcctcatttaattagaaagtcttcctttagtttctttcttatgttagcataatgtctcaatattctactttaagtgtactccgttgtagaattggggaaaattagttacactaggcagtgcatgttctttggtctttagttaactgctgtatgccctataaatattaattgatgaccttcaggctttatgggatatgtttagtggttttttaatggttaaactgaatatttttaataaaaaattacaagaccatagaatgccacagaaccattccacttaccaggaaacttaaaatttgccagctgacctgggaacagatctggtcatatacccaagctatttaagaagaggaatattattcatcagaataaaaatgttatatcataatgctctcttacataaaatgagcttacagccagtgggctaactggatatcatttttctggtttcttgttagctcccactaccatatttgttacacagagtgaactaaggccaagagaccttccatatcattcttcctgtggctacaaactaggattcacagctagctcaaataaaaacagaaataaaaggagagagatctcatagtctgcaggaatggattctgacaataaagaccttgcatttactctgttccttgtgcctggggtttttaatttaacacatcaatgaaaaggcaccatttaaaaaaggggggaaacacccagcaggacttacttttattagtgcaatttgtaagaaattactgcacttaatgagaaaatcattaagcatgaaaaaatgggctctgactgaacttgtggaacttaaatggtgaggttttaattgagttttttagttattggtaagaataataataataatttaaaaatacaggactgcatctgtgtgttgaggtggtcagcactttgcatatcttagtccaatttcctgtgccactggtcatgcataatattatggctgtggtgttctctctgtcgtatctactgatttttctgttctgaaagggaagcagggaacttcttttttgttagattgaggaagtttggggcaaagagctagcagaacagtttctagaaggtggaagaactgtaggctaaggcaaagagcagagctatgtctgcttctcagtccagctgcttaaaaaagatgacaaatttcaatgtcattttcaggttactcaagcttatgcttttttcctagttctctgtttcttttgttgccatccagtgatttatttttcctcaataagaatatttcattaaagaccatgcaactagaaaacaagaataccaagagcaaagagcactcttcagtccgaactcttttagaagtggaagcagaaagaagggtgtttaagaaataagtcagcactgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgtcacaaccgtgttagaactgaaggaaaggaaatgtatgtaactctaaagacgtttcaagtagaagtgaaaacaatatttttttacataatttgttttttatagaaatacagcttttatcaaatgtctgggagaagctttaaatatgcttttgaacttcttcagtaacttttaattgaatttcattgtatcctacctcactagaaagaaagaaacctgcaaattttagcttcccttataatttaaatgatgccttgctaatttctgtgtttttgagatggagtctcaccctgtcacccaggctggagtgcagtggtgagatcttggcccactgcaacttctgcctcccaggctcagatgattctcctgcctccgcctcagcctcctgagtagctgggattacaggcatatgctaccacacccagctaacttttgtatttttagtagacggggtttcgccatattggccaggctggtcttgaactcctgacctcaggtgatccgcccgtctcggcctcccaaagtgctgtgattacaggcttgagccgctgggcccagcctgatgccttgcatttctgtctcctggaaatatccaattcttaaaagaggccatccccttgtgagttcataacacactgtgcccttagatcccctcctcaccctcccttcttctgtatgccctgcatctgagggaggtgtgggcagagctggctcttgtaggttgcatttcccaggctcctgtgtctaaagacttcctactgggttcggcatgagagatactggtgggaagtagggagggagaaaccggtgtatctcttcttccctttctatgttgggtagcatctttggtcctcagtgtcttcagctcccataggacagatccctgaactctatttatacccttttctttttcctgagtaccaagggatgctaagggtttcttgctgttaccaatcccggggttacagcaccattctcagttggctttaacacacttcgtaacctgcaaaacaatttcctgtcttaagtctcctgtgttaaatatttggagtggtttatattccttgtgttggtccctgactgatacacacaccgcctctacccacaatggccaatttatatccgatagtaaagaggcataaagaaagcccgcttttgatacgtttcttaaattgcctctgttaaaacagactttcttatcaggcaaatatcttttataagtttctggcttaaacaatgattataatttacaggtggatttaatttatggtagactggactgcttgcctagacttttatttgctgatgggcattactcctttttattctcttaataatgaattacctgaccttatacttattttgatttaagtgcttgatttttattgtcacttttaattttgtgttataaagatgcaattgtcattggctacataaatttgtttttttcttttctttttcttttttttttttgagatggaatctcactctgttgcccaggttggagtgcagtggcatgatctcggctcactgcaccctccacctcctgggttcaagtggtttctggctaatttttgtatttttagtagagacagggtttcacaatgttggccaggctggtctcgaactcctgacctcaagtgatccgtcctccttggcctcccaaagtgctagggttacaggcgtgagccattgcgactggccataaatttgttcttaacatttaaaatttatttaactgctgacatttgcaaaatgtacagcatttcaataagtaacatttacatgaggcattgagaaagtgagaagaattaaattgggaaatatcctaaatgatggctgagttcagccaaatcatttgaggtgtcttcacagtcttttatatataatgtgtgacagatgagggaacctactgctttttgggctctgtcagatggaggagaaaatcccacaataaatgacttcctttcactttgttggaaacatctttgcaaagaacagaggtagtgagtaaatgtaaagtcagaggcagacatgcacatggccctgggtgttttgaccttggtgactgtgcaatgagaggggaggtgtagtccattttataggactttgggtggtgttgaatgtattcagtagagaagcagaatgtgtatttcagattaaacaagaaaacttcgccattttcctcttctgtaacatttctaaatctggataacattttgaatatgatactgaagtattgtattgagattaattttgggtgtcaacatctgtactcatttaagatactgggttagtatatgatgcccatatctaaaggttttgcattttctaaaacctcaaaatccaaaacagacatttgaagtaatcctggaaataaatgacagccatttgcctgacttagtatcctaagatggatggcccttccaatggccattttttattttagctactaatgagtattattgagtcactaactaatttcgaaaagcattttggtgaattataattggggctgtgatttactgagtttgaagactgataagccattcctcagccctgtaattaatgtagaagcagagaaaagcaccctgatgatcagcatttcctttatgtggggcaggggagtcaaaagcatattccagccaaatattatagaatattattttttcagccatttctgcattttacttttattaaaaatggcagggaaatgtgaagtgccacaaaactttggaaaggaagtctcttgtttacatcccttttgatactcagtatattcaagcgtcatccatcacagctattccctggtgttaaatggttcgttatagtcagtgaaccacaaaagtagtctgggtagagggacagaatttagaatcatggaccagatttacaagccacgtaactgagtattcctagaaggccaaaatctggttgtttgtattctttgggtttattggaagtttggatatgtttatccatctgtgtttctgaaccctctggaggaaagagcacaacagtctaacatgtaaataagaaaaactaaatccacataggcccacagatacattaggacttcatttttttttttacaaagaaactgggtattgagactcctgctacttccttttacaaagaatttatggtagactggactgccttctttcctgtatcgttgcaaatggattgttggcttgggtatttatttttgtttcttttgaatatttttctctgtaagatagcaactgtgtgtgtgtgtgtgtgtgtgtgtgtgtgtgtgtgtgtgtgtgtgtgtgtgtgttctatcatatttcaggataaaatgagtcaggaagctggttgttttggttttttgttttgctttgttttttcgcaaagcaatttagtacctgtgtagttgtttcatgggctcccagnnnnnnnnnnnnnnnnnnnntactcttttccgtgtagtctttatgcagtagtttggacacagcagacaactctttcctttaaataatctcttctcttagtatctgtgatgccatgaactcctgacacacacacacacacacacacacacacacacacactctctctctctctctctctctctctctctctctctctctccccgtctccctgtctctccctctctctctctctgactaatccttcttagcctccttcttcagctccctttccactatccaaccgctaaaatttcttctttcttctacactttctaaggagccacgctgtacccctacctcaggactctcacacacactttctcttcttggaactccctttcctccagccatttgctgtctaatcctcactcttttttcttcccctatttctgtccatgtatgaggccatttgcttttctccaaacacagcttgtgctttcttcttcatacttaggctaattgtgtttcctgctgtgtaattgccaaattctgtttttcattgcctagctaaaaagccatgttgatttgtgaagctttctgtaatcaccaaagattttttaaaaattcaaaccaattaatatatttccttaaaactcatagccctcttcacattatttcccagtgttaattttatgtatatgcattatattccctattcaactgcaaactcctcaaaggcaagggccttgtcttcaacttaattctgtctcccacagaacataacatagtatcttctacatagtagttgcacaataagtatatactatcaaacaaagagaaacatttatattatagcttcctaagatttcctattctcatttcaaaagaaatggagaatttagagtctctaggattattgcccttggcctgtaaaggtttttatttgtgcccaaatatgtaacctcgagtgaactttgtatcagatgatctgggaaagtacaccgctttctgttatcaaacatttctgttactttgcttttcaagctgaaaaggggagataacttctgtttgctttgagcttttgttgatggttttctgctctgcctactaatcagggttgtattatttaccttgtttaaaaaggttcatctgaacattctctctctattttgaattgtaattggatattaattcactgctgcgggatacgttggtaaagatttttgaaattgcagggaaatgtttctttaatccctcaagtttgttaagtgctttcttataatggagatcataatctccgagttggtagaagggatgaaacggttactggggatatttttcccttgttagaaaattgctgtattaaaaaatacttcatccagttttttaatcctttccacatgctgtatggtccttaggaaataagtagattcttagcaccgatttcatgtttttaataaggaaggcattgagtaatgttcaggtcactgtgattcacagagttagtggcctggggcctttattggtaaagcttgaaagtagttttctttagcattgtgcatacacaggtagctgctagaatgctcacaggaggctgtgatttggggaaacaggcagtcatagaatatcttgaacattcagcataaattgccaaacagccacagctagtgaatggtttcaggggacaagggagaggagcctttaggcatgattacccacatctccctgatttgttcttccacacacagatcttaagggtcagttttgatctgcacagcattaagtttcctcatgacttttagatttcctttttcctctgctttttattcatactgaagaattttttgtttctttgtaaggtgtaatctactttggaaatgataacactatgaatgcattttctctttctgtagcatttatgacattgcttgctgacagttactgtttattaagtatttgtggcttttggagtagtgagcaatagggagaatattcaggtccagctaagggcataaggtagatagcaatgatttctcattcgaaagggatattttgttaagactagggctgatcttttctaatttaaccttggattggtagaagatggggtgtccctggctcattatttttcactgcccagcactgttcgacaattatcctgagtagaattaggggagggactagaggatctgttttctgtgaatacaataggaaaggcagttttgaattatccaaatggcccctaaattctgggggaaaataaaataacaacaacagcagttttaaaaataactacaacctaggttctgacatcccaaaaaggaatatttcaactataattctcagcattttagaaattaatttcttgacaaatatcaataggtatcattcagactttgcaaatacagagttttgaaatcagaattttgcatctcatctctcccctaaaagaagtatggcaattgtgcttgctgaccatgaggcttgtgaactataatacatacttataggcacaaacacagaagcataccctctctcaggcatcactcaaatctaagaaaatttgttgtcttatgttttagcgagtaaccagctcataaatcacatcgaacagtttttggatactaatgaaacaccgtattttatgaagagcatagactgcatccgagccttccgggaagaagccattaaggtaatgctatcctagcatctcttttcttcctaaacagttggcgactatcacagggaaagaggcatacagcatcctggaaatgagtctgggccgtggaaattatcattctcaatatgaatagcagtgtatgccagtggagctaaaaatgacttaaattcatgttactatcactgtcatttctgagatgggataaagatgagtaggtagggtgttttatccctgaaagttggctttttattgtactgaagacctggcctttgctttctgttcctatttagggaaccaaggaaatttccattataacctctggtggcccactcactattgtaaaggatgggctattttagggaaatggatgggaaatatatattggtataattattgagaaagattttatgaagacaggagtagggatctaaatgtcagaaaaaaaagaacactgacaataagttcctcccatgccttttgtgtgggttttgtctgtttgattgttttattaggaattcttagaaaatatttctaaaacttttccaaattatgtataggcttttatatctctaggtaagaagtgagcaagtttaaattagaaagcatattttttaagtgggcacagttgtagtatatgttcttgtgtgggtgcttattaaatacttggcgaacgtatgaatgaattaatgcttaaataatttaggtgcttacaaagagtgacaagaaaatggaaaaatcattaaaattagattcaataacagattcagaagtagataacctgaatactcttagataaaagacaaattttagaaaagtagagtcaggacaagactgcagatgattcagttggatggagaaagatttggttcaatggaaagagatagtaaaagtgtattgcttttttaaagcactacccaggctaggtggagtgtcttataacacctctgtgcatggttgccacccagtgtccttaaaaatactaggtcacattatatctcttaaaaaaaataaaagagagacaagagaagcagaagagacttcagtgacatatcattcagtcttaatggagagattattattttttcttttccttttttttttttcttgagacggactttcactcttgtcgcccaggctggagtgcagtggcggatctcggctcactgcaacctctgcctcccaggctcaagcgattctcctgcctcagcctcccgagtagctggcattacaggcgcatgccaccacgcccagctaatttttgtatttttagtaaagatggggtttcaccatgttggccaggctggtctcgaactcctgaccacaggttattcgcccaccttggcctcccagagtgctgggattacaggggtgagccactgcgcctggccaagggatattttttgaactgtaaaaagattaagttttatggaacaattaggaaaatgagaatactggctagttatttggttctattaagaagttactaattttttatgtggtgttaatggcatgtgagtgtttgttttaaaagactatattttctatatttcatacaagaatattcataaatgaaataatttgactgaaatttgcttcaatataattggagggttatgggagaagaaggtcatagtatagaggaagcaaaattggtttggttgataattatttctttattttattttttatctttgagaaggagttttactcttgtttcccaggctggagtgcagtggcatgatctcggctcactgcaacctccgcctcccgggttcaagcaattctcctgcctcagccttccaagtagctgggaatacatgcgcctgccaccgcatccagctaatttttgtatttttagtagagatggacccatgttggccaggctgatctcgaactcctgacctcaggtgatctgcccagctcagcctcccaaagtgctgggattacaggcatgagtcaacatgctcggcctgagttgataattattgaagctgggttatgagtgtgcgagcactcactaaattgttctctgtttttgtttgggattttctacattaaatgttaaaaacaaagggctaggccaccgcagaaaaactgactctgggaagctctgtgccttccacagatggaaggatttctggtccccagtgaacacacctcagtttggaatgccagcttcccatgtaccaaagaagaacattttatttttttgtaataaataaggtgattcagaccaaactttgtttggtctggggtgaatttgtttttgtgtttgctctgacttgctgcctcctctaccccaacttgctaccacagttttcagaagagcagcgctttaacaacttcctgaaagcccttcaagagaaagtggaaattaaacaattaaatcatttctgggaaattgttgtccagggtaagttgtcatttgcctttttttttaaaaagtatttttaaaatacttatgctattttattctaaatatacatataaattctaaatataaactgtattgtataatgagttatgtgggaaacatgatgactttctacatggctttgggaaatgctcagtgttcggtgaactcaaactctcccttaataagcataaatacagagtgataaataataaataaacatgtaagttccatcttagactctttacgcagcatgacctatttcatggctgtgcctttctgtttgttgaatggagcagctgtgtgggcgaacattgtcccctttctcagatccttaggccatttcagtcctgctggttccacagccctttggttgacctcacccagattttatctccctgctacttttcatttaccatgttcttggactttccgtttcaacagaccagcatcttcatgtaccaaaaccattcagttcttcacttgcacagcaaccaatgcaagttaaacccagaaagaagacagcacacattctttcagtgttaggcttgatctttgctttttttcatgccctttgccccaccttttttaaaacatgacctgattttcttttagaacccaagtataagatattacttgtttaaaatacatattatgaaaatgattatgtttatgagataaacttttcacttatactagagatgcaaaatttgtttcaatctctttctgtgcgaattctatataaaaagaattgcatacctatctatccgccttctaatgggcaactcttcatcacacaggtaactgttttcctgacagttaatttttcagccctttaacttctgcactggagaacaaaaggaattggaatgggtagtgaagggggcttactcaaatcacttttgtgtctctgctgttgaccccgtaaatgaaggagattggttttggtatttattgaatgcctatagcgtattatttgctgaaaagaaacttacaggtcatatgcaaaatccatattttctgatagcttatatgccactgagagaatacagatgaccaaggccattcataggtacacatgggtgttaaatacatgtgctttttgaacagtttatcaggtatcagccatttgatgtaggaaaataggaagaagagcaaactaaagagtagattttctacccttgatttgctcttactgagctaaaattgattaactgtcctaaatgatagacatgccccttggtgaagaccatgttttcttcctccctagtcctctggccactctatcaatagccagtaacatggccacaagacaaaatgcatggcgtagttccatattgggcaccggatgtcttggacaaaagcatacagtcatttaattatcatttatttattgagcttctgctatgttctacagtaagtcctctcttaacgtccataggttcttgaaaattgtgactttaagcaaaatgacacataatgaaaccatttttttctcatcagtgttataatgaaacaatattatttaagtacctacttttgtttcacttaaagtcacagtttccaacaacctattgatgatagttaagtaaggacatactgtacattgaggggaatataaagacttataagacttagtgtctgcccttgagaaaatatattcttaggagagagaacatgtgtacaaatagttacataaaatacgacaagagccatttcaaaggaataaacaaagtgatctgagatttctaaagaaggggagacttatctagagttgatcaaggaaggcttcatggaacacgtggcatttgacatgcggcctttattgcttattacacaggcaaaaactggagaaaagataatttaagatggtcattgttaattggttgcctttatagttttatattttttgtagaacagagcacctttatagttttaaaaatctccagctcaggctgggcacagtggcacatgcttgtaatcccagcactttgggaggccgagacgggaggatcacttgagcccaggagtctgagaccagcctgggcaacatagtgggaccctgtctctatttaaaaaaaagaaatcttcagctcaaaggtgggaggaggtgtgatggaaacgaaaatgggattggggttgattctttgtgttttgattttactctctgaattactttttagatggaattactctgatcaccaaagaggaagcctctggaagttctgtcacagctgaggaagccaaaaaggtattgaggggtaaacctttgtctttagttgaattattatagtggactttattttcttgataccctcgaagaagttaaattttatgggtaactaaattagtgtactcattttgtattcaatatgtaaattgcttcaaccacagcatccccatgggagaaattataatcttactcagtttcctgtaggctgtggttatatttctggaactcacctgtaatcccagcttcagtacccctagagcatgctgttgaaccccatagtgcgcaaacttagcctcggccctggtaaaggctatgaaatccacagtgattcccaccctggccacacattagttacttggtgagcttgtttttcttttttttcttttcttttcttttcttttcttttcttttcttttcttttctctttcttttctctctctctctgtttctttctttcttttttttttttgttaatactgattaaaaatcagaattaccctagagattctgttagtctgagatgggtcctgggcacagttggtttgtttgcattttaaaacccctcaggtgattgtattgtatagtgaatagagaaacactagtattctagcataagggacatccaagtattttcagtaaaagaccccatgcagtccccatgagcttcttattcacacacattgttaggcctaggcctccttgtttggtgtgtattgaatctgattcagccatgagtcagatacatgtggttatttagttcagtagtccttcattgtacctcaaggttgtgatgaaattttaatgaattaagttgaatagctcaaaagtatatacttcgtaacactcagtttcagttacagtcactgactgatgtagttctgctggcacctgacagctctcagttactaagcttctgcgatatgctaggcactgtgctggatgataagacagcacccctgccctctagaagctcgggcagttaaaatggagcagagggaagcaacggagactcagaaaataactatacacactaagggagagcttggtctggggctggtgaataggaatctgttagggaagtgacagatgcaaagctggaaatgttaatcagatggctaaattcaggccaaaatttaaatatcttcaattttcaactcaagaaaggcatttggcagaaaccatgtttggaaaagaaattaaaatttacaagaatttttattaagcactttgcctagcaaaagatttttgttaaaaaaaaaaaaaaaacttgtcatccctactttcagggagtagaatcctggaatttttgaagcatactgtaagatggtgattatatctcagaaggggttccgtggtgtctgtaccctctctgccacaggcaatactgagcaccataggcttgagtatgccatttaactgtttggttttgtttctgtttgtcactttatacaatgtttgataatatctcctcattgaactgggctatttcagtcaaggttctccagagaaacagaaccaagagaacgtacatgtgtgcgtgtgtctgtgtgtgtgtatgcacatacacacacacatatatatagagagagagatttattggctgaatttcagaaattggcttgtgtgattgtagggcttggcaagtctgaaatttgtaggacaggctagcaggctggaaactcaggcaggatttctgtgttacagtcctgaagcagaaacctcagcttttgctcttaaggtcttcacttgattggatgagatctacgaatattactaagattaatctttacttaaaatcaggtaattttagatgttaatcacatctacaaaataccctcacagcaacatctagagtagtgtttgatggaacaactggggaccatagcccagccaagttgacacataatattcattgtcacatggtgtgaagacctatcaatcaatttttgttaaacaagtaaatcaggaaaaatattttttgtcattattacattaagaaaatttattatccaggtgacagtacatactagagtttttggaagaagtgaggagccatgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaaggcactgagcctaagcatgaggaattttaatgtctaatgatgaagctatagagagaaatttcagttaatgaccaggtaggtataagatggtgtccttagataattctgatatcagaactgatgttagttgtagtttaagacaactctcctgagacaggagaaccgcttgaacccgggaggcagaggttggggtgagccgagatcgcgccattgcactccagcctggacaacgaaagcgaaactctgtcccaggaaaaaaaaaaaaaaaaaaaagacaactctcaaaacttcaccatctttgaatagagagaacatcataaaaaacaagtggagagaatctcttctacttcagccacgggttgcctggctctgactggcatcttcttccttttagagcatagtgtttccatagtcaaggcacagagagtgtgcttccagtactaccagcaaaactgaacttcactgtcatggcagataagaagttaggaaattcaacataaaatgtattgagtaccaccagctctatgccaggcactttgatatatattatctcatagcctccaaaaaaagtacattgcacattcacctagcagactctttcacatctagaaaatgccatttcctttttttccccacatttatcagtgctttagccaatgtagtatgtataccagatatttagataacactttgactgctaaagaaccattcacattgtatggtgtttgtctacaacactatatacatcatatctagataatggtagaaaataagagtagtagaattttacttgtatccaactcccgaaccaaagagcccagtattatctctgtaatcttcacaatgatctgctaagaattggcaagagcaggaactaccatccctgttaccactgggaagccaatccccagaaaggtaaagtggggttacactttgagctcaccgaggtagcaagaggattaaaatgcacgttcctttgcaccacaccagaccttcgttttcaagtggattaagttttgtgaatggaatcttggaccaatcatttctaaaatacagtactccctgtctgcttcatctcaacaaatgactttctggcctagagccaggtggtggttagaataacctggaaagtcatagagtagaccctgtaattttgactcaccttcagtgtacgctgtgttatatctgtcagttctcattagtatagtggtgagtacccccacctgtcactgtatcatgcctgactgtgagattatgcttttgtgtctgctttaatatcacatgaaccctttattttgttttccagagtgaaaacttgatcctttgtatgaaaaatgcttttatttatttatttatttatttatttatttatttatttagagacagagtctccctctgttgcccaagctggagtgtagtggcacggtctcagctcactgcaacctctgcctcccaggttcaagcagttgtgcctcagcctcccgagtagctgggattacaagtgcgcaccaccccacccagctaatttttgtatttttagtagagatggggttttaccatgttggcaaggctgttctcaaactcctgacctcaagtggtccgcccaccttggcttcccaaagtgctgggattgcaggcgtgtaatcccagccatgcctggcctgaaaatgcttttaaatggcatctgttgatttttggagagaagtgtagaagggagagtgtacatgtaaatgataatggggagaattgcagaggaagattctggctcaaggaagctgatttcttttggttttaatagaagagacatgctttagctatttctcttagccaagtgagagaagtattatcacttttgaccatgcactgaaatattcatttatattgccttcaaatgttcaatttggtcacttcccaaataatcatttaaggaaacttgactataatcactgaggttaaagaacaatcctcacagtctatttaaattcttttgaggtgtttcccataagttatttaaagttagcaagctgtcaaattcttgctattaaatgttgacatttgaaaggaaataattatccagggatgttcattttaaatgaaaattataactttacatttgtataacatcttaagagctattaccctccagtttttctagaaatatgtggattgtatgattctttgagaaatagaaggaagtcagctctgctacagaaatagaaagtttttgcatggcgtgagtttagacagtcactttcttttaagtttcctggtacctctcatttcattttgaaacctaggcataaatcattctttaatgttcatttttattatcattataacctgtcagttcttccactttttctgtttctagtttatatgattagatatgccattagcatttgatgtttggtagaatctttgtatagcctttgtgtgctcttcatctatcagttctcctggctctgtagtgggtggaagaggtaaagtgatgtgtctgagagctcacagtaagtcaccggccaggaatctagttctagcactgccctagtccttcattctcctttagtattgagaaagcagtgaagaaagaggatttatccccatggcattgggatcttttttttttttttttttttttttttaccagattccaagaggctgagctatatctaaataatcatttgatgtaagctctgtgaaaaaaaaatcattattttagcacttatttttcttgtaactgcctaatttatccttctttattgttgttgacatttatggattttccaccttagtatcacagacattcatagatagcaattggccattttaccaattggtgttggccattttaccaacacccctgtctagagaggtaaagttttctgtgcctcacagcaagctagtggccagcagaattgactggaatccagacccccagatgcccgctgtagtcgccttatcaccacaccatggcaccagctcttcacgccttcaccttataatgccgccaaccacatctacctagagaaaggatgctcatgctccctttttcaagagtacatctggttctgtgtgtgagagtgcacaggaattctccaaagcttagtgaaggattgaagacaaaggttaagaatcatttcttgagagcagttttgtcaaactgctggcccctgttggaacctgtgacatttttctttgcttttttctgctttcattttctgccttaattctctggtgtagtttgctagtacaagaaaagtaataatgaaaatatcacagtgttacccaatatttatttaaggcttgatacatttaagatatgatattaaattttttattgaggtagaacatgtgtacagtaaatgcacagatcttaactgtgcaacttgatgaattcttacacattcatgtacctgggtgctcaccacccagatcaaaataatagaacatttccatcaccacataagcctccctggtaccttcctagtcagaagcccccatcccttgaggtaaccactattctgacttctgtcacttgagagtcatctggcctgtttttgaccttcatataattggaatcatgcctttttttcatcaattatgtgattatagctatgtagtaatcccttttatgattttaccacaatttattcatccattctcctaatgatggacatttgcttgtttgtcctttggcagttatgaataaagatgctgtggatattcttgtacataccacttggtggacatatgttaagtgtattcctaggaattagaacatgaaacttacaataccataatgaattttttcatactttagtttatctgagactcaacaacccctaagataggtatggtaagtagtagtattcacattttgtttttgagcgaaattagttatgaaaaggtcaggtggcttgcgtaaggttcctgagaaactgacagggttatagttgtgttctccacactaggctgcaggatttccctcttgcaccatgttagtgtttatagcatccattaagctacaagtggcattaatgaaacccaaatatatgtcattttaggcaaagtacatgcaaactgacttttattctttttgatgcttttttacacatctagattgtcagtaatcctttggaatcacctgatggtgttggaaacaacccagtggaagtcatgtgtttttactttgggggtcagtaagggtctgagcacaagatgatagtcttttagtcttatggtggtataggactggcagtttctatatagaggttattgatttcattactctgcttgtggccaggattatatttcagtgtacttgaaaagtagtaggttatccatttcataaagttctccaggtaaggaggcacttttatggtaaccccaggtaagtgatggtggtttgaggaagaaggaatatgtcactcacacacatgccctttctatctgttctctactttctcagcatattgcagagggaaagaacacatgagaaaagatgagaattgactcctacccctttctgcagaagagattcggagaatctcttgcttttattgagaaagcaggccagtcattgagttctctgctctatcttgcttccctgtcactgcatgggctagaattacttgcagttacaaacattaatgatgaggagtgatatgtggaagagatcagccttgcctggggcattgggaaggataatggatggcagcccagcttttaaacataatttgcttacacagaaatgtgaagcagatctgtcaggaaaatcagttgcagacgatacttagcacttaatgaaaatgtaggatttttgttgctgctcatttcttcctaggaatttggcctagtctcagagatgtgccatttgtgcttaagtatatataccatggtcatactgtgccaacaataagtccttatctaaggggtcatacaagatgtagtggactacagaaccattaagcctatggagtttttcagatgtttggaagataccagtcatttgtggccctacagagatttatggcaggatgcagctctactgtttattctcttgccccaactggataagtcttatcctgtagccatatagtcctgatatcacgaaaatcatgcaggggttaatgacaatgagtaggagaggagaggtacaacataaaaagtatgataataacccggaaaaccccaaataaaaacccatttgagaatctaggatagagtagtttatttaacctttacagataaatcatatgctagtaaatgtatagattttttaatcatttatctgtatttggctgtcagatatctttattcataatcacccagaataaacagaatgaatgaaacagaagcttcatcacaattctgttacagactgtctgcctccattgctgggatttcctctctcttataccattgattctcagtcttgcacatggcccagtttagggtcaacaaagagctatggaaagatccataaatgtccttaaaagaagataaattccttattcgctcagtcataaaagaagttaatgaatagtgaggtggtcttaactgagggaaaaaaagtccaagagagtggttgagtcaacaaacaattatgtccatggtgctgacaaaggcactgcaccttaaggcagacacagcctccactgttatcactttgttacctgtgtgtgtttttgtatatgaggactagaagaacaggcagagctttcttgcttcctgaaacttgccacatgcagcctcatatttcatggttgactttggtttgactttttaaagagacatattttagtttatttataggtcttaggtttcagaggtcatgattgtgtccattgtaccataaaagtaacaggaatgtagagaatggcagctcttaccattttttcatgttgagagtgaggaaagtataattatactttttcctcttgggtggaagcaactacaggagagcataagtgggctggaaggctctctcaccgcgtgcctgctccatgcactctcagcctgaagaatgccagaatgcctctaggggccagtcagttgtggtaccataactgattctctatttactgtttctggcccccaaaggaaaagtagaagtgccccactttccactgccctctctaaaacactcactcctacaggcaggcatgctaccagaaaatcaccttctcgtgttaggatagataggcattgctagatagatatgcattgctagaacccagctcttagaggcagctgccacatgccttgaaggaaaaggctccccactgctatcccttggagggacaggatggaaaaagagtgttcagataattttcaagggcactcacctcactacccttttaaaatctgagtgtcattcctagatcctcacagacttcacttcctggactttgctgtattactatgtatctgcctttcagaagctccagatctagaacagtgatgctgaatggttttctcatccatttctcatctgcctgttttcaaacaatttctaacacaaattgaaagatttccataaaaggaatcaaacaaccttccaagctcactcatttttgcatttcacgtttcttatgagaagtcccccttttactgcttttgtccacagtggaatttaagagtagattattctaagctttttttttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctgtgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaattgctgctaattattgtctgcaaaagacttcttcagtgctctgctgagaattgaacacccttatccattgattgaaaatggatctgcaagatagaacatcattcatttagctgaggagagaaaggagtgctttactttgggcttctaggacatcctctcaatactatacacacttgcatcaaacttgacatacaggtgctcatttaaagtaaccccaacagaggatgacatatagtttctggttagatagttaaagcccaggggttgtttgtgacttggacaaaactgagacattcttagaaccacagagagtggaaactttgatctctgaaatcttcattattctcatcagatcctcccagcaatatgaatcagctcagtaagtatggctccatcagcagcccctgtctttggcagtttggggaatttcttttgggaaacgtcagtctttttgtcatgccaggaaaagtttaaatcaagttagtcctttagatcttctgatactttttgacttagtttgaatgcagcaggattatttgtgcttctctaaccctgttttacctaaatctcaatacctcaaggaagaaattagtttcacaggctaaggagaggaagaactaaatgagtcatgtaatttccaaatccatttcatacaggtgaagtatatgtgctatgtagacttcatcagagcgtactgttttgagtagggacagcgtgttttgcatgaacacatcacagtcccatttccgtgaaatgagattggcagatctacagaactcccaggtgttctgccgagtgtagccctggaggacagcaagtgctgtattgtcgtcaatccaccatgggctgcttctcagaagcccagtaatcccacaaatgataggcttgtctgtgattgcaagtcactgactatggacccggtcacctttttcttctatgtcactgaaatttattgacttgaagaggagtcatcctctttgtgacccccccacccaagtcacaactcaaatgaccatacgcatttccaaatgcccccttgaaggtatgtgctgcccctcattaagtaccactattttaaatgttgggttttaatcctttgccagttaatttacatataagatttagaatcttggaaaactatttgaaaaatcgtgttgggattaggcagcatttttttttcccgccaagtccaggatggctttgaaaataaatggacacagatctctcctgttttgatgatgtgcagtgctaatgactggctttgcagttaattttgattcaggcaacagatgttccttttggttccctgtctcccatgggcgtcatttcatgttgtcctctgccttcccccagatattctaagttcaggacacaagcttctggcccatgcagagcagaggccatgaggggtcacagcatgggtacgggaggaaacactgggctaacccagatactggacttgagtcttgcctctgctgcttgctgcacagcttctgtcatggtgctaaacctgtgacctgcctcacaggcttagagcatgcccgtagaagtactctaaactaaaatgctttccacaaatgagatggtttcatgaaaacttcaaatagagggcctgggcagaacataacctttttttttttttgagacagagtttcactctgtcaccgaggctggagtacagtggctcaatcttggctcaccgcaacttccactgaccaggttcaagtgattctcctgcctcagcctcccgaatacctaggattacaggcatgcaccgctacccctggcttatttttgtgtttttagtagagacggggtttctccatgttggccaggctggactcgaactcctggccttaaatgatctccccacctcggcctccccaagtgcttggattacaggcatgagccactgcgcccagccacaaaacaacttttaaataggtctgctgctgtttttttattttaaccttatttcttctaagac

SEQ ID NO: 12872 - DNA, 146095 bp, Human
taaaaccttcctagaacgacatgaaaatcagagctcattcattatggtgtgtgaccttgctgagttcttatttttaaattcagtaaaataccatatgtgcctgtcaacttggtgtatatgtgtgaaaacactcatccattcctgaaacaagaccttttggataaaaaacaaagataacttctttgaataaagcaaagactaaggaggagagtgagtggagctacaactgtcttccattctatggatactggcacagatgccaagtttatagaaaatgttaacttattttaatgatctactatgaccaggaaataattttccccctttgactcaacttatctttagctacgtcaggccattaaacacatcagaaagcaaatgagcttggattctgtgaaaaaaaaaatcaatggcattagaaaaatatgaagacgcttttctagaataaaacacactaaacagaacaagcaaatgcaatctttgattggatcctgcttgtcttagtccgtttttgctggttagtttataaataatggaaatttacttctcatagttctggaggttgggaagtccaaaaccaaggcttgttctctgcttccgagatagcatctccttgctgtgtcctcacatgacagaagggcaataagagacaagctcattcccgcaagcccttttttaaaaggcaccaattcataagtgggaggggagtccttatgacctaatcatctcctaaaggcctcacctcttaagacaattacattggagagtaagttttacatgagttttagagaaacacattcaaactgtggcactggtttttaccaaacaactgtaacttttctgtgtgtttgaaaattttcaaagtaaatagtggaggggaaaagcaaaaatattctagctccatctctttaaaaaattacctgggattatggtttggaagtaatacagagagagaaaaacactaaaacttgttctataagaagaaggactatagctctgtacatttttggtaagatgtttggcacaatgctttataggagcataaaaatattgtcctaagggttaagattttaaatagagaaacttatagggaaagaggatgcagttcctggttatgaatcatgtccatcagcctgacactttaattacaacttctttggagtttatagtatattatcctcattaatccccaattagaggtttgagtcatcaaaataaatctgcaggacttacacacacagagttcattatggagcagcctagcttcacgcttccaggtgtatgacatatgacaccctctgtcctttcacttctgatgtgtctctagttcttccaagccaaaagcagagcccaggattagagcaacatatatttaagggtgtgtttttgcagatgtcagttgggactagaaaacaaatgtaggcatgcttaaacgctgagaccaatgtggaaacttcacgaggtgggggtagggggaagaaaatttttggtggggcacgtttaagttcacgttaatgtataacgctatcaattttactaccactgagtgggtatatgaaggggatgcttgcgtgtctgtgtgtatgtgtgtgtggtaaaggagggtgtgtgtgtggcggggggtattttcacaaaatgacatggaaacctgactgcagttcttttgggaagaggacttggaggtgtcttgggggtggggaaaagatggaagactgggatttcttctggacttcagggaagaaggatgaaaccaaagggaaacaatccaaggcagattaatgaatttagtctaatatttgtgaattcaaagtagattctaatcagcccatctcctccctcttctgtttgcagaactggcactaaagaggattccccaagctgcttcatcactccctgccattcgctgtcccaggaaattctcctgactcgccccggaatccgtgttcgactcttctctggctgagctgttcattgccagccaccctgagactccccacgcggcaggcatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggcgcggcatctttcttggatgttttttctctacacagacttctttctttccttgggtaagtgaagtccagcttgtaaataaccaaagggtagaaccgaaggggatggagggggattgcagtagcccaaagggctaagttttcttgggagggaggtctccctccatccccactccatgcagtccactccaaatacgcagttgaggaggagttgtgtttgatttcagacacgttttgggaaacggtactgggatttatttacctaattttggtggatttttttttgggggggggcgggtaacttgcttttgtctacattctgagaaaggagaatgaaagtggaggtgagagaaagctccagaggttggaggtggggaaaagaaaggagggggcggcatccagtgattaagcagagagatcatcccaagggccaatgactagtgcaagtcttcaaggcagaccaggagcactagacactgatcctgctccctgccctaatagagtctacccccacctccccatccccaaccctccccttataaccatcctgctgttgccattctggggaaggtcatcactactcagggccccaaataacttttaatggggacctgcaacctgtcttgtacacaagtgatgctcaataaatgtttgttgattggccgaatgatgttgcatcctaagggtgcagttcctgccacaggaatttgccttggacagtgaactaattccccaatgcagaccccagaacacaaccataggtcagttcattttgcaaaggaggagggcctggaggcttggaaaatatcgtatttagaccttcattacccaaacgaacccatgggacaggttcagggtcagattcatgggtcccgggactggatgagctcacaaggttctggcatggagagcatggacctttgtgtcaacaaacttgggtttgaatcctcatatcgtgaccttgggaatgtttctttatctctctgagccttgatcttctcatctgtaaaaggaggccagttacagcttctgcaaaatgatctaacaaagatgaatggagaggaaatatgagatggtgagggggaattcagtaaatgtcaatcttgcctccccgtgctctgaggactcaggagagggtgtctttctctgctgaagcccctctctgactctgatgcatgtaaaaaacattgtattgcagtgactgtgctagagtccagctgtccgtgaacagttaaagagaagagcgcagagggaggttcgaaagcctttcttagaagcatctccctctggacttgagaacagaatttacatacacactggtgtctcggggcatggctgggagaagcagagattccttgtttgtttgatttctatgtcttagccatcctcccagtcctagtagagagaggcaaagtgtggttacagagtccagggaagatggttctgaagcacccgggaacctgcctaaagggctgaagagtcagagtagcaccatcagattggtaccagttttgcctgaacggggtttgcagagaattcagggctccagcctggggtgcctgtgacagcccagtgacaaagcactcacctttcccacagaccacagcggacctctgtaggtcttgctcttggactcagaaaccttgatgtgatagtgacggatggatggtgagaaagatgctgctgacatagggctccccagaagcctcaaggtgccgtagagtagcatgcaacttagagatcagctgctagtgtgggattttaggaccccagctggcaggcataggaatgagctgggcaatttctatgcgtaagtaaaggcaacaacaatctaacaggaccttatggcactagatagtaagccccatgaaggcaagatctctgtcttgttctctgccatatggccagcacatagcacagtgatggcacttggaaggggttcaatatatatgttgaatgaacaacaaattttagtaaccttatctggaagccagagtaggggtttaaactacttcctatccaacactgcagcatgcaattcatgtcttcatttagcaagtatttcttgagcacctactacgtgtaaggctccgttgcgaggcatccgaagcaatttgtcagcatcattcatgttgatactcggagtgacccgttcaagagcacctcagcaccacctggcttttctgaagactgaggccccaccacaaacccctgtggggcttcaagcaggggcagtgagagggcgttagacgaatgctccaggtttagcccctttccgggaacaggtctgggtcccttcgcatctgccctgctggtcccaggatcccggggccgccgcttccgggagctgccgggtcttggcaactccgctttcctccgggggcccccgtgcctctctcaagcctcctttccagccaacgaccagcggccccagtccggctgcaggtagctggggaagggaccaagctgtgccttgggagcgagcttccccgggcggggagagcgcagcagatgcggagcggtcccagaacaaaaggctcatggctggcacgggcctccttggagtgcggcggggacgtgggttcgggactcaggcgagagagccagacgcgggaggaaaaaaaatgaagtgagaaaagagaaggagggagagctcagggtgagagcggtgagaagaggtgacccggaggccgaggtctgcggcggagccgcagcggcccttcctccgcctcctgcagcgccttccaggcaaccaagcgtgtctccggctgcaactccagcaagcgcgccgctgccgcctccacgcccgcccgccggccggccgagccagtaagtagcggcgcgcccaccgctcgttccccgcccctccgcggcttccccgccaccgcccaccgcctcccgccgccccgcgggcaagtccgcgaccgcctcccgctgccccgagccgggtgccgggggctcagcgcgccttcccagctgggagcctcggtccgctgctcgccctgctccctcttgccggggcgcggcgtctggggcgcgccgcggggagggtcgccctcgccgcgcgctgcccgggcgccgcgccacccctacatccaatggctttcggggagcgggaagtggggggcgtcgccgggggcgaggagccgcggccggggtggggcgtgtgcgctcagcgcggccgagcgaggctgacgtgcccgcccaagcgcgcgcccgggagtgtgtgtgcgggtgtgtgtgtgcgggagtgtgtgcgcacacgccttcgggggctggagtgacactgcagtgggcttctccgtagccccagccttcaggctgcgcagcccctaacctgccggcaccgcttttgggaagcagcttggctcttccatctccccaagccttcctctccatcctttcatccacccctcgccgatcttactttttcttttacccacggggccgcggccggccaccccctggccggtgcaaacacccaagccctctccagttctcccccaagctaatattttcccacctgtctttttctggggttcctccacgagccagtccaaggctcccccatcctcggaaattgttttgttggactgctaaaccgaggcgtgtaaagcttgaggactttattattatttgggttcttttcatttcttccccttctgggcaacgaagcaatgaaatttccaatcgagacgccaagaaaacaggtgaactgggatcctaaaggtgggtgtttcctacttttggctgccctcgccctgcctctgtctccggcgtgtgcgcgcttccttgagtggaagcactcttgcttctggcagcgtgtgtcctgaggctgggaaatgcgcctgggaactgcagcgcgggtgggaggagggcggaggcagcgtgggttccgaacccagatagtgcctgtcattaccacataatcattgtccctcctagattgtctccagatctatttagatagaccaagccgactgtttggtttgaaattgcaagtgtcggtatttgcttttgactttgagtgtgcgagtgtgtgtgtgtgtgtgtgtgtgtgtgtgtgtcctttgtttctggtgatctttgtctctctggcagatgggtggggtgcttccccctggacctggagctgcgccgcatgcccgggtgtcctcagtgggaaaggtttcctggcagcaagtggggctcgagttgcagcagccgtccctaggggtgggccgttctcgcagggcatgcagaataatggagcccacagggcctcctgagtcttcgttcaatcttattaccaaacctagcagctagttaggctcaggtcagagtagaagcaggaggaggggtggtttgtgagaagggtggggctggcaaggcataggggaggggcacgaagtgtgcccgcccaagcaatggtgtggtttgcatgcttttacgaatgttggaccaggtttcatccacgcaaaagggagggattaagacggatttgtgtgtgcctagcgtcggccaccgtgtctgtaattagcatacagatgttaaggctccaagggagtgatcagtatgagagcagaacaagttggaaccgcgtgtccagttgtgacaagaatgctctttagcatttcttgtagctcatctgacgactgtgtcaggctaggcaacgcctctgtgtgtattggaattgaaatttgtttatttggggtgcgtgtgtgtttaatgttctttatgagcgcatttcttctttttctccagactggaaagaagaaaccatcttatttgttgagtaaatgtcttaggaattgactggctattgaagagtgagtgaagagatactgcctttttaaaacactgaggctgttacatcttaaatacagcccaaaccttctattttgtctctacttgaaatctctggaaatatggaggtgtgcctttgcttttttggggggagaatccctgaaaagcatatttgttaaatacctattacatgctaaacactgtcctaagctctggagatacagtcagaacaggaaagataaaagctctgacttggagtttacagtgagggagacagacctaaatcaattccatggaggaatgcataattcaaagtttatgtatgctccagggagagcatcagaggtttaagaaagtgtctgatagaagagattgacaaggaccagagaaggcttccctgaggacatgacacttggacttaggcctggaggatgtataggagttaattgtctaaggaggaggggaattgttgcagaagagggaacagcaagtgcaaagggcctgaggcagaagaggtatgtgtatatgatgaactgaaaggaggttcccatggctacggcagagtgagtgaagaggtattgccttttttaaacacccaggctgttatactgtaaatacagcacaaacctttcattttgtctctatttgaaacctctggaaatacggaagtgtgccttggctttcttttgggaaatccctgaaaaatgtatttatccctagcagagagcaagagggcttgtgttttgagatatgactgggggatccacaggcgagacgcccccctccaagccctgtgttgttggaggtggggtagcattgtggggttggaagagtatagtatttatctaaagccaatgaagagtttcaagacgaggagtgacatgatttgagctaagtttcaaaacaagtgctgtgtggctcttgtggatgtaggggaccagatacaatggtagcatgggccagggtggttgctgtgggcatggagaagcggacggagtagagagctgtagaggacgtgaaatcaacaggctttgcatgaataatgtgtggaagtgaagtgaaggaattggaatgactgagatggcagccagggcaggaccagtcttgaaggaaagctcatgagttcaatctaggacttgttgagtaggacatgtccccaagccatccaaggggtgtgttaggtgggcagctgtctaagtgctggggtcaggatcttcaaggaacagagggagtaccgtgagactgattttgtgaagctggctttgtgttttaaggtacatttctgtgtgatcatcattctatatattcatgttacagtgatgaacacagacaaattttacacattttacagcctgacacagtgaagaaaagcatacaaatagcaccttcagttacaaccagtggtgctaaaaatgaaaaaaacctcaataaaaataacaacatttaatgagcaaccattgcatgccaggtgctttatgtacattgtttcatacaattattttcacaatacttatctgatggtataagtgttatagttccatttggcacttgattgccatcatgacaccactaatctgccttccagtggagttgctctgactttgtgcacagttattcccaaaggtaggggtgacagtagtctttttctagccaggggatggaggagggaagagagtgaggagtgaggtggcatatctcttatctgtatagaattatgtgctaggtgctcttctaatgttttacatgtgttaatttaatcttcacaaacattttaggagaaaggtattatcctaattttacagatgagttaactgaggaacagagagtttgagtaacttgcccaaggttgcacagctagtaggacaagattagaatctgggctcttaaacactcttcaagtctgtgtttcttattgggacttttggcttttgcctggtaaggttcccaaagctcaggaagtggagaagcttgttgcgaggaggaaaaggagaagagagaggatgaagaggaaaagggaatggaataggaggaggataaaagagaggaagagagaggaggaaggagaagaggagacagtggctcaagcttaccctacttgttcctttctctactaacctattcagacaataatcttttcatttccatgtctgatgggcaagtcagtgactactggacagagtttgggtctctgttttggaggttctggattacacagaccaaatgtgtttagcagggaaaagatgaaggggagcccagcagtattaggggaaagtggagagacagttcacattacttggactgtaggatatgtctatcaacagacatgacccttcaggcggaggtgctctcatgggttctggaaggcagttgtaattataatgtttttcttacagccttattaccctacaatttaatagcaaaaaatgaaggtggtttgagaatagattggtttggatagcatttgggtggattaagcaaagcattgtcaagaggtgtaggtaaaaacaagacccaaatataaaatggttcatctctggtgagctatggccttccttcatattcatggaacagagacttctatgaagagcgttactgtttgtgtaggacctaccacaagtagattggttctaagtcttagctttcatagcagaatttacgtgcactttaaatcatcagcatcatttgttgatgattttctgcttaaaattggtatttacttgctgcttatgtgtattaagatctttttaaaaccagtgagatctgcaaatagtattcctctcactagaggcaagcagatgaatacagtgtaaaaaaactttggatttgggggcaaaataattaggttctaaaagcagctgtagcaatacttagtggtatgactttgggctgctcatttagcttttctgggtttcgcttcccttccatggagaaaggagtcattgcctttgtctacctctctgactttgtctcttcaactttccccatcttgatctgatcttggggccagttggcttcctttcattcctcaaatagatcacacttgcatctgtctgagggcctttgcgcttggaattcccactgcttataatgcatttcacgtagttggctcctttctgtcatttgaatctcagctcagatgtcctcttgttagcaagggattccctgtcttatctgaaagacctctcctcctgttccccagcaccatcattttctcttgtgtcacctattcgattgtcttactggcacttgtcatgatttgaaaccatctcacttactcatgggtgacatttgatgccagcctcctttactagcatatgaggtgcatgagcagggactttctctgtcttgtttattgccataaccccagtgccctggaaagtgcctggcactcaataaccctttgctgaatgaatggaaggttggcaggatggactggagaggactgaaggctttatgcctcatggaaattgcaggacgcctctcagctataaatggcaaagtacaaataaggagaaaggaagaatatccccaaatagtggcatatcagaaaggacgctgatattcccacttccttgcaagctccagctcgctctaaacctccagtgcgctgttttccttcttttctcgtctttgaccagaagtaagaaggctgaatagaagtgcagtgagggtggatgggtggactgatctagcctgctgaagatatggtcagtgtccaataaataatttggctcatattagctattggagtgtggctatttttaggcactttaatccacttaagaaagaagcaaagctctaggagtggaggtggatttttttttaaatgctacacttttagtgcacactttaatgcaaaattctggagaagcccataccttatgtgcatagcacctttcagtttacagaacactttttaggaatgatctcatttgtactttaaaaaaccctatttttgtagggattagagtcttagatttactgacaaataaagcaagatgtagaaaggataaatgatttatgtgggagcccaaagcaacaaacaggcagagctggggctaccctaggccttttgatgcttacgtccatgacagtttccttcaagctttccttcctcccagcgactttgttcattccacactctcctgctctttgttacccaaaagtgtgttcaaaggtttctctgagagatttagaggaagcagtctccctgttgatcagtgaatctttagttgatggctattttcagcaggttgtgcttattgtacaggtctacactttcattctatgagctcaggtgaagacccttagatcttccttctgctgtactggctaaaagaagattttggtcttttgtgaatgggggccattttcaacttgctaggttgcttaagtgctagctttattaacgtgtttccaaacacacatttgtggagcttagatttcctggaaagaaaataatctatttttgatttaatatccaattttcaggagatcagtgttccaaatgggatttaaaatgtgccaaaatcaccacaattatcctcaaaagtaccaaggaacagtgttccaaagactgtcttggccaagatttggttcaggcttcttttccagcagtgtctaaggagcttcaccatcctttttgctaatcccagtgatcactgggttgaattaagactgagcaggttgactttgctgttccacaccatttccaaaacatctgtactttggctccatatgaaccccaccttaaatctgatgcatttaaaaaatataatatagtctttcccctcattaggaaacttcaaccacaactgagatatggtgtgaagtatatttaatataggcacagtgagctagtgatttccttttgacttttagtctacaggaaattagaggaagagtttaatgataaaatggaaagaagccattctactgatagccagttaggaagtttcagtttggacagctcccttggctgatgcagaaaggtggataaaaatgacaatctttttcagtactctgattcttataaagggcacctactggatgatccagatgaggttagagtgagttaggggcttagctctgcatggcatgtttacagaatctacctaaccatggcactaggagtgtggtcaccctgttggttccacccacctgggtgatttctctccataagaatcatggaggtcaaagggaccttccacttctggggtctggtcctaggggtactctcagcggagactttacagtttatctatgtctggctcattaccatcacctacaatggggaaataaagacctcatatttacttgctagaacatctatttgtcatttgcagccacagtttaagagttttttttttctccctgtgagtgtctaggactgagtactctgaattgaaaatgaaacctgacttcctaatcctccatttagggttgaagggagggagtaagggtcataatcactggcaggggagggcacggtcatgagggagcattgcattcttttcctttgccattcccagagccagggagatggggaggggtgggcattggaggtagtggggatgaggctgggagatggatgggatttcaggagattttaggttttgtattaccaataactgctagtctcatcacttaccctttccatggaagtaactttgaagcagagtggaatggtggggaaacaagattagaaaggaaaacataggatttactgccatacataagccaggtgatcacagggaacttttccttcattcctcccgtccttcttttcttcattcccttgttccctccccaccgccatccccccaaatcctgcagagtcttgatctcaattgctctcgcttgtgcaaagggtcctttctcccttactcaactacccagtgtggtggggctggtggtatttacagtttaaaaagagttgcttgaatagaaaatgaaaatttggtcgggtgatggagagcctggaagtcacggtaacctttgcagacgcctaaaacaccaatattcataattttgacatgcaagctagcaacaattttactaccaagaaaatgagtttcttatgtgcaagcagaactcgagatcccctaaataatcacacaccaaatatttagcatgataaagataaatagtatagcttactaaatttaatgtgatatgagcctgacaggcagaatagagatgcttgatattaggtgtgataaaaggtttgacatccaacattcacttacttcgtcctctgagacaaaagtcaggcaccaagtgtttaagaaaaattgatgggaggaaaagcttagagatgaataaagtctatttattaatttatattttcctctgagaactggggagtgttgttacccatgttaactgtggactaacctgggccagctcctggattctactggctaagaatgttgctttaggccaaaggaatttatccctcatggtggaatttgaggccatatgggaggtgattatgatagatctgtttcggcctctacattcttacaataacctgaaaggagattaaatacatgttatagtcatttaacctagactccaggcaaaatgtcaccctctgtacagtataggagcttaggataggagacctggtttctagggctggcgctgccactcatttagaaaaggagggagttgagttgttggttgttgagatcccttccttccctgatagtcttagattgcctgagtcctaatccaagcatgatttactagaggctgatttgggaacattgcttcatttttctgtgacttggtatcttcatctgcaagatagggataattacagccattacttctttggtttgttatgtggattacataaagtgatacatgcaaagctcttagaagaatgccggatcatcatgaaggctccatgagtggtacctgccttgtgctgttctcacagttgcaggaggcagcctgtgaagtcagggtagcctccagctcagcctcttggaagcatctggttcactgtctggatcatccaggaagtggtccatagcagagcacaaccctcctgatactctggaagactcttagtattcttagttcagatttaaacaacctaggctgtcctggttaactcagagaaaagaccagtgaaagaacatggcttggaatcacaatatttgagtctgagttaatgtacccattttattagcagtgtatcatagttgatttcggctgctttaataaaattccataaactagatagattatagacaacagaaatttatttctcactgttctggaggctgggaggtccaagatcaaggcactggtagatttggcatctggtgagggcccacttttcagctcatagatggtgccttcttgctgtgtccttacacggtagaaaaagtgatgggtctttcttgggcttctttgataagtgcactaatcctaatcatgaaggctccatgcccatgacctaattaccttccaaaggccccatctcctaataacattacctttggggttaggatttcaacatatgaattctggggggacacattcagaccataacactgtgtgaacttggccaagtcacctaacctttcctagcattagttttcttttgggtaaaataaagatcacaataacaaccacttcacagttgctgagatgatcaaatgagacaaatgtgaataaacttcataaactgttaaattccagaccaacatttcccaaaatgtgttctgtgagacataagctagactcatcagatactctgagaagaaaagtggtgtcatggtaaagtcagtttgcaggatgatacgtgctcagtcattcctagagagtcatcatgcacgttagcatgttactgtattattgtgtaacaaataaccccaacatttagtggcttaaatcaatataaacatttattatctcataagttctgtggatcaataattcagggatagtttaattgggtggtctgactaggagtctgtcattgattgtggtcagatgttgtccgggctgctgtcatctgatggcttgactggggcaggaggatctgtttccaagctggtgtgctcatgtgacttgcaaattgctgctggttgttggggagagggctcatttcctgccaatgtgggcctgtccatgggatgcttatgtgtactcatatgtgacatggtggctggcttccccaagaacaagtgattcaagagagaacaaggtggaattggcaacactttttatgacttaacttcaaaaatcacatattgttaccaccaccacgttcttttcattagacgccagtcactaaagttagtccacatctggggagtggtgggggtgatcacattcacgttggaagggagacatgtcaaagaatttgaagacatattgaaaaatcaccgtaagaattttttcctatcatttattgaataggcaccacgtgctaggctaaatgctttgtagttattatctcatataatcctattcataatccaaagaaataggtgaaattattatctctgctttctgaatgaggaggctgaggcctatagagcttaagtaacttgcccaaagttacctagtcatgctacgacttgaacccgagtctgtctgatttaaagcctgaactcttacctctgcctcatatgcctctctctgataatcctgtagttcagaagtctgtttaattttgtttaagcctgcattttctacttaaccacagaatgatgattcatttaactccatttttaccctttcatttaccaacggcttgaaacattattctagaaagacagtgagcatgatgatgatttatgtataatatgaacatatggtctcataatagatcccagcatacctatcagtccaaactttttgtattattcaaatactggaagtgtctattttgcctgtcttgtgtgggcaccatctatgtgtaaatctgtaaacattaatttaaaaaaaagaccccataatccaccctattttttctgactgtgaaactagaggtggggtgtgataactcatggtcccacttctcttacagagtccctttctttgcaatgtcccttcttttacagattcagtgactgacaacttaactttcttgggtaaagccagaaaaaacaggatggcctccaggccgagcagtagaaatgctggggaatggggtgtctggtgtgtgtctggtgtgttcctgcagtgcctgcaggccatgtgtctgtatggtgactgaaacgcaagtcggcatccagccaggatggcagggaccgtgtgcctgggggtgacggcaaacacacagtgagaagctgctgatggagggaggaccgttagcactccttgtcatattttgagtaaacatttttttacaatcttgttgctttttctgtacagtcttgagaaaatgatttccaggaagcaggatgcatccaatgacttagaggttcccatgtttccaaacattacatgcctggcttattcctgaggcagttttgtattctgaaggaagttttggagcttctgtgttctgggcagaggcgagtgaatatggtttcttttgagtagcaccgtggacttgagaatgatcaggagctggacattgttgaatatgtcacttactgcacaaaatggcaaagacagggtctgggacagggtgagagtgtgttgaatggagatgcctggggccccagtcacattcaggagccagcactgatggcatctgtaaccatagtaaccaagagtggaaaaagtctcaggatgccaagacgccactgtgccccccttctggttctgttgttttcccctctattctttcatccagaaattcccccatccctgcccccaaccaccctgacaagggactgactttcagggtggtttctacactggtgattttaacttcctactaactcaacacttcctgtagcccctttttcagttctgagatccacaaggattcattatgatccagactaagcctcatgcacctaatttcttccgcttttccatttttactgtgaaaattggtcctaagtcctgtagtatacatactctagacttatttacagctgggcataacaacggtggctcatggcactcaaagtttccagtaacactcctgcactcacagtctggtatagatcatgagatttttttagatgtgttttaaatgaacagagaaaggcaatgaggcacaggaaagagagccgtggtctcttgtttggagatgtgggttttgctactggttggaaagtgaggtgtggcatggcgcatgagggtggggagaggtgggtgatgctcaggtcatgtagggcatagtaggtcttacttactaaggaactctttttttctgagaataacaggaatgtcttgattgatttgaagtgggaggatgacacaatcagatttttaaaagattatttaaatcgctaataaatcaaatgatgggttcagcgaatgtttgcagaggatacttactgtgtgacaggcatagtgctggccttacctggggtatctgtgtattcttgtaggaatcctacataaaagctgttaaaatattttaacagaaaaaagcttttcttgacatctttgaattatgacaaccaattccaaacttctggttgcaaatgggaggtgtatcttaaagcaatggcgattgcattttcaatttctgttcattaaaatgatattttccctggctttgttacatgacccttgattctgtgataatttgcatatctagagtcgatgaatcaatacatgcaaaactgtggtgcgctcgctcatattctgttatacttcagacgccttttggaagcatgtggctctcagttcagcataatgctcctgataaaattgccccctccatacccgctgtcactttgttcctggtgtgtccagaggtattgtaacattggggtatttctcctttgactctaatgggaccccctgctagttgtgttcttgtggcctcagcttggaaggcctcccaaaagcctgaattaatgaaagcttctgatgtgccgatccctttctctggcagggtgagaacgcagtttctataggagcgtgaatgcctgctgctcaggcaataatctctgcattcagcctcagtactaaagacaggcagagcagacagccacagggggtgggatttgaggagccctataaagtccctctccacagctgacacacaccactccttcccatgactatcaggatgcctacaatcttaacagttactttattcattggctgttgtcactcatccatctggttattccataaacacttagcgagtgagtgcctgcagaaatggggctaggcattggacacagaaagatgaaaaagacctgaggcgtgtacccagagaagtcacagcctagccactgagacaggtgcatcatcaagtaattatgatataccatgataaatgcatatcatttatatggtatatgatataccatatgatatggtatatgatataccatatgatatggtatatcatataccatatgatatggtatatcatataccatatgatatggtatatcatataccatatcatatggtatatcatataccatatgatatggtatatgagagagatatggattaaaacatcagctccagaacacatcttgttaacatgcgaatgtagttcctcagggtaacaaactaatttccaattacccgtgggtacagccaaattaatagttcctatgagagaactggaccaagagagaacagaactagggactgatatgtattgataggctggtgtcaagtgggaaggggggaagtcaggtgctgtgtagggagcagactgagagctctggagggcaggagtgccaggaaggtcactgaaagcaacttttcatttgtgcaaatgttgtcagaggttgctctgctcatgttaaactcactttataaagtggaaggaacttttaagatatccaagtccattgaggcttcttagggcaatactgaatctagattggtgaagtgacttgtgcttgcccagacagcaaaaagaggacaaagcatatctatgaacccgtaatgctaaccttcattattcaacagtgatgcttatggcaatgccaacgggtgttggggccttttattaatttttaattttagttttttatgtttttgagacaagatcttgatttgtcgcccgagctggagtgcagcggtgcaatcacagctcactgcagcctcgatctcctgggctcaatcaatcctcccacctcagcctcctgagtagctgggactataggcatgtgcccccagacttggcaaatttatgcattttttgtagagacgggattttgccatgttgcccaggctggtctcgaactcctgagctcaagcaatccgcctacctcggcttcccaaagtgctggaattaccggtgtgagccaccgtgccctgcctgcttgagcctttttgctattctccctcctatgggaaaaagaatcgagaaagagcagtaggctctactagagtctggagcatatcggttctgagatttcagattaaattctctatgtctgcagcaagtacaaatgtgagtgtatattcagcctcttgaagaagacatctatccatttcttcagtgaatatttgcccggagtcttcttcgtgacaggcactgttgtaggccctggaggtacagcaataaacaagacgaagtctctgccctcctgaaactaaccgtttagccaaggcttagcatctctcacactcaggtcaacttctgcattttagaaatctgtttcaggcacacatttgacaagtaaagaggttccaaaaatacattaataaggatgaaaatgaggccattctgatattccattgcttggcaaaaatgcttaatatgggaatttaatatggaatgggtgctgatgctgtcaaaggtggtgacattctgttagaaaattcagtgatttcaaagaaggcctcagagctgcctagtttgtaattagatattttgaagaatctgtgttaattaggactctgtggcttgtgcatgtatactgggacgagactggagtttgtgtctctcccatgatgatggcatgtaaattaatctccaaggaattgcaagatgctgaaatgtgaggtacttgagtacacgttgcatgagtgcacacaagtgtgcctgtgccgggatgcgtgtgcacgcgtgcacacacatacactctagcagatagtaactttttgctacacgtgatttccaaagtgtctaaatttacatgtcttttgagtaggaggaaattaggacttttgtctgttatatgccttgcagtctcttggccttctctgggctgctggggcagaatgaggccaacagagaaccacggatgccagtctgggtcacaagggcttaaggaagcagcagatggttggactgactggggtgtccattaagaatccaggggtagtgagagtcttacctggagtttgaggccgcacttccattgccaggactctcagctgagtggctggaagagacctgtaggagccatccttccagtatctatcagaggtttctgcactgttttaagctcgtcctagtgatcgagggaaccttgactgggggtgctgatgattattaacagtggccatactcccacggctgcaggtggagatgaagtgtttgatgagaagatgagcaagagctcaggtgtgccccaccagctctgccactcccaagctgccgaacttaggcactaacttacctctctgtgtctgcttcccaacttgagaaccggaaatgataaaagtacctgctccctagggagtaggtatggttaaatgagacctcttaaatgagaccatgcacacgaagagcagagcacagtgcctggcacacaggaggcacctaataaacatcaatgatgctgctgctggtaacacccatttgctgagggtcttcagtggctcaggcacagtactcagtgcttaacatataatatgtaatttattcttcacagtagcctgagtcacttgcttgttcttctggttaatatcctaatgtttagctcaccgacttagatgctcatgacttccaaaggatcttcatgtaacaaggactccatatctatttttaaaaaataagagctttattaagatataatttacataccataaaattacctatttaaaatgtacaattcagtggtttttagtatattcacagagttgtgcaatcatcatcactatctaattgtagaaaattttcatgactccaaaaagaaactccatatccattagcagtcactccccattttatctctcccagtccctggcaagcatgaatttactttctgtctctatggagttgcctattttgggcatttcatgtaaatggcatcatacaacaggtagatatttgtgtgtgtgtgtgtgtgtgtgtgtgtgtgtgatcagcttctttcacgtaacataatgctttcaaggttcactcatgtggcatccatacctattttgaatgaagaatgaagacagtcatctgagacagttgtattagtccatttggaagatgaggaaactgaggctgagagtgtgtatgtaatttgctcatggccacccatcttgaaagcgcttgagctgggatttgtgctcaggtccatcttggctccaaggcaagaccttggccttctcatccactcactggtctctggttggacctctgcatcatgctgaacaccatttctatagagatgggtgtgtcccactgggtgtggacatcctgaggaattgctgtggttgcaagaactctgatattttccatctaccttgagggggatatggtttcatgtctgtatactcacatagtgttgaccagtctaattcttttgtccatttcctaagggttatgatatgaacttggaaagttacagaaatgaaagtgataggagagatatactttctgggttggaaacccagcaaccagtcactcaatatgatggaggaaatgtcatccttcttgtgttgtcttcaataatagattgtaatgaaacactatggtgtcttagttggctcccctcctgccccatgccccctcccccagccccagtgcttttctggagacatgagatggtgtatcccttcctcagttgctgtgatagcagtggggatgatggggacaggtattcatggaaggaaaaggcgtggtaccagcaggctcttgggcagggatgtgtgtcttcacttgatcatcagggaatgagctatcatgatgacagagcacatcctatgaagtacaaatcttcccccacatttccccaaaattacttttgtcctgctctgttctctcacatgctattctagggaaaaggtcccattttatcattaaaatgcaaatgagatttccatcttgcttctaccaaagaaggaggaaaataacctatataaacaccatgaaaccttactttgacttaaaactagtggaaattggcccctgaatcagataattagctgaaagtacatgaacaatttaggcctccggtagtggttatgtgcttgttgtataggaatttcgtctaccatggatttcatggaagtggccccattcctgctctgggtttatgtaagactttcagcagcagcccagtctgatgtagcagatgttccagtgcctgtccctatcctcctgctcgcaccacttcagctcatgctggctcacttctgactgccaacttggcattttttttgcctttttcttgactgagcctactttgctgctcccatggaaggcaggaagtgttggggaattagtggaccccaggaggagccctcaaccaataactgatggaagatggtgcgtaaacaccccaattccctcagccttgggtagggtaactcaggaatatggtttacatggggtcccagtttcctctgtaggaaaaattccactgggcgacagcagtagctagttagaaacttcaccttttattggttttcttggctgccttcccagccctttctcttttctctaattccctactggcgatttcttcacttcccaaacaaaccacttgtgctcaaatcgtaattgtaggatcagcttctggggaaacccaaatgaagacatatggtaaagcttccctcttttcttgcctttctgccttttgccccaatcagttagctttgatggtgggagtgaggggatgctcaacctctcaggcaggctaatggctctcaggagacacaatccacagctgattggcagttttctccccaagatatcttcagaacaaaccctggtgctggtgagtgatccatgcagcatgaaaagagagggtgaagcttgatgaggcatgttccagtctcatcaaactattttgtttccataattttccttctcagaaaagggcagaatcaagtacagttgattctcatcatttatggtaattcttgtgttttataaagttgctgtaaatcctgaattagcaaatagtgaaccgttgcttttaggggaaatatacggttaggttcctgtgagcctctagtcacaacattttcttcttcttcttcttcttttttttttcgagcttagggtcttgttctatcacccaggtgggagtgcagtggcgcgatcttggctcactgcaacctccacatcccaggttcaagcgattctcccacttcagcctaccgagtagctgggactacaggcatgcaccaccatatccggctaacttttgtattttttggtagaggtggggtttcaccacattggccaggcttgtctcaaactcctgacgtcaggtgatctgcctgcctcggcctcccaaagtgctaggattataggcatgagccatcacacctggtcaggtcacattttcatcaactaaatacataaccttgttgtatgtgtgtttctgtttaaagacatcttatttcatatatactgttgatttgttagcattgaactcacagccacagcactgtgactcatttctgaacaaagttatctaacacacatattttctccataaggcacctcgcatcttgcacttaggaacactggatagcacttcagcattgcacttgggggtgattttaaacagtgcaaacactaacaaaaaagcacaaaatgtgaaaaacatggcactaaatagatcacagaatggacactagcttacagcatgagcgctcgaacaagaaggcagagcgctgccttgttcaacctcagctgaggacatgtgcatcgggtgactcaaacttttttcactgctgtgtgcatgactgcgaatgactgcagaacaccatgaatattgatttgatttcggggttacaaataaattttaacacgtagaagaatttgcaaatatatattcagtgaataatgagggtcagttgtctttcttacttcattacaataagactctacttcaattcagtatttttatttcattttattttgtttttgagagatagggtcttgctctgtcacccaggctggagtgcagtggtgtgatcctagctcactgcagcctcaaactcctgggctcaagtgatcctcccgccccagcctcccaaatagctaggactacaggaacatgccaccacacctggctaatttatttatttttttgtggagacggcctccctatgttgcccaggctggtctccaactcctgttttcaagccatcccccttctcactctcccaaagtacaatttagtatatttattaaacgtgtgttccaggctttttgattgctattgagatgctaatgagatggtccctgtcattaaagagcgtccattctggtggcacaaggaactcaaattatgacacaagacagaatacctactccagaagagagttctgtgaaagcgtgaaggagggacttgagtgtgcgattcaggaaggacttcacattggagggagtttttttagataggtcttgagaaacattttacattttgaacacctcatacatcattgataaaaaaaagaagcaattggtcgaaacaacttcatttccccagatcaagtcttctaggttacctgcatctgcacccaccagtcccaccttgattcctctctagatgaagggcgtcttttcctacctaaggccgtcccttctgcttatgctggggactcctttgctctttggggcatcctctcttctcctggggaattgatctctccctctctacttgaatattcctactagtgtatacatgggcttccgtgtcatcccccttgatcccgcattgccgccagccacccctcattcctttaggcctttcacagcaaaattgctggaaagggtggtctgaagtcaccatcactacttcctcccctcacattctttccaagccaccaccactttatgggggctgctcctttggaggccacttatggacattgcatcacctttctgtccttttatcttaagtaccagttaggatgctttcagctgcctgttgcagaatgtcctgatacaagtgacttacacaatacggacattgactgttaagagagttacgttctcactgaacaaggatgttccaggcttggcttgggtgtttcataacaccttcaaggacccagacttcagtttcctgccctgcctctcttgatcacatcagcagatattatgtcgtctaaaaacagggaagggagtgaagtagcctctgtgtttttctttttatcatggaggatgttttttttgccctgcaagccccatgcacatttcttaaatatcacccccctaaactcatccctggcaaagggggatggtattatccttattggcttggaccaattaagattcatcccctgagtctgtgaatgggacgcatcttctttgaaatgttgtcatttaaccaaaattggatctgttaaaggaagggggagcgcctaaggtgaaagtgccaggcagtgtctgccacattttccctgacccttcctagcaattttgacagccagccaccccatccttcttgaagcacttcatttccatcacatgctttgtgacatcatttcctctgggttttatttatttatttatttttttatttatttgagacaaaatctctctctgttgcccaggctggagtgcagtggcacgatctcaattcactgcaacctctgcctcccgggttcaagtgattttcctgcctcagcctcccaagtagctgggataacaggcatgtgccaccacacctagctaatttttgtatttttagtagagacagggtttcaccatgttggccagactggtcttgaactcctgacctcaggtgatccacccgcctcggcctcccaaagtgctgggattacagtcataagccaccgcgcctggccgctctgggttttcttttaacttttctggccactcctgtttcctgttgactcctttctcattgctctacctctaattggtggaatgcccaaatagttagacctgaggtccttcttgtcaggatctgtaggttctcctgagtgatctcagcagtccctttgtatcatctatatgccgagtatatcctaaacttgcttctctcaagagtttgtcatctcattgaatgagtttcccatctcattgatgggcaccgccatctatctgtatagttgcttaaagtacgggcatgttgcatgagtcctctgtttcccacccctgccattttgttctccactcaccagcaagtcctgcctgatacgatatctagaacacatccagaatctgtttgtttctctccatttctgctcctgccaccctcattccacgcatcttcctgtgtggagagctgacagcctttttatcggcctcctttcttctacccttgctcccaataattgatcctccgtggaacagccacaatgatcttttaaaaatatgaatctgatttctcttgacccgcagcttaaaattctctatcggttcctctttccactcggcataaaatctgctttctggtgctggcctgcagcaccctgagtgctggctgtgctgacctcctttccaaggctggtcttgagccgtcttcctctaacctatgctgcacttctttctgctttccttgaataaaacaagctcctcctgatctgagggcctttacgggacctctttttttttttttctcctaggattatcttctgcccaattttcataggactggcttctcctcgcctctgaaatctcagtccaaatgtcatgtcctccaagaatctttctctaaccgcccactcctgctgggcaccctctgttgtagcatactgttaggagtctctgcatcatgcctctaactctttgaaaaaaagttctatttgttagtttaataaactaaaactaaaaaatttataaaccaaatttcaaaattttaaaaattaataaactaaaaacagtacaatgatatctctgtgaagtcaagggaggagagagttttaagaaggggaacttaattagcagcactaaaggctctacaacgactcaagataatgataatgatgatgatgatgatggtgataatgacagtgataactaacatttattgttactatgaacctggaagagtgccaggcattttgcgtacattatcatatttaattctgacagattaaaagtcctgacaatgcctctactgtcaaggaatgttattctcattctcagaacactgagacttagggaggtcagtcaaagtgcctggcacatggtagctttcgattaatgtttgctatgtgagtaaataaatttccacaaggtcctggagctggtgaatggtagagttgagagtctaacttagatctgactgaatccaaagtccgtatttgtaaccactggtctatatttgctcagatgaagacagagaaccccttaacagattgagaaaaggaagcctaatataggataaatgatttcttatttatttaaaacatatgataaataaaactaattttcagtccaaaaccttctgaattttggaattctggactccattcattcaattcatttgaaggcataggtgagttctttaaaagaagcattaggaatgaatccagattgaacaattttcttattaaaataccctaaagatgcattcttatgatgagccaggttcattgtccaggaaagctattaaaactcagtctttgtgatgagtgcagtaagaaccccacttgaattacgtagtgagcaggtgcttcctaaaccaagtttcatgtttgacaagctaggagagaacccagtgttaaatgttttctggcatgttggcctttggtttctcatattatgggacatatgtttagtgcttgtggtatatgcttagcctactcttgtaggatgactgagacctcacacaacatcaaggacatagtctttgcctttgctgagttcagagtgtaattggagtgatgaaacatacatgtgaataaatgcaaagtcacaagtaaagacagttaatgtgattgatgaaggacgtgtggcacaagatggataagaatgagaagtagaagaagtaggtggttttgaactttcgttactcagggaagggaatgtatgtggattggtggagaagagaggggaggaagatggttttaagcactggtaagatggtgcatatttgcaagttttgctcaagggatagaaagggctgagacccagtggggaggaatcagaggggaatcggcaaagagaattagggaaatgagaactgtcagtagaggaagtgagattaggctggccgggagctatttggggtttctgagtactgatgttacatgaaggaatatttgtgagggataaatattgcagtgggtgcatttgagagcaaaaccagattcaggcccagttagggaagggtttcttaaacgtcggcctttcctatgccatcttcactttttaattttttggtggccatatttagatatcagctgtgtcactatatacttaatattttctgtaagttgatttcacttttaaaaacttaaatttagctttgccctatgcaataaacttatcattgtttactgaatgcttttctttaaatttaaccccttaaatcttaaataaatgtagccttaccccaagcactagtacctatgaaatcataggtattctgtgctagttctatttttccaaatgcacagtaaattaaacctgcggccattaaaaaaatgttgcatatgtgtgttacctaatgctgtcttgtgtacctatggttcatgtgctacacttttgggaatacccaaggcactgttacagctttctaactgtgacatgatgaaactgaataaataggagccagctacatttattagatacttactgtgtgcaagcccttgtgatggaggagatgaacatatgatgcagtccttactcttaatagatttggagcaaagcagagagagaatggcacaccaatgagaaagtgagatgtaggcctgacaggtccaatctctgccatgtaaagcagcttttagataagccatctgatatcagctctgccactggtcagctgagtgagctgccactctggaacccaagggtaagctctcctcaaattcagttcacttcaacaagtatttgccagatactatatgacacttttgcagatattaaggaaattaaagtgtcttagggagtgttaaaccagaaaccaaagtatgaagtgggagacagagtggaataaggactgtaagagagatgcaatgacatgtattcggtacttacgggaggaagagtttatagccagctttggggaccagggaaggcttcctagaagatgtgtcatttcagatgaactttaaaagatgggatcatacaaaaggcagtgatggagggtgttcagcagagggaagggcatcatcatgacaacagagagggaaactgaggcacctgtgaggagaagagcaagtctccgttgtttggtggtgatgttgggggcatgaaggtggaaaggaaggttggggtcttatggataccttacatgctaggttgaacatggatttattttcacagatgatcaggagccatggaaggctacactagctgggcgtacataatttaagtcagagggacaaataactgcaagctaaatactcttagggagaaactgcagcaatctgggtgagaaacaatgaatttgtgagtagtcaccatagcaaaggtctgggctaggggggcactggaggagtgaaaaagaaaggtttaaatagtcactgagagggctgaggacccactagccactggcatagtggagtcaatcatttctccgaaattacgaggaggagaggtggggcatctctaaggcgtggagcagtggaggatggtgattgtatggtaggggaaagaagataatgatcgcagttccagtaggtgatggatgaggaggggaaggcgttttacagattattcactgggaaagaacagaggcagtccacactgtagttaattccttttatttttgtctttaagtatactcaaggataaatagccatacaatttctgtttggcttttcatgctggagaggtgcagaggttgcactgaacgtggacgatattaattttgacttgtacaagggtactgtgtcctgggaactggccaataatattctatgaaaagtcatttgagtaactcatttttatacataaaataggtagttccttttcaatttccttatattttgggatacttacatgccaggattcctctatttcaatctcttgttttctacctgaaaagatcttacggttggtggctgtggatgcaattctgcctttacacagaaatgactctcctgggcatacctttaggcaaagagcagatgaacgcataacgagcagctttgagatttggtattcccactgcagaacgaagagaagggtggcccactggaaatttcctcagagaaacgtctaagtctgcatctcccacatccattcattttcatgcatagttctttcatctgttgttttttaatttatctattttatataatgtctatctctgtagtacctgggatgaaatgcgccaatcctgactgcaatgaatagggcaaagcaattcttgggagctgctctgggcaggaagtggaggctgaattcttttaaaggaaaattttttggggatcgtgactcactggccttcatccccatcatcactgggattggttaagtgccaggaaacagctggaagtcgacagacaatttagggtacaaatgaaaggagaagttactgttaaagggatctgtattctctgttatcaaaaccaccaacgctgtctcctagctaataggaaccaaaactgtgccctgagaatgctgccagatgtttctcaataggcacgttacgttttatggtcctggatgctgcacttaaaaatagtgtccaatttcaaactcactattaagtagacactaaacttttggaatctattaatggatctagatctccaacctagtggcaacaaatgtttgaagtgaagtttattgttttaagtgaattttaaatgtgaaatgatgagtatttaacttcaatttttttgcatgatttttccactgtggcaactttccttttaaaatgatagaacctcattataatgtggctgataggaaatctgtttattcatgcatatatttattcatttacaaatatttatttactacctaccaggctctgtgcagtactccgataaactggaacaagagccatattttgtactttgtatgtttctccaagagaaatgttctattgtactacattaattcttagatgcatttttgaattatttacccttctgaaatcagaatgtgtcttactagcaatatgtcataatttaattggcaatttaaattttcaagaggcacataagataatgatgtgttttgtaattgacaatgtcttgatttgatagaagatatttgtacaatactatattggtaccatgctttggccgatgtaatggtcctatttggagttcactactaatgttaagcctctagttttaggcgttgatgttggtccagggacactaggactcaaatgcccagatgtccaggtctaagagagaagaatcagaaggtgaatgcagagcccagtgggttcaagccatgtagacaataatagcagaatggagagacattttccgatgcctcatgtctatgcatcttctctccctttctggcctgccacataaattcattgcagtgcaactctgccagatatcagaatagagcaggaggaaagagaaacagctgcagcatgggagataggactcataccaagagagattaggctcggtgtgtatacctaatgatggtaaagtgaacaaccaggttacagtgatagcagcaacacgcatttatcgagtgtcctatccacttcagaaacactatttttaaatgataacaattctacaagataagtattcattgatcatcaatattatccttgtttcatgtgtaaaactggggctcagagagggtaaaaaacttgtccaaggtcatacagttaggaaatggtagaaccaggattcaggctttgctccatggggcatcaaggtctgctccacttccagtgtgccatgcagtttccccaaatctgagaacatgcatttactttatgtccggttatgtgaggtctcagaagccagacagggccagagtatgaagagttacataaaagagcttcagaatctaatagggttcctgagcaagattctaccaatacctggaataacttcctctgtgtatagcccaggtgcatggactagaccagattgggaggggatggttgcccagcaggcccagagaaggagctggtagcatggtgagttaagggctgaggatcaagaatttgttagtttaattagaccccccaaagagcagaagtgctgttgtagttaagactctggaactcagtgataggatattttaataaagcccatgatctcaagaggaacttgctgaatggatgagctcacagtccatagttgggagctaatgaacaactttaattatgtttctgatactagtggaggtgttctcctgtcaatgaattccttttagattttgaccccatgtagatctcaaggaaataaataaataaataaattagttaattaatttatttattttgagatggagtctagctctgtcgctcatgctggagtacaatggcacgatcccggcccactgcaacctctgcctccctggttcaagcaattctcctgcctcagcctcccgagtagctgggactacaggtgcccgccaccacgcctggctagtttttgtatttttagtagagatggggtttcaccatgttggccaggctggtctcaaactcctgacctcaggtgatctgcctgcctcggcctcccaaaatgctgggattataggtgagccaccatctcaaggaaatttaaaatgtttgggtttgctactgaagagccaagaagaattttgcaaattatgagaaagagcccaagctttcaaatgtccaaggtggctattcatatctgggaactaggaagaattccaagttgttcacctatgcctgtttctaatgccttcccacaagggtgacagagcaaagttgatttctattaatttaggggaaataatctccactgaatggccagaacaataacctttctaatgacacacagaacaacgctactgtcacccttgtcacggctgtacttgtcatcataggtatttattaggtacttaaatacttgtttggctcaagatagctcacaaagagggtcataaagtctcgttttctgtcttttagagtttccagtataagaacaaatagatgagcaaacacatataagaaatacattgaagagaattagaatattcatgaatgtacagtgagaaattcttaacctatacagggtcatagttgacttcatttaaatattttctaagggtagaacgcaacattattagaatacctgagaggggaaggttgggaccgtgcccttgaagtagcatattaaatttaagagaggaaagagaaagctggcaatatttcaagtctggaactgatccttaaggcaatactttgctgctggaatttgtattttaaagaccagccagaatctcttgtggtcctttgcccatgtagccctatgaggacgtttgtatatttggattgcttgaggcctgagtgtcatgggcataggcagagtcattggatcaacccatgtatctgttgcttgacacattgctctggatacattgtacccaagaaatcagcccaagtgggatccagcccaaaagagaattgttgattttcaaaactgaacagtccaggcaaagctcaatctagggctcagatcatgcatccaggactgcatagttcttcatttcttgattcgtcttctttgcattgctctattcttaggcaagttccatcttggaaatcctaaggtggctgccgaaggctgcagaccctcctctgtcttccagatttacatccttcaggagagcgaaagctcagttccctaaggctgaaacaaaagtcttgcaatggcatctttttggtcctgattggcctgtctagggtcagatactcattctttaattatcatggtggtgattgggggaatcgaatgtgctaattggctttgcctgggttgtgtgcttcactcatggaacctaagagagaagcccagtgaagcccaactcaagggctgagagtgggctgtagtggtttccctaaacaaaatcggtactgttgacataatatggcatggtcatggatgctgagagaatgatgtagagaaagggtggatgagaatggaagcaggactaggcacagtggttcacacttgtaacttcagctacttgggaggctgaggcaggaggatcgcttgtggccaggagttagtgaccagcctgagcaacatagtgagaccctatctctaaaaaaatttatttttaaattagccaagtgtggtggtgcatgcctatagtcccagctgcttgggagactgaggtaggaggatcgcttcagcccaggagttcaaagttacggtgagctatgattgcaccactgcacactagcctgggtaaacagagcaagactctgtccataaaaaagaagaaggaggaggagaaggaggctaagaagaaaggaagtgggtatgctagtttggaggtattgaagtccaggcaaagaatcatggtggcttggacaagcagagtgactgctgagatggagagtggtggatgggtttgatttctagtttggagatggaatccacagcatttgctgatgaaatacatgttgaagatggtaaggaaaataattaaaaatgattcctaggcttgtggactgagtaacttgggaggatggtggtagcatttcttgagataggtaagaatggagggtttttattattttaaaatcaactatgctattctagctctgtgggatttgagaagcctgttaatatctgagtgggaatgtcaattggacagttggagacaggagtctggaatttagagggtagagctggaaatatatattcatggatatatgaatccataatgagaaggggtggctatagcagtttttatttttacttttaaagccatttaactagtttattaaattggcgggccttcttgagagtacaaaccataaatcacttcatttatcttcaactcctaccttcactcttgccctgtgaggccaaccctggatgatacaccagaaatacctcacagcttttccaggcactttaaaaatcaaatcaagtaaaatagaaataaaaattgtactttttttttcagatattcaaaagtccagttttacatgaatcaaaacatcaacctctcatccaattcaaagctctctttcagccgggtgaggtagcttgtgcctgtaatcccagcacttatgggaggccgaggcaggccatcgcttgagcccaggagcttgagaccagcctggtgaaaccctgtctctactgaaaatacaaaaactagctgggcgtggtggtgtgtgcctgtagtcccagctactcgggaggctgaggcacaagagtcgcttgaacaagtggggagggctttgcagtgagcagagatcgtgccactgcaccccagcctgggtgacagagccagtccctgtccaaaacaaaaccaaacaaaaaaacctgtaatcccagcactctgggaggccgaggtgggtacatcacctcaggtcggcagttcaagacctgcctggccaaaatggtaaaaccccgtctctactgaaaatacaaaaaattggctgggcattgtggcgggtgcctataatcccagatactcaggatgctgaggcaggagaatcgcttgaacccgggaggcagagtttatattgagccgagatcgcgccattgcactccagcctgggtgacagagggagactccatctcaaacaacaacagcaacaacaacaaaacaaaatcacaaagctctcctttccctgtaggccaggcctggcctgagacactgcagatcagccatgggaaagggaaggcgggggccgtggctgttccttttccctccttgtgcacactcctttcctgctggctttgctgcttttggctccaccacagtcaaggggcagggagaaggtgactagaaagcaagggtgttttacttagctggtgcttcttatggttctttctagtcatgaaatagtctctgtcttgcaggtgtccagcttttgtgagttcttggccaccctgtgaagacccccagactttcctctacagacatggatgatgccctccctggctggtctcttatgacacccccggcctctcagcttctgccttgagtgtaccctgaactttttttctcaagtggatggacttcttggggaaggcttttttctgaaggctttgatgtagcttctgaccccatccagtgcctacttggcccaggagaaaccattaggcatctttgtgctgccatatatggggaaagcacgtgactccactgttgcctaccctcctcagcctgcattacaggccaaacactgcgcacccatgtctgattttcccagggccgtctcattgcacacctccagagggcatcattcacatgtgttctcctagaattgcacagttaatgtggcagccctgagttcagacaaatctctcatgcccctacctgtagcagtgcattctatgaagtatgcagttcagcaggcacccagctggggttccagatgctgagacccccttctgccaacccctctgatctctgagcagttctctttctgctccttcatttgccatagtgctgcaatgctatgtgttcttttctgctaagaaatgctttttctccagcgaattctcttatatggcttagagatcatatgcaagctctgcattgatggatcctcagtcttcagttttgagagatctcagtataaaccccaagacaacaggaaagggctcacttaacattgccttgtaacagagaaaccctctctttgaatgaaagctgtcagggaagctcagtatataaagcaggtgacatggtgctccattggggtggtggggaacgaggggcggggtgctcaaggctggcttctgtgcacagttagaaaactcctgtgcctgagaaagccaaccgtggtttccacgaccaggagtttcccactatttacagttctgcagtgtttggcttcttcatgattttctgctggtgaaagcaatagtttgtacaagacgtgtgggaataaaaatagtccaggtgctgcccttttccgcggcagagggaccacctgtcaggctgccctagtgggcctcttcccacagcacggttctgccacttgaatacctccctgcctgtttcctgacgctgacctagaagcttctggtgaatgctttgcttctgcacaacttgcatggtgggtgccttttttttgtgaatgaaaaggtcttcctctggctctgaatatagcaactgcatgacctgcagaaataattttgttgtttccttgtggccatgttagcttagggctttgtaccttatagggacattggcaagaattttctcaaaaggttttcatctgtaaattttcatctttgcacatagtagagagcttagaacgtcagtctcgttccatctgttataagttttgaggctttgggcaaagtacctaacttccctgtgcctcgatttctccatctgtaacactggagcaagagtagaacctccatcctggtctgcggtgaggcttagtgagggcattcatgtgaaatgtacacagtgcctggcacagagcaagcacccagaacatgttactaattgcattagtttcctcttgctgctataacaagttgcacaaactgcatagcttaaaacaacacaagtttatcatatcattctgcatgttagacttcctaagtgggtcatatggggctaaaatcaaggtgtccacagggctgtttccttctgggggctttagggagaatccttcccttgccttttccagcttctaaaggctgctcatgtttcttggctcatggctgcaccactgtaacctttgcatctgtcctcacatgcctcctctctctggccctcccgctcccccttgtgattacactggacccacccagataatccaggatcatctcctgatctcaagatcttaatcacatcagcaaaatccctttgtcgtgtaaagtagtaaagtaatgtgctcacaggttccagggatcaggacatggacatctttgggggaccgaacattatcctgctgatcctaccaattatttaaaaagttgtcctgtaagtatctacagtgtgcctctgctgtgtgctgggcatacaaggtgaataagacacaatgcttatgccaaaatagatacacaagcacgatgcccttagtaataatcacagtagctgacatttactgagtatttactatgtgccaggcattgtgccaggcacttcaagtgaattatcttgctgaaatctcaccatggcactaagggaaaggtataatttccattttaaggataagaacactgaggcttagagagcttaagtattttttctcaaggccacagagctaaggacatgagctcaggtctatctgattctaagcttgaacaattcatcacagcccccttaaaagatgggtgggtttaccctcaggctctcttcttcactgtgtgtgtagctaaagattggccagcttaagaggagcagatcacacaagcagctatgatgagggccagtgggcagagctcccagaggaggctgatgcaacattgctcccattcctgccatcacccaaagctgcaagtccatggccctggcacttgggcaaatgttgccttgtcttcaagtgaatctaaaaaactgtgtaagggcatgattaattccaccaaactggattctccccaagatcacttacaccacactaatggggccctgcttcagcctgaggaactgtgtgaataaaagagaagaagcccagtgagattcttctttcatgattaatagaaaaaccacctggtgactttaaaaggcaaagaaggaggtacattcagatgagtcagaaagaaaaggcagcatttgaatcctaaaggccatgttactcttgatcttctccaggatttcctttagggaaatggaaatttttacatggagggcagaggtggggtgaaggttggactgtagactgagtggtgttataatgagaccaacccgggtgctgggttgaatcatatattctagatgggaagtttatattctaatgagggagacacacagggaatgagcaaatcagtacagaatacaatctcagctagcactaagttgctttgaggaaaatcaagccaggtggtgggctaggaagagactggaggggagaatggcccttctgcagtggggtggtgaggaaggaagtcctcgctgaggaggcagcattgagcactgagagggagctaccctgtaaggccctgggcaagactgttccaggttgagggaacaacacacgtgcagtccctgagactagagctaacttggacaaatgagaagaccagtgtggctgggcggtattgagggacagatggtaggagatgaaggtggagaagtgggccatggccagaatttggggatctaaggacaggagtttggaggttcctcagggagttgtgggaaccctctggaaggttttcagcgtgcagtggagggatcgaatttacattttggcaggcaggttaggacactgttgtgcagaaacaacaatggctaatgggctggttgaggtgggaatgaaagaagtggtggaatgaaatcaggatgtatttggaagggagagttggctggactggctgtgggtgtcagggcagggtggagccatagactactctggattttctgtccaagccctggatgaatagcagtaccatgaattgagatgcacaagcctaggagaagaggcagatttgggatgtgaatgtgtatgagtgaaaacaaaatttctctttgaatcatgttcaatgtgctacttggacaagcagctaattggacaactaagtgtaaaaattaaatagtgaacaatgagtggaacaaaacgttagagctgtacattttgctttagaaggggcatactttttgctttagaacgtgtggcaatctaatacaaatggccaacaaacatatgaaaaaatgctcaacatcactaatgataagggagatgcaaatcaaaaccacaaagcgatactgccttacccctgcaagaatggccataataaaaaaatcaaaaaataatagatgttggcggggatgtggtgaaaagggaacacttctacactgctgctgggaatacaaccactatggaaaacagtgtggagattccttaaagaactaaaagtagaaccaccatttgatccaacaatcccactcctgggtgcatacctagaggaaaagaagtcattatacgaaaaagatactcatacatgcatgtttctagcaacacaattcacaattgcaaaaatatggaaccagcccaaatgcccatcaatcaatgagtggatgaagaaattgtgatacacacacacacacacacacacacacacacacacaccatggaatactattcagccataaaaaggaatgaaatgatggcatctgcagcaacctggatggaattggagaccaacattctaagtgaagtaactcaggaatggaaaaaccaaacattgtgtgttcttacttataagtgggagctaagctatgaggatgcaaaggcatcctcattggactttggggacttggtgaaaagggtgggggcagtgagggataaaagacagcaaattgggtacagtgtacactgctcgggtgatgggtgcaccaaaatttcacaagtcaccactaaagagcttagtcatgtaaccaaacaccacctcttccccaaaaacctacagaaataataataaaaaagaacttgtggcaatctaattgatgataattgatggtagcatccatgttggggaaggaaggaaacaatgccaaacactatgctagctgcttcacatgtattgtttttcacagggtgtaaggcttgagaagcatctagtgtcctgtgtcagattatgcattctggaggcagattgctaaggttcaagtcctggccctgcctgttagtggcatgttctatgctttgcttgcttatctgtaaaatggagtaataataataccttgcttgtaaagttatttttacatttaaatgagttaatgcatgtaaagcacttggaatagtgcctggtattgtaatgaacaataaatgagcaattttaatgttactattttattttctccgtagggtgcacctcaatagatggaagagtagggcatgtgataaggtttggctgtgttctcatccaaatctcattttgaattgtagctcccataattttcacatgttgtgggtgggaccaggtgggaagtaactgaatcatgggggcggttcccccatactgttctcgtggtagtgaataagtctcatgaaatctaatggttttataaggggttttccctttcacttgattctcattctctcttgcctgctgccaagaaagacgtgcctttcaccttctgccataattgtgaggacttcccagccacatggaactgtgagtccattaagcctctttttctttataaattaattacccagtctcaggtatgtctttatcagcagtgtcaaaacagactaatacaatgtgttataacaagagtgttacttcagaatcttgttttaacttgtgtattagtcagtgtgcaggatgcttgggttctgtcctggtttttgccatgtttccattttatgagcagttcctctatcacaatatagatgaatgcctctatcacaatatagatgcagcaataagttgggattgctgcatagccatcccaacttattggcataaaacaagcattttattatgctcagataatgtgcttcagggattcatgcaggacacagaggcgatggtttgtctctattctgcaacgtctggggcctcacctgggaagatgagcctcacctgggaaatctacaggtgtctgtggggttaggggagggggctgaaatcaactggaggtatcttggctcatgtgactggtggttgattctggctcttggctgagatctcagcgtggctgttggctggaacatctgtatgtgatcactgtgtttctccacatgggttagcttgagcttcctcacagtgtggcagctggatcctaagagtgagcatcccaaaagaaccaggcagaagcggtgtggtctttcattatttagctttggaggtcacatagtgtcacttctgctttagtcacaagcctgtccagattcaaggagagggaacataggttcgatgttctcacggggggaatattaaagtcacatagtaaggagtatatgggataggagagattgttgtagctagttttggtaaatacagtcttccaggaggcttaacctgtgggccacttatgagcctgtctggcttaaaggatccagtacacatctaaatttggacatactctaaaatcaggatctcttttatttattaaagaacctgagtaatcttaacctaagttgtattaaaattcaaagattgactccttagaacagctaagctttcgttcatttaatgggcactgattgaatcttgactctgtgcaagatcctgtgctaatggctgtgggagcatattgagatgccacaagaagttggcatgctaaaaggtgaagacaaatacagatggctttcaattaactagtctctggagagacagaggccactcacaacctctaatgatagttaaaataaaacttattcaggccaggcacagtggctcaggcctataatcccagcactttgggaggctgaggtgggcggatcacttgaggtcaggagttctagactaccccggccaacatggcgaaaccccatctctactaaaaatacagaaattaaccaggcatggtggtgcgcgcctgtaatcccagctacttgggaggctgaggcatgagagtcgcttgaatccgggaggcagaggttgcagtgaactaagatggtgccactgcactccagcctgggccacagagtgagactccacctcaaaaacaaacaaacaaacaaacactatttaaaacaagacacaaagtgagtttaatgcaaacttatttagttagcattgcatttaatgttcaggaacacatgttccattttgtagacttcattaattacaactagcagttatttaagtgcttactagagacattgaatattctaagcaccctgtgagtattatgtatttaatttgcacaatacagtgaagcagttactttatcgtacccattttatagatgagagtgaacagtagagaggttctcattttgatggttaatattgtcaacttgattggatttaaggatgcaaagtattgtttctgggtgtgtctgtgagggtgttgtaggggagattaacatttgagccagtggactggagaggaagacccacccttaatctgggtgggcaccatccccttggctgccagcacggctaaaaaaagcaggcagaagaaggtggaatgagcagactcgctgagtcttccagctttcatctttctcccgtgctggatgcttcctgccctccaacatcagactccaagttgtttagcttttggactcttggacttacaccagtggtttgccaggggctctcagacttttggccacagtgcactgtcggcttccctacgtttgagtttttgggacttgggctgtcttctttgctcctcagcttgcagatggcctattgtgggacaccttgtgatcatgtgagtcaatactccttaataaattccctttcatatgtacatctatcctattagttctgtctttctcgagagccctgactaatgcagtcatggaggctggcgtttgtacccagggtctcccagtccccaggtgcatgctcaatgtgacagggctagttagtgcaaagccggcactagaatccaggttctggattttcttcttggtgttctttcctctagacttgaggttttgaattgtgttcctgaatcttttgggtcctaaaaaagtcttgggacctgctgcaggggttgagaagaagcaaagctcatgtgactctaggcccttactccaaagtccaaccaagtagcatgctttgaggtaaattatattgtgttaaacttaatatatgatacatagtataatgcaatacttaatatatatttaatatatttgtaacatacaaaatacaatatccaagagcagtatggaacaccaaaaggtgttcagacttttttttttgagacagtctcgctctgtcaccaggctggagtgtggtggtgcaatctcagctcactgcaacctctgcctccctggttcaagcaattctcctgcctcagcctcctgagtagctgggactacaggtgcccaccaccatgcctggctaatttttttttgtatttttggtagagacggggtttcaccatgttggccaggatggtctcgatctcttgacctcgtgatccacctgccttggcctcccaaagtactgggattacaggcgtgagccccttccttcaaatggaattttatatctgtgtttacattttctgcttaaagtttgaattttgtttaattcaattgaatttccacttaaaatgtaaacttttgaaacccacacctctgacatattccacattgctgttggatatttttagtttaaagatttggcctgtaagctgtatcggtatcattattctaacttcaggctcaaggtctcagtcactagttaaagtcttttctaccggcaaatctgtattaccatctactgtggaagataacctctaaagtgcccatgtaagcacaaatccataaaactaaaagtcaaagaaaaaagagaaagagtttattccactgtttaaaagttcagtttgatttagatcttatatctcttgggttttcttgactgattttttacataaatgtgtcccagaaagagtgatcatatcgtgatctttgttcccagttttccttttccacatcaagttttcctgatggaaagtgatttaaaaaaacccttaaagtgtgataatcactctcttctttagtagacagtggagtttaatagatgcatacagcagttgtttacttgtgatgaaaagaaatgtgaattttctggtgcaaggacatttctagctcatgtctaaattgcagagagaccacagtttgacatagtgctgaagcaggttgtaagaggtaggggtacaatgtatgtctgcacaggttgtgcactatgcgactgtgaatggtgtcttctggaattgtctatgcggaagcactgtcaggaggtcgtggattccagcctctgttgatttttgtgcatgggagagcttgataccaagcctcaaagtactaggaataagaaggtattacatgctgtaattttcaaggtggtgcctttctgtacctccattgcttttagtttagggcatttcttctgcaatctttggagggttcctaggaataaaaaagtagctagtttgagacagtgtgcaattgtgctgaaatggaggaccatgggggtagatgtagttcccttcatgccagtagctaattggcttagtttgctgatttgttccaggatattccctaaaaataggtgtcttctaagcctcagctttgggccttgaggtatggcatggctatccgctctctgctcctgctgagctaaatgcagtcctgaatgccaaatattgagatttggaattatcaaaggactattagcatcaaattgagaaactcaagctaaatttgcaaattaatacaaaatcatgaactgagcttctcttccagagaacctcttgtaacagaacttgaaggtggcaggatgtcttgatagagcgtggattttagagctggatgcatgctgggcttatatcctggttccagcatttgccttgggcaagttatttacaacctctggttgaggtggttggactagttgatatctatgattcctttttaagtaaataactattagttttttcatacagtataattactatataacaaacatcttcttctttgatttcattcatgcattcaaagtatttattaaatgccctccaatgccggacaccatactaggtactgggtatataagagtgaaccaaatgagcagggtttctgccctcagggagttgataatctagtggggaaggtgttggggatgatggttcatcaatagtaaagaaacaaataatataactacaatcatacttgctgtgatagagaataatggggaggacctatgtattagtgggggtactctagagaaacagaaccaataggatacaaacacacacacacacacacacacaaatgtatcttgtgtatatatatatctatatgagagatatatgtatatatgtacatatgtatgtgtgtgtgtgtatgtgtatatatatatatatatatatggagagagagagagagatttatttattttaagaaattgactcacacaattatggacaggtcccaagatctgcaggtgagtcagcaagctggcgacccaggagagctgatagtttagttccagtgcaagtctgaaggcctgagaaccaggaaagccaatggtataattcccctgaaaagccgatatttcagttcaggtccaaaggcaggaagaattctctcttactcaggggaaggtcagccattttgttctattcaggcctccaaccgataggatgtggaccacctatgtcgtgggagaaatctgctttactcactctgctaacttaaatatgaatcccatcagaaagcaccctcacagaagtacccagaataatgtttgaccaaatatctaagcatcctctgacacagtcaagttgtcacataaaatgaactatcctaggctacttagagtagtcagaagatacctctctgacatggtaacatttaaactgagacccaaagaatgggaaggagccagccgtggaagaatgggggacaggccttccaggcagaaagaaactgagtggtaaccgagtggaaactgaatggaaactggagtccagagggaaaaggggcatgttgtgagatgaaattagagaggggacagaggctttactgtcagaccttggaagccatgataaggggcttgcattttattctagatgcaacgatgagaggcactgagtttgagcaccttggaagccatgataaggggcttgcattttattctagatgcagtgatgagaggcactgaaaagtttgagcaaggaggaatgtgagaggatttatgtttcgaaaagatttttctgactgctctgtgggagtgggtgagagtggaaagtggggagacctgagagaaggctatggctggagcctagtagggagcaggtagcctggatggagggccagggggacagagggaagtggattgtttgcaggtctattttggcggtagaaatgagagaactattggggagggacaggacaagagaacagaaagtaaggctgcctctcaggatcctgcctatttggcttgaacggtttgggtgaacattactatcattcggggaggtgagacttccttttttggttgggtcaactaacaagcgcaattttcacttactaagcatgagacacacctgaggtatccaaatgaaactcaatagtaggcaattgggtgtgtgaagctggagttccaaggacattttgggtctgggtgtatagacctgggagccatcagcatgtaggtagggattacacagggagaggatatagaacaaaaggggtgcagaaaataacccacggaagtccagtgtttaggcagaagaagaagtatctgcagagtggatttaaaaagacccaacgagagagggtggaggaaagccttgagagtgtgatatcacagaggctgtaagcagggagctttttaagaaggagcaagttctcctgtgcagaatattgctgagaggacaagtgatgtgtggccgtgttggtgtcccctgtgtcggtagcagagatcgttagcagagcagtttcagtggagtgacaggagaggaagaccagtagattttatgcagttttaggatgggtatcacccagtgtattagtccattttcacgctgctgataaagacataaccaagaccgggaaggagaggtttaattggacttacagttccgcatggctggggaggccccagaatcatggtgggaggtgaaaggcacttcttacatggcagcagcaagagaaaatgaggaagaagcaaaagtggaaacccctgataaacccatcagatctcatgagacttattcgttatcatgagaatatcatgggaaagactggcccccatgattcaattacctccccctgggttcctcccacaacacatgggaattctgggagatacagttcaagttgagacttgggtgggaacacagccaaatcatatcacccagtttagtacttcactatgtttttggccaattatgttgggtaggggatggttgtgctcctcctgtcccttaccttagagctggcagataaaataccagatatccagttaaatttgaatttcagaaaactttttaaaaaagtataagtatatcccaaatattgcatgggatatacttaccctttaaaaattttgttgctattgtttatctgcaattcaaatttcactgggtgtcctgtatttttgtttcctgaatctggtagcacacattgaattgcaccctttaaaatggctagaatagggaattttatgttatgtgcattgtaacacacacacacacacacacacacacacacacacacacacgtatctggcaattctcccttaactaaactaccatgtagaagctaccatgcgatgcagtctatttctaggtttagccacaagggtcaataagaaaatctgacctcaaaggaaattatgtctggtgatggttaatgcttctactaaattcccttagagcataggatgctgagcccatagtaggacctcatcaaatgctggtttgatagaaattgcatttggggaaaattagcagctgttgataactgaatggaaagaaatgaactaccctggtacctgtggtacaacttaaagaacaccatgaaatgggcctcatgggaggttctcaatgaattcagtggcgtggcacttttgggcatgcttttggaaccaagtacttactccatgtgcctgtgagtttggcacctctcatggcagcccaagtgcaactggtttctgaggggccattaaaaatctcccaatggcagacaactctcagacatgcctgcaaattccaagacagccaggctgatcatctgctactttaattggttataccagtttttatgcctttgtttctcctcctttctgtgaggtggaggaaacataaccacaagactgtttccagtgacctcttcagaggcaatttccaagcaattaagtatgggttgaatccaaagtgtattgatgaattaaattctgttccttggctgaagattctgttccttggctgacacctgaactcaaaggttagattgaactatctaggaaaacggtttttctcttgtgttttcctgcaggctttgctgtttacgaagatcttgcatcaacacttagcattcactcacatggcaagcttgcatgtggtactttcattccacattaatttagggaactctactatgtgccagcattcaatatccaatttgtcttagattttcgaatagtgtcccacaattttataactggggagttccttgaatggaaatatgttcacagtggctgcttaattgtgactaacccatcacatagagactgctttggtaatagatttgattctgagggtctaggagaagggacacttctcatatggggaagacgggattaatccttgaaaatgatactgaagccaacttctgtaccagtatagcagcttagcagacttctatatgatccatgtaagggtctgtttgctctctgagattttgggtgccttctctagcccctgagtgctgggcttcttctgaattccataggggtggaggtgaaggtaccgccagctctcacccaactcatccatccctggacagcagggattctgctcatcaccttggtgcctccgatgcctgaagcacaataggccctcagcaaacatttgttgaattcatgccatgaacattaatcgagccctttttatacactgtgcactgggattgggaccatggaaaatttagagaggaaaaggtccaccttcaaggggcatctagaggaacttatcctctagcaggagaaattgctaatgagaaaaggtattttggggagtggagtgaggtgttggtctagctggcaggttcagcctatgctcagtggctctctggtatggaaaattcctcagaatgttgattcagccaaagatttctctggcagcactgactcttgccttccttcggccacattttattccccaaacctaggtgttactgggaagagactgagctgttttattgaagataattgactttcccagtttttaagtaagtctgttgattcctcgaagacttcactaatcagagttatgaatatttcaaaaacacttcccagtcttcagatgaatggatttgtaggttttctacattgctgtctccctagccccatgaggaataatgtgggtatccttttcccttttaggtttctctcttcctctaacctgcgcccactcccagcctctgatagatgcatttgcagtaaatcacagaaatgttgctgatgtcagcagcactgatatgcattagaggagccacttcagaggaaattactcagagggtgatgctgaaatgcaaagctgtttggtagggtattttgtagaaactgttttctccctttgatggatcttgtttatttttttttgacttagtaggcacagtgaaggaataaccatccaaatgttttttttttttccatttaagttttgtataggaggttttggtgactttgaaatgaaccaggagcactgagcagctacactgacaaatggagatggctgaggctgcttgcaaagcagtgtgttggggtgtggagcctccatgtcagtgacctggggaaaggcaacagtgagggcacacctcattctacagaaatggtttaaaaatatacatatgataccccacttttgatgcacacagactgtgctgtttaaatgctttcgatggaaaatccttttgtaaagtacacgtctatcttgcagagtaggatttctgtatatgatctcaggtttgtttatagggaggtacacttggatgtcttcatgacatttatcatgacagctgtagctgagcagagaaagagggcaggactgccatggggcatcaagggccatttgaagaaggaaatggtggactgagagtgatagcgacctgtgaggctgcctggtttctgtagcagtgttcagcagcctgtgactctgagcagagagaaggaatattatacagggatatttccaggtagctccaggaaaagacaaaaggggaggaagttgagtctgttagctaaagagcagtgttgaatatgggatccaagttgggtggagaagagaaagagaacacagggagggtaggatgacaggagaaagtagaggcagggtatgatgtgggagcgatgagggtagcaagctggaaagagaggatgatctagtcaatgtcttagtgtgccttagggctactataatgaaataccatagactgagtagcttttgcacaacagaaatttatttctcatggttctggaggctgggaagatcaagatatcaaggcagattcagtgtctggcaaggatctggtacctgattgacagacagctgtcttcctgctgtgtcctcactcggtggaaggaccaagagatctctctgggttctcttttataagggcatgaatccaattcatgagggctcagccctcaccatctaatcaccccccaaagcccccacctcctaatcccatcacattgagggttagatttcagtgtgtgaattttgggggacacaaaaattcagaccgtagcagtaatcgcttcaactgagtattgagacagttcttgtggtaacaaggtttagggtgtggccatagggagactcagctgtagtggagctgttggggctgtgccaaggtcacccagatccgttttgttctgtgcacctgtcctttagcttctgggggcttctctctttctggcctgtacctacagcctttttcagaggactctccttggtctaccggagcctattttcaggatgttcctaggagttttttgagatggagtctccctctgtcgcccaggctggagtgcagcggcacaatctcagctcactccaacctccacctcctaggttcaagccattctccagcctcagcctcccaagtagcttagattacaagcatgcaccactatgcctggctaatttttttttttttttttttttttgtatttttagcagagctgggacttcgccatgttggccaggctggtctcaaactcctgacctcaggtgatcccctgcctcggcctcacaaagtgctgggatgacaagcatgagccactgcgcctggccatcctaggagtttgtatcacccactccttcacggtttgtctggagggatctcctaaataaataactcacaaacaaattctcatccgggatctgcttctgggatacctgccctgagttagtggttgagatggaatggagatgatggcaatggtgataaattcaaggaaatgggaggcttgggtcttggctgggttgtgtgtgggatgctgaagtcacttaggagggaaacaggacccagagagaaggctgcaggaaactgggggagcagccaggtctaccactgatggccacagggaagagtaggaagtggaggagccagagggctggggtctcagaggaactgcgggtttgacacaagaatatggggtattggttttccaggacaatgtgaccctgatgttgtgggcgagggagactgaacagcccctaccccagagtcacactgacagcacagtgtcctcagggaaagcccaggtatcaggagaaaaggcgcaggaaggggccctgaagaggctgggggcatgagggagtcttcagatcttcagcaggggcccctgaggcatctttggaatggtttggggtaggggtgaggggaaggttggatcagaggggaggaggctgagagcagaagagagaacaaagctacaccaagtggcctcactggcctcacacttctcagaattggtcccttcagacccggtggtgggtggcttggcagcctggatgtggggtgtggagattggtactactcctggcacacagggggcatgcattggttgaataaacaaatgaatgacacatcaagtttgtagatgccccaccttttcatcattctgaaccattgtcacttccatgtattttatggtctgataaatatggaattaatcgaagtacctctagctatttgttatcaccattattgggtgggacacagcgaacagatttcttaaagctagggaattatgcaataggacatgttacggacttaagccataagatctttttttttttttttttttttttttttttttttagatagagtctcactctgtcacccaggctaaagtgcagtggtgcaatgtcgactcactgcaacctcctcctcccaattctcctgcctcagcctcctgagtagctggaattacagcgtgcgccaccatgcctggctaatttttgtatttttagtagagacagggttttggcatgttggccaggctggtttggaaaggatctttctaataggccaaaaaatatttttcagttttgctttctactgtggatctgtagatccacagtataactacttatggtctatttgcttgtgattgcagatactgaaggagtttgctgggaagggagaagtgtgtgtggaagaagaggggagggctggagaagtgagatgagccctgagcacacgggacattggaggccagggaaagaaccatggcggtgcttgtggagttttaataggtgcaagctgggaatttcagaaggctcacctggctgctgagtggagcctagggcagggtggggggtggggggagacccctccgggagccagtgaggagagataactgcttttgacaagacacctgggaaagacatctggaaggaatggcgttgacaataagatttaaaacccttggccccagggaaaggggatattttgagaactatgactgcttgtattacttttaatcccaagaggaggataaaggtctttcctgtataaagtgcgctagttaatttaaattgtggaggaaaaaacttagggcaagagacagaatatgatattcaggaagcattttggaaaaagacacaaggaaccccagctgtggctgtgtgcacctttagggccttgatcatggaggcaggataaagaagtccatctcgtcaacatggcggagtcagagtctattgggagaatcacgaggtaggcagctctaaatcccaaaagatggtggtccagtcggatatgcctgggctgctctgaccagctcagcacacacaaggaatagctctggtcctgggcaatttgtgccctgggtcggagggtgagagtttattttatcggaacaataaaggcatcccacctgctaccaggagcaaccaaaaatgctcagaagttctggaacaggagtgctgttgaacagggtttcctggcagcccgagatagaaagtggtaaaaacagcaaaatgctgctatggtatagtactgaagtcatcaggcacacactgagacttcctgtgggtcaggccttgtgaatggtgctggagacagagactgggataagatctaccatctctgatgctgacgcccagcccagttctccccttttcctctctagttttttctttctctgtcatgcatccccctccctttgctgtcccttaaatgttgctcccttgagcatcatcttttactctcttctcattttacatctccctctggaccacttcatccagtcctgtggcttcagtaccacttacatactcatcactcttaaatctagggattcagctagattattcccctgagttctggtcccttatgcctcatgttaactggatagctccacctggatgggctacaggagctgcacacctaactctcctgcattttctgtcttgcagagcatgatactgttataagcttataagagtcatcccagacgcctcctttcttcctttgcatccatcactaggacccgcacattttacttccttaacacgccttgtctctgactcctcctctgctgctgcctgagttgaggcctcataatacattccagtaaactcctacccacaccccccacagacgatctctcacttgctgcatgtctcttacgcactgctgccagagtcagcttgctaaacccaggtctgaccccctggctcttctccctgtgttagccttgatggcttcccacgctcattaataagaccaacaagagccacactctctcctctgcttgtctttgcagctttattttggtgtagccatcttcacaccctctagtcctgacacgcagacctgaggtaatttcccaaatgccccaggctgattcatggctgagtgtctttgtatctgttgcccccccattgctgttccgccttcctctccacctccttctgccctctcgcagacacctaatgccctttccacaccagtgggcaccttgtctttgcattctcgtctcctcttcggtggcactgacactctctcttcatgtctttctgtcccccacacctctgtcaaacacagcatctgcacgctttgttgcatttgcttgcatagaacacgtagttttcttcacctcctaataatgtggacagctcacgttgattgaggacttgctttgaacaaggcattgagcaacatgccgtacattttatgttaaatcttcccaatagtgctactgcttctgtccctttccagggaggaggaaggaggcttggagaagggactgtcttttaggagccctgcccagtgtttcctgtggagggtggggccatcgtggaagacagacctatggtaggggtaagctgggtggctgttgaagtccaaccttcccccttcttcctctaaccctgataaccttgttctctggggcctgtctgctagtggagaggcttctgactttttttttttttttgccatacctttggtttataaatacaagaagagatttgggggaaaatcaggggaaactgtcgagcttacaagtcccgagaaggaagtcactgctcctttaagtctcatgtgaaccccttgttctctccccagcttgtggggtgaaagaaaagccctttagtcttttgggtcctcaaatcacagtttatgcagtttggccccagtcagagggaccccaggaaggcagactcagggtaaattctgcctgtcttccaccagagaggggactcaccaagtgtgactcatgccattcaatagaatttttaaaatctcacaagtattttgtacccctgagtaaaagagaggcttgtagctcttcatgaaggaacaagaaaggcccgaactgagtgtttggagcccagtgaagtaaaatactgccctgtctcttgtctgtccactctagcgcttgtacaaaccatgaagaactctctttggactgtttgctttttgagaatgttaacaccttgactctggatttctgcctatgggaaaaaaccacaatagtgccaggggtgcttccatatgcaggattaactctgcagtcaaagtttctgttgggcaggtgtgtgaacttgatatcataaatgctggcccaaagcaaatgggagaatggatgaatgaacaaattcaggaatgaaacaaactgtaaccaggggtctcctagttgtaggttctctgctaaacttcatattgagacacaaaggaagggcatcttataatataatgttgggggatgagcagtcagcttggaggtggggacacgtaaggtgggttttgatgtttgagaaggaattgaccaaaaaaagagtcaagaggtgagaagaatctgggaagcgagacctgtttctctgggacaggtgtgagcgggtctgggtgctgctgggtttggctggggcaaaggttgcttgtgggggcgtggcagtgggtgaggcctgtgagataggcaggcgccaggtcctggaagggagagtcagggagcaaggcatggagcctgcactttactctgaatgttggtggcgccttcagagcattgttagcaggggtccatgtgatcacactgacacctgagagagtgacacaccatgtacatggctggtatatggaggatggatttaagggggacaggactgaaggctgtcgcagtgattcaggtgagagaagatggggttctggactaaggggacaggaaagcacagatgtgagatgaggtggcaggcagttctagctccctcttccccccagtctgccttgttttcctcttctcatggctccatagggtctcagtcatttcatcatagcttgatctcttccatctggaagtgcagcctgaaattttgaagacagcagggagcaatgcttcacccaaagggagagcctcgggtggcgttttgggaccatggcttgctctcttagtgcatacagacttagtgttactgccattcttactgggatcagcttgattgcctttaaggtagggctgtcccatggaaacagggaaaacatgatttggttgtttgggtatctggaaccagaggcagcacagatactgctctaagagctgctgggacaactggaggccggtgtgggtggagcacccgaggtggaatcctgcgctcctcatctttcctgccctcttcctaacaccctccctccccagcggcctgaagtctgcctatgcctatgcaggctgagctgtaacctgggactctttggaagctctgagccatcagtgcaggtggccccggaatgattccagacctagagtaggggtgggaggtcggctgcggggcggggggaggtgagaggaggctgtcctttccctcttgcccgggagtctgcagtcacagttgcactttgcctgggtcagtagcagagtcacgctgctgtgtgacagtggcactgaggcagctgcatttcaggtttccaagagactctgaacccttggaatgccatttgtttcaggtgacatggaggaatggaggcactcgggttaagtgtctgaagatggattcaaggatgcccctgcttgttagcttgtcataggttgctcagtgtcccctctctggcccgtagtttcctcatctatcaatgggggcagataataatcatcaccttacacagaaggtttggcgaagataaaaacaggttcactggctgggtgcagtggctcatacttgtaatcccagcactttaggaggtcgatgctggcaggtcgcttgaggacaggagtttgagaccagcctggacaatgtagtgagaccccatcgctacaaaatattaaaaaattagttgggcatggtggcatatatctgtggtcctagctactggggaggctggggtgggaggatagctcaagccaggaattcgaggttacagtgagctataattgtgccactgcacttcagcctgagtgacagagcaagatcctgtctcaaccaaaacaaagcaaaacaaaaacagcttcatgcacgtgtaagatctttgttaattcttccattaactctgaaggcgggatgcgtcttattaatttatgtagctccagtgccaaatgcagtgccaggcaaactcagttgtttgttgattgaacgaatgaatggatggtgcagtaatatctgtggggcttgagaaagcctgaataatgtcaacttattaagagcttgttcaaccatgaaaaagcagatttccacatgtacccctccatatcacccacatttaggtgaaaatgaaatatgtgccgtattcttttttttgagacagaatttatctcttgtcacccaggctggagtgcaatggcacgatctcggctcactgcaacctccacctacctggttcaagtgattcttctgcctcagcctcccgagtagctgggactacaggtgcatgccaccatgcccggctaatttttgtatttttagtagagctggggcttcaccatgttggccaggttggtctcgaactcccagcctcccaaagtgctgggattacaggtgtgagccactgcgcccagccatgcagatattcttgaggaaacattttaaaatgaaaactagcagaaaggatattacctttcaacatttcctttctcatcaattcttggcagcacttttgctgcccagtactcttctgttggagctgtgaagtgtgataggccattactttatagatccattcattattgatacgttttgtagggaagaactccactgctgtttggaaactgaagtagtcaatctcatagactggaaaatatttttaatgcctatttgaaacaaatgtcgttcctattttttgggataaaagggccctttccccctggaattgctatgtttcctcttttcctgttcctacactctgcagaactgactttgaagtcagatgattccctttttaatctggcttctcgcttttgggccgcttaaccttgacttagccattgaacctgtctgggtctcagtttctttgtctgtgaagtggggctgtgttgggcatgagcatgcgcctacaggcctctaactggagggggtgttggtgatcagggccctggctgctgccctgatctccacagctgggcttgcactgcgggtacgttgctcccgggctgctcccagccagtgtctgtgcgcagcaaggataccacggcaggattgtttctgggagacacaggactcctcagacagctaacttcagctcaagaactccttgatgggcttgctaaacttccttaggctggaagatgcttacctcctccttccttctttccttccttttccaggggtcagacttacttagagtctagtggctgttctagcctccccaactccctatcattttctctcacacatgcgttccccctaataaaatccatgcacatttaatcccttcttggcatctgcttctgggggtcctacctggactcatgcagtgtgataattccttgtagtgaggaccgaatgtagtgatgtaagcagagtgtttgtcagagtgacagcatgagtaagtgcccagtaggccatcagggctcctgtcaccttcaccaccatcagcaccaccatcctcatcaccatctggccaagtttgcttctttgttggttccaggcacgagaactccagtggttgattccaggtcatgaggcaactgtattagggtgagaacaactgtggcttctaaggagaataaatggattaatgaaaatgccatttaaaaatttatccaacttggctggatgcggtggcttacgtctgtaatcccagcactttgggaggctgaggcgggcagatcacctgaggtcaggagctcaagatcagcctggccagcatggtgaaaccccgtctctactaaaaatacaaaaaatcagccgggcatggtggtgcacgcctgtagtcccagctacttgggaggctgaggcaggagagtagcttgaacccgggaggtggaggttgcagtgagccgagattgtgccactgcactccagcctgggcgagagagcaagactccgtctcaaaaaaaaaaaaagaaaaagaaaaagaaaagaatttatccaacttaagcacaatccagatccttttctagccattgagatgtgcagtcttctttgccaaaacaaccaagtccctttttagtgaaatgcacaaaaggttttgtaacattctgagatctgtgccggtactcctgacaactacaaatatactccagccagtagaccagggctgctcatttgctgttcctgagaaccctgtggacgtttagaaaaaaagatggctgctattattcacatttcacagtaagcaaacagagaaactaagtgacagtttcgaggtcatgctgtcactgatggatttgggactgaaactctggtttttgctctggtgctttggaagctcaggcatgggtggattctgttcaaactctgccctaatggacagtctcttcgcaaactggcaccaggacctggcctgaagagacgtttctcaagcccaattctgcccagcctcagggatgctagaagcttgggaagcatccatgatgcaggtcagtgacggagtccagcctccactcacctccatgctcatgctatttattgcatgtcagctgatgaggctttaagctaatgttggttacctggtgctgtggaacatgttccttaagctgactggcaagcccctgaggctgggagggactgtgccttatccccaccataccacacccctttgtgcccattcagcattaaataaatgtttgtttttgagagtgctggtgattccgatggggcttttgtgtgaaggaattatcaccaccaccaccaccaccactggaaaacaacatttgctctatgccaggcactatgccaagaaattgagatccaatgattaaaagatgaactttctgactccaagaagttgataggctagtggggaagatcagcacgctgggcctgcctggaagagcccaggacgacttcatagaggaggtagcttttggctgagactaaagaggatgggagttttccaggcagatgagggtggggaaggggttactggctgagaggacaacacctgcaaaggtgtgaaggtgtgaacagagcactgctgtgtttgaggacctgctttcagtattgctggagtgccaaactgtttgccatttgacgctgctcatccacgttgtctgtgtggtttggatgtgccagcattccttccaccctttattcacttattccaccatcattgattgtctacccaccatgtgccaggtactgtgcagaacactaggggtgcagaggtgaggggtagacagggtgcctgccctcatggagctttcaatctaatgggagtgctggacaagggcacaggctgtatcagcagcacagcacagtgagtgctgggcaagggagatgtattagtctgttttcctgctgctaataaagacatacccaagactgggtaagttataaaggaaagaagtttaatggactcacagttccatatggctagggaggcctcacaatcatggtggagggtaaatgaggagcaaagtcacatcttacatggcagcaggcaagagagcatgtgcaagggaacccacctttataaaaccatcagatcttgtgagacttattcactatcacgagaacagcacggggaaaaacctgcccccatgcttcaattacctcccacggggtcactcccccaagatgtaaggattatgggaatacaatttaaggtgagatttgggtggggacacagccaaaccatatcaggaaacctgaactaatggagggcagattcatttcctggggcttccgtagcaaattgccacacatgtagtggcttaaagcagcactaatttattattgtatggttctggaagtcagaagttcaaaatcagcctcacttggccaaaatcaaagagtaagcagtacaggttccttcgggaggctctaggggaggatccttcccttgccttttccagcttctagagggaccacattcctgggctcatggctgcatcactccaacctgtgtatctgtcctcacatcccttctctctctggccctcctgcttccttcttataagaactcttgtcattatattgagcccaaccatataatccaagatcatcccccatctcaacattcttaatcacatctgcaaagtcccttttgccatgtaagataacattcatatatgtcttggggattaggatgtggacctctttgtgggccattattctacctgcccccaaggcaggaggggagaaggtgctcccagaagtgatatttaatatgagatttctggctcagaagcaggatacacatggaagcagggaggccccttgggaggctgctgggctggtccaggcaagatgtgacagtggcctggatgaggctgctggccacaggggtagggaaaggcccaagggatgaaatacagtgatgaggcagaatgaatgggagatgtgggcagtggtaaaagaaagccaccttaggcaaggctcaccttctcggcatcaacaggagcaagggggaaagtgaatgcagcgtctttagggaaaggttagcaagaacataatgcccaggttgctgattctaacatatagatctttcaatcaagattccagacaattttgcgtttgtgtaaatctgagggaaatttaacatggagtgattttattggattggataatatgccataaaagactgacgttcagctcggtttccaaagacagaaactgattccgagggcctaggaggagaggcagatgtttacaaacttagattcttctaagccatcacctctacagccaggtgttttgaacaggcagtgacatagcctgctctttgacttttccaacagtgattgagcagtttaactccctgctggagtgggactgtttaccccacttaggtaattaggtttatcatctactaataccttcttcacacaacagccagcctgcaccatgacagagactataataagagttggaataataaagggagaacaaaactgaagtgcagtggctgttcgttgttgcacaagacatttctgtgatgcatgatagcattgcgtgtgcgtcataaccccaaacttcctgccatcgcagaaaagcctccagctgaacctatttatttccaaagtaatgaaattgccctacagagaacagggaccttagagaattctatgtgcttcgaaaaccaggaaacagtttttttccaatgacgtcttattggaaaacaatagaagaaaaattctattactagtagatcaggagtggttatgcctaagtcacatcttctattaagatataacaagctcatccttttttcctttgttttgtgacaagaggactttttaagtctctagacattcatctcttctctgctgttggtatcaccagcccttggtgcttggatagagtagttggttatccctctcctatttacttcctctccaagttcaacaacatgtttgtttttaaatctgatgatttgttgtattccttacacattgtttcaacaaggaagctaagggaggaggtgaattataaatggcagagagatagctttcaatttggaccctcgtagaaaaatgtaagtatttcaaactcagtttatactttttttttttttaaactgggacccctggtgcttattttttagaactcaaatgggtacctagcaactgatcaaattccctaactgcaggcttggtgaaccagcgtttcatcctcacatttgaaagctggctcaaagaagacatctgtgctttgtttctgacacgttttgtatttatttataaacaaactctcttcttctttgtcccccaccctgactcctcagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccaggtgagcagggagtgagtccatcttaggccagctggtggggtggatggcagtgttggttttatctttctgggtctctagtcttgccttcagttgagaggctcttggtggtcagggaagttctctccagggaggtgacatgtgagctgagacctccaagaagcgatagtgaggcatgtgacagtgtgggggaaggagggtccatgttctgcatctggttttggatgagtggtcagaggcggcagcaggccaatggactttggattttcaagttcaagtccacctatgtgtgctgattaactccttgattctgaactctgtggaatgctgggatagaacccgaagaaggaaagaattttaaatatgcagatttagaataagcagggatatattaacctgtccaaggtccatgaggatgaggtagagaagaggccaccaggtatgtgggtgaagaggctgtcagtggcctgagacagctgttatagtggatttatggggatgaaataatatggatcacagtagtagtaatcatcaggtttgctgtttttgaatacttactgtgtatcaggcactgtactaaggcctttacataccctggatattaaggaaaaaagattcttaggaaaatggaagcagagaacttgaactgcagcctaaagaagcaaggcaacacttctgggcgacagatgtggacttggcaggggtggactgtggcggtaaggagctataggaaagccagagagtcatctgtggggctgcggtgcgagggactggatcaggagggttgtgaagtctgggaagccagagagaaaagcagttcccacgaggaagaaagggaaatggtggagagccctgttggagggcttcaccttggacgtgaaggaggaaggctgcctctgaggctgaagttccactttctatcccagacaccctcctgaactacaaagagtgggttttggtggaaggcggtgacatttatggaggtgagggagagtctcatctttctgggggctctaaagtttggaaggtggagggatggaaaagacagcttttacaattccttctggctctggaagatgcacattaaattctaatggctgcaacaatccaagatagtgtaggatttaccagtctgcgctgttttcttatttatttatttcttaccataccaatagagtaggggaattctgatgctgcttatgatctggcaccttcatagcaatcatattcttgtcagttagttttaataatgacttgactcttaaataaatagaaatacaaattcttcccttcctgggagtaaatatgatttcatagctatgccctataattcttctcaaaaaaataaaatgttaaaaatccaagggcagcatttcatataagtgtttcataggaagtcagttctccaaatggctttgtcttttttttttttctttttcttttttgagacagggtctcattctgtcacttaggctggagtgcagtggtgtgatcatggctcattgcaggttcaacttcctgatcgaggtatcagctgatccttctgcctcagtctcctgagtagctgggactacaggcatgtgccaccatgcctggctactttttgcatttttttgtagagacaggttttcaccatgttgcccaggctggtcttgaattcctaggctcaagcaatcaacccgccttggcctcctaaagtgctgggattacaggtgtgagtcaccacgcccatcccttttcttctttcatgggaaaatgctaccacatttgtggtgatgagatttttgtactaatcagtgccagatttaaagcctagcatgctatagagaatggaataaacaattctggagtagttttaagtaggagtataattacatttatacacattgttgtgatatgaggtaggatcctttttaattagttgtaagacacgtcataataacctgataggcgttctgaagtgaatctagtattgtgtttgaattttccttcattaggcagtaagatcttgaagaaaaggaatgcactgtgttaccttttcctccacatgtgacctatgctttgctttgcctctaattattgcccattagataaatgtttttagagcaagatatcaaagcaaattgtagaacactggtgatgtcacaagctatctgagcttatccatgcatttgttgattaattcggcatttccgtattgcccattctttaaccctcatctttatgagagagctcagagacctgaatgaaggacagggtcagagagcgtggaggtccttattctgatgctgccattaagactggtgtcctgttttgacctcaaagatttctctgtgaaatgagatatgtgtgtgtatgtgtgcgtttgtgtgaatgtgtttgcacatacacacgtgtgtgcatttaagataattttataacaatttaaaaagctgctctttattaggcatctgttatgagctgggcatcatatacccattatctcatttaatcttatcaacaacactctaagttcatatcacgattcccattttacaggggaggaaacatcagtttccttaaagaggtgagtaactttccaaccaccaaagtggtagagctggtagtcagcgcaaggttggactgactgtacactctctcatccaaatagtctacaggccctttaagtagatcttggtttataataagctccagtctcttttaaacttgtgctttatgttgaatgctgtattagtccattctcactataaagaactatctgagactaagcaatttataaagaaaagaggtttaattgattcacagttccgcaggctgtgcaggaagcatggcttgggaggcttcaggaaacttacaatcatggcagaagacgaaggggaggcaggcatgtcctatatggctggagcaggaggaagagagagcaaagggagggatgctacacacttttaaacaaccatatcttggcctggcgcggtggcttacacctgtaatcccagcactttgggaggccaaggtgggtggatgacctgagatcaggagttcgagaccaacctggccaacatggtgaaaccccatctctacctaaaatacaaaaattagccaggcgtggtggtgtgcacctgtggtcccagctactagggaggctgaggcagaagaattgcttgaacctgggaggcagaggttgcagtgagccgagatcatgccactgcactccagcctaggcatcagagcatgactctctcaaaacaaaaacaaaaacaaaaagccaaacaaacagatttcatgagaactcactcactatcacaagaacagcaagagggaaatctgcccccaccataccccttctcctacactggggattacaattcaacatgagatttgggcagggacataaatccaaaccatatcagacactttccagaattttagcagtcaaaaagcattagatggccaggtgtggtggttcatgctggtaatcccagcagcttggggggccaaggcggatggattgcttgagcccagcagttcgagaccagtctggacaacatggcaaaacccttttgtacaaaaagttacaaaaattagatgggtgtggtggcacacgcctgaagtcccagctacttgggaggctgaggtgggaggatcacctgagcccgggaagtcaaggctgcagtgagccatgattgtgccacagtactccagcctgggaaacagagtgagaccttgtctcagtaagtaaatcattagagttcctggctgcctaacaggaagcatttctgtttcttctccctatgcacattgagcatcagtcctggacctgggatgcttttagatctccatctactatgacttacagattcatccttgtgtttatctacagtctttctcacaatataagttaagcaggtttaactgctgaatctgtgtcaaatcattgcaccaaatcattacattttgcccttcagttcactgataccttcacaaggatgaaagtgtccactcttacagaccagggagctttctcacactttatgcctctgagcagcactgtatgtagcgatcacaagaaacacagtatttaaaaatagtctgttttcacatctggaagggttttcagtgtgctgtgttttaagttggaaagatagtactattgtatctcacccaagtctgaaaggagtgactggagagtagaaagtagatggaaagtatttatttcatcatgtctcttggctggattgagtgaacccctcataaagccaagctggaatgtgtgcttcatattattaataaccaaaatagagtatccagagaagcatgataccctcaaaatgcctggatagcctagaagagccgtagctcttacagccatcgtggggagggattttccaacaagtaagaccacttcatggggtactgtgggactccagaggagagtaatgggccactatccctaaaggtgaagaaagatgggttgctgttatgaaggggacattctcatccattcatttagtcattcattcatctatccatccatccacttgttctcagaattgctgctgaactcctgcatgtatcaggtaacatgccaggtgttggggagagaaagaagaagacgcggccgggttcggtggctcacgcctgtaatcccaccactgtgggaggccgagtcaagcggatcacgatgtcaggagtttgagaccagcctgaccaacatggtgaaaccctgtctctactaaaaatacaaaaattagctgggcgtggtggcaggtgcctgtaatcccagccactcaggaggctgaggcaggagagttgcttgaacctgggaggcggaggttacagtgagctgagatggtgccattgcactccagcctgggcaagagaatgagactccatctcgaaaaaaaaaaaaaaaaagactcaccataagcaagttactcacctcttgtttcttcatcaatagaatgtggcctcagggtgctgagaggattaaatgcagtaattcatgagaaaggctttgaactgtgcttggcacacggtaaatgctcacaaaaggattattattgctgcttctattgctgctactgttctttatattattcagggagctcagattttcaagcagtggttcttaatgggatggggtggggtcaccggggaggggatggttgcctctagggggcatttggcaatgtccggagacatttttggttgttacagctggggaggtgctatagacatctagtgggtagaggccagggttgctgctagacatcctacaatgcacagcatagaccccccctcccacaaagaattatccagttcaacatgctcataggttgagaagcactggaggaagaggcatgtaagccaataattacaatcttttggaatagagctatctgaaagacgtccaaaaaatggagccctagtgaggcaaatagagctcagagaatattttgtggttatttatctccttcagtccccacagctgttctgtgaggataatctttggtgcccacatacaggcgaggaaatgaggcagcaggagctgaaatgatggcttaagttcacctggttagaaatggaggatccagggtttactgccaggcagtctgaccacatatcccaggctctgaaccaccatgcactggaacagaaacacgatatctgggagggattcattgggtaggccatggttggagggtatcccaatggctggcatgtggcccatgggaaaatgctaacaagtttgtggtgacaagaatgttatactaatcagttccagatttgaggcattgaaagtgatcagaatggcttgaactgagaagtatgagagtacgtggaaatgagactgggaagggggtcgtgggagctgggctgaggaggtgcttagaggacctttatgttgtggaatgtcgagtcactgaaagctttaagcgaggcttggaagatggaaattggctgctgaaaaaaccttttagcaatgaggaagttgggttggaggaaggagaaacgggaagaaggaagaccagttagaatgttgcaacatcacaggtgagggatgctgagagatagagaaaaggctatatttaagaaagttgacagagaaaacttgaaaattactcaaacctgactcagcaaagatttctgctatgtgctgcatatccctgcatggcctgtagcccccaggactcgggggttaatctccccacgttaaatcctataccacttaatgagctgagtgaattgggcaaatatcatgttgccccggcctcactgctcttctgtgaaatggagattgcgatcacggtgtctacctgttagacactatggtggtctgaggattaaacaaaagaagctcagtaactttgagctcttgttattgctgctgcttatttgttagggaaggaagaaaaaaagaaaccagaaaactcctaactgatgcgcatcgtggagttctgctgagggaaaagagaagaaggtgtctgaaatgactcttgggcttcaaactctggattttctcatagaaaaattttatttctactgttcaagtgcagagtgcccatcacagaagtcgctcccagagtgctaggctgggctgctcacaccatgatgctctgtctttgtggcttgagctcagggaatcagcacagcaagttgctattccattgagagggtttactgtgggcatctagaatgtcatctttatccttcgtcttactggagactgtcagtctcacatttattaagtagacactagggccggctccactgatctctctccccgctgcttctctggtttgaggcacagtttcagagaacctgagggacccggtgggctcaggcggcctcaaagcagcaggtcacctgaccagtggagtgaccacagattccaaggtgtgaccgagtgaaagggcttatatccccaatgcctgactgcagttaaaccctaatgaggtatgtggatcttctagaggaagggccaggcccctttaataaggacccttctgaacaaagagacaagatgctaatccgaattccactaggaccaagtttgatgtcctagggcaagccgcttaacccgagctggggctcagcagttaagcacatagaggacacaaaagatgcatccgtctctagaatcttacccctgagatgtgagggagtgtgcagatgattgtaaatgggtaacttcctgcagagctggtgtaataataaaatatagctaccacttactgattgtttactttcctctagactctgttctaagtgcttgaatcctctagctcatttaactcttgcaagaagcctacaaagtaggtacttttttttattccttttttttaaaacagggtcttgctctcttacccacactggagtgcagtggtgcaatcatggttcactgtagcctggaactcctaggctcaagcaatcctcctgcctcagcctcctcagaacgtttctgggggtaggttggtccaatcccctcagagtgagcaggttatctcactccctggaaggctggcttctcccctgcctctcttcggtgcttgcctccagcaagttactgaagtcctcagaggcctctccaccgtgaaatggacactgtctgtctgtgggactacaggtggataccaccagacccagctaatttttaattttttttttttttttggtagagacagggtctcactgtgttgctcgtgctggtctgaaactcctggcctcaagcaatcctcccacctcagcctcccaaagtgctgatattacaggtttgaggcaccatgcccagtctgaagtaggttcaatcatcatctcattttatggatgaggaaataaatcccaagaagttaaataacttgtccaagtccagacagccaataagtgattaaacttggatttgagccctgggaagccagactccagagcccacacaactgaacccttgtgccatactgcttacttgcatcaatggtgagtatcccctcactaatatgtagacctcttcataaagcttttactccaaggaaaaggctggagggagaaggaaacatgattcaagaaactgggctgtctggcatggtgctatagcactccacgtggggaatattgtgttttcaaagaaagggtgtgttagaaggggaatgatcatggacgttatatcagatagacttggtccctcaacaccactaaacctaaggcccctcctcatattaaagggatcacagtcctcattaggatgattgtggggagtgagtgaacctagcagagtgcctggcatgtcactggcatcaggaaatgctatttccttctcccacccgtctttcttctctcaagcgaactgagtagacaaagataattatacctggagtacttgcatttctttggcagtagaataaagtaaattaaatgtatttttgaagttgaggtttccatgaacttgatttggcggtcactgtgtcccaagaaagcctttatctttgacgtcctcacatgccgcaattgcttatctccctgttcccagtgcaattgtcttagaagcttctatactgactagtcttggagaaagccataaaacattcctcttttgtgatcctcaaagaataaaatcgtgaggagccttcgctgactgacggggaagtgtagaatgaatgcttcggtttgcagggatgatcattggcagcagtcttttttcaggttatgaattctgatgtttcccagatgtttgaagattttgagtgtcttcaggggagctcgagtggtcccatggctgccatttcttctggtcatagcctcgctgaagggaatagcatttcacgggagtgggtttagggttggatgaggcacccatcgggaaggacatgggatttttcattctaagtgccttgccataaagcaaacgacaggggtctattcctctctctctggagaatgtttctgggggcaggttggtctaatcccctcagagtgagcaggttatctcactccctggtaggctgccttcttccttggctcacttcagtccttgcctccagcaagaggggtctctccaatgcaaaatggtcactgtctgttcatgatagtttttctgtctgaagaaagtcccggggccttcatctgcatggctggggctaggtctggaactgcctggagcatgagccttttggggggtctcttcccacctgctttgtctctctctctctctccccctcaccctgactggtccagtgactctttatgttggtgaacagaaactttaccattggttttcactttatgacgtctatgggcttcccctctctgcccccaagatggcgtctcactctgttgcccagactggagtgcaatggtgagatcttagctcactgcaacctctgcctcctggattcaagtgattctcctgcctcagcctcccaagtagcagggattacaggctacttcaccaccccagctaatttttgtatttttagtagagacagggtgttgccaggttggccagactggtctcaaactcctgacctcaggtgatctgcccacctcagcctcccgaagttttgggattacaggtgtgagccactgtgccggctaaggattttttttttaatcctttccaaatagagtttcagatactttgctcagtactgtgtttgatgagtattatttggcaagatttattattttttcattaaaaaattaaaaatgacctataataattgtatgtatttatgaggtacctcgtgatgtttccatacctacaatgtatgatgatcagatccgggaaattagcatattcatcatctcaaacatttatcatttctttgtgttgggaacgttcaatatcctccttttagctatttgaaactatatactagattattgttaactgtagtccatcctgcagtggtatagaacactagaatttattcctgttatcttgctgtaattatgtcctgtttaacaaatccttccctatcctctgctcccctgactctttccagtcagcattatttattaggcactgattctgtgctggctgggtgctagagagtttacatatattacttagcttcatttgcctctctccattgcaccaagaggcggccactgttgctgccccattttacagagggtaaagttcttgcatctagctagtgaccaaagcaggacttgagtctagctagatctctctgactccagaggccacgctctcttaatcgtactctccttggcttgacacggtgggcttagagagtacataattggatcaagacaaattcctcctgacgaagggaaaacccactcaaacaacatgatgagcaggctcctttgtgacagttagtgcttgccttctaacgcagagctctctctcctgtcctcttcctgtatttgtaacctttctgacatacagagagcctgcatgacaaggctggggtgccagattgttggcctctggcttactgactcattttattggctgtgcgcattgggcctgactctaccatgttttagtggagaaagatttagtctaagatgtgggcagcggcatgtgaggagtgggtattgtgctgtggtcctgggtatgaacctttgatgttgtcatggcaaccaaagctgctattctgcagatgagaggactagatattatgaactgtcaaactgttctctccataaccaaggagatgttggtaatctccttggtaatttgcatgacccataaacatttcccaaggctgtggctctgcccttctgccaagacccgagtcactcacttgctcactcacttactcatttgctcactcacttattcattctttcattcaacaaacttgttgattgcctactgtgctagatgctgggatgtaatggtgaataaaagacagacatggtccctgccttcttggagcttataactaggatgaccaaatgtcccaggttttgtggttctggagtaattgttaatagtgcccctttctctctcagaagtgtcctggggctgggcgtggtggctcatgtctataatctcagcactttgggaggctgaggcaggcggatcacttgagctcaggagtttgagaccagcctgggcaacatggcaaaaccccatctatattaaaaaaaaagtgtcttggtttgaaatataaaatatatagtgaccctacttatagacagtgggagagccaaaccttatgcatgttattacacaaataattgtaactaaaagccagatgaaagttgcaaaggagagggagctagagctatgggacacccaaataggagaactgatttagtaggacaaagattccaggcagagagggctgagtcaaggccctggatgggaggaagcaacatgccatggctgaggacttgagagaagtgagcaaatgtggccaaagggcatttagcaaagggaacttagaaagcaatttggctggagacaggcaggagccaaaccacgcaggtgctgattctgaattttatcttaagagcactgtgaagcttacagttatgttttcagtagcagagtgatataatctggtcaatcagtacattgccattttggttcttcgtataaacccaaagggttttaagttatttgttcattaattcaataactaaacatttatggagtggcaactgtggcactctgctaagtgttttgctctggagttctgaactcaattgtcctcagtggtgccaaaactcaactcttgggggaagcctttatgggccctttatgttgggtcgtgtcctgcttggcaccatttgccccccatttgctagactctcttggatgacctttacttttctctgtcctctttccatgactgtgagctctttgaagttgaatctatgtcttttatcaatatatcccttctgcctggcacagtggctggccaatagaaaatgctaaaggcttgaggaatgaaggaatggtgctttttgtgtctgttctttttttttttttttttttttgagacagagtcttgctctgtctcccaggctggagtgccttggcatgatctcagctcactgcaacctccacctccgcgattcttctgcctcggcctccctagtagctgggactacaggtgtgcaccaccacgcccagctaatttttgtatttttagtagagacggggtttcatcatattggccaggctggtcttgaactcttgaccttgtgatctgcccacctcggcctcccaaagtgctgggattacaggcatgagccactgtgcccagcctttgtatctgtttgaagaccaagagcccttcatttagaactttcacagaaggaaagcaaaaaattcttttgtttctgttttacaagtcttttctttttggtctggttgtcaatagtacttctctggatccgcctcctgtattcaagtgatttttctgtctcagcctcctgagaagctgggactacaggggtgtgccaccacacccagctaagacaaaaactcaccttgttgtcttctttatgcatgagcagattcccttggtatctatagccgtcgaagctttacgtatttccctatttagggacataagaatttttaggaaagcagcgtgttggaaagcacggcacctgagatgttcatggaaatccttgttgtgacttcagagtgcagatctagagcagccctctgtttgtctgccctgggccatcccctatttcaagcagtctttagtccaggaagtttaggtagcagctcaggcagcaggtgagctctggagagtgcaggttcgggttctttgagcccaggggcacaactctgagttgaagtgactcctcctggctgttgctttgaatttagaagagctgccctttcaccagcaaggcagtcacgcaaaagatgcttcaatgtgtgcaagatcaggcctgcagcccccagcctgtgtctacaggcctccgagtcattattattactgtttctatccctggggttattgatttcatcactgtttagtgaaggagatctaaagcttttaagccagaaattaaagaggtaatggaaattggcatgccactggaaaatgaatttgcaaatgagaattcaatgttctaaaaaaactcccataaaaataaaaccaaaacccagaagtgaatgctcctgtgactgcatttttttccaaatgtgcatgggtttgttctcctttagagtgtggctgtatacattatggaataatgagattttgatggtgtctcgttcctacaattgctcttattacttatcacaatacaatgtattcatttatataactaatatttacttagtacctataatgaagcaggtgctatgtttggctctagcgattaaaaaacaataaaaaatgcaagatgcctccaccctgtcctcagggagcttgaggttcagtattaattatatcgctagccaattctggcatggtgcttactgtggacaggaactgctctaaatgcttcacgtgtagtaactcatttaaattttacattgatcctatgaagtggggtaagcaacagaggaacagagaagttaaataacttgcccaagctgaagtgagaggtggaactgtgatccggccaaggcagtccggctctagaatccatggtttttagccatgatgctctactctagtggatagttacagcccagtagctattggttactagattggttctagaagacaaggaagcactcaggtccttagtcacagagcaggagtctctgactcaacctatgggacccccaagaggaccttcattcacctgtgagtcaactgcagtgagtcgtgattacctcctggttgtcctttagagtggcagggctttgtgtcttaacataaggtgttgaagctgggtcacccttttcgatctaaaaccaatgtccatgggttatcattcaggtctgcaattaagagtagcttgtcactttatattgggaacatttatttttccttccttctctatggaaatgggcagaagagatgaaaagcctgctggtgcagcttaactttcctcagtaagtgagtgtttaaccttttgtttttttaaaaatggagatgagacatacaaattatgacttctctatgttgtccttttttttagttggaagaaggtgacatgacagatgagctttagaaaaatgtttagaaggtgaacagagaactattcgtggaagatagaaggctagagttaaaagagaggacttttaaccagtctcagctctgacacttcctaactactataacctcacaggattttgtgaggactaaataggataataaggcggagtctgccacattgcaagtgctggcagctatgattaattttaggagtattctagaactttccctgaagtttctagcattgtctgcacttccttgtttctccccttatcaaactatgctcagggagatttggtgactcattcttaaggaggcacagaaaatgattttttttttttttggcacagaatcttgttctgtaaagggcagtcttgctctgtggaggctggagtaaagtagcacgatcatggcttactgcagcctctgcttcctgggctccaacgatcctcccacctgaacctcccgagtggctaggactacaggcatgcaccaccatacctgtgtaatttttgtattttttgtagagatgggattttgccatgttgcccaggctggccttgaactcctgcgctcaagcaatcctcctgtctcagcctcccaaagtatggggattattggcatgaactaccatgcccagctggaaatgaaatcttaatttgtgattaatattgatcactcaaaagcaacaaagagccctaaggtaaatagctacaataaaagcaagatagcagaagcctctctttttcatgatgttattaatcatctaaatattaaatttcaggctctgttcaatgcaatggcaatggaaggaatagtaaccttccatttagtgcacagtgtaatgaatcagaattcttgtagctgcttttgtagtccagtacagttttttaaaaatagaaattggatagacccatttttaatgggaatgatctcaagtgcagagagagcaaggcatatatcagacactctcctcaggaccagggcaatttttcaacatcagttggcaaatttgttattctgcctgtagagtgtaagtccaaactgagatgaaagagtgacagcttgttagtctgaaagtttattgatcatatcaaagtatacacatctatccctgattccttagtggacttgatactttcctcgtggtttaaaatttgtcttatttcatccttccatgtagtcaaagagagacagaggaaatgcattttccatcataaggcacaatttggaagctacaagagtgcccccaaatatggcctggtctcataagataatatttagatagattagtcgttagtgaatacccaaggggctaatgaattgagtctcagaaatccccattgtaagggattaacttgtagtagcaaggaaagctagcgtgtctaagaccatacgccatgagcaagcatgctagcccatcctgggtttctctctcctcttctccaaacagattctccacttgccctgtcctttctgccagtggccttcactttagatttataactaggctgtaaagttctaatgaaaacttgctgcctggctccctgaggacctgaggaaaggctaatatttgcacataactgggtacttagggcagtaggaaaatacacgtcattgtaatatccaccacagcactgaaggtgcctctttctttacctttttatggtctggtctgctttttatgagggactctgaggtggtgtggcagttaggaaggccacttgattggggtgtgtccactcaggtcagcccaggcttgactgccatattggctgtgtctgggtgggaggtaaaggcacacgtgcgtcagcctgcattctcttcccttcgtcctattgcaggtagctgggtgtcccaggctgggtgtgagccagcctgcccttcccagatgtgggaagctgtgcgtctgagatagagaaaaaagaactcaaggtagagagaagcgcctttgcagagttcaggatggtgaacttcctgttgacaattctaagagcattgtttgctagctttgctgcgcaccagatgtgtactgtacacacagcactttaccattctcagtgtcatgagtcccttgggggcagcagtgttgcccactgtactaggtcctcaccagggctgagttaatctgtactctaggaagtgctccgaaagggttcctgttactaatactcctgaataagaaatgacaaggcacagtgcctgaagtcttatgttcatttttagacaactctgacaacaaccttgtatggaaggtattagtcctcattttatagatgaggaaatcaaggttcagagaagctgaacagcttgcaaggctgaatggttaccgctttatccaagaactttccctgttgcaagagtaatgtatgaggtgctcccactgtcttcctctgcactgaatccaagacatctctgaatcagccacaaaagtgcctcactgggtgtggccccagaaatcctctctgagaccctcccatggttgtttgaaatattgtgaactcaccttgcccttggaagattcacttgtgtggctgtggaatatttatatgtgaaatacttctgaagcaggtgaaagaaaaagtaattgtggcaagcaaattaaatattgtctttccacttcaaacccgaggctcttcggccataaatgtgtgaggaggtggagagatgttgctgccctgctgctggggttttgaatcattaggggcatttttgagtagtaatgaatgtggtctgccagttgcctttctcacagagtttgtggctttcctcccaactgctaatggctggaataggctccctttttttttttttttttttttttctgagacggagtctcgctctgtcccccaggctggagtgcagtggcgcgatctgggctcaccgcaagctcagcctccctggttcatgccattctcctgcctcagcctcccgagtagctgggactacaggcgcccgccaccatcctggctaacacggtgaaaccccgtctctactaaaaataggctcacttttaatacattttagaaaccactttccacattcatgccctcatcctgcctcaatccctggctaaatctccaattcataatccctttgctgactgtgccgttcagggagtaagaacgtggtggacgcagccaccattgtaccctcagatgaagtcctttctcgagagacaaacagtctgttagtaaaatgaccatacatcctgggttgcacctgtcctgtggtcccagcatagctgttaacagagctacctttttatttgcaagttccctgctttggacaatagatcaactggtcatccagctattagcgtccatgcataaagcacgaatctgttgtattcttcagccaatctgagacaaccaagagattactgctgcacctttgtttgtctttctttttggtggcacataaggaaacagagaaacagatgatctcaccgagtgcacagatcataggagaaaagccacagacagttagtggtcccctgtgggtcatcattcatcccagtgcagcactaacgctcatgatggtatcgcacgctgtctggagcagtgattcatgtagctggcgttgcctgatgggaggaaactggtggggaaaacgtggtggggggtcctgtgaggggtccagttacctcctcctcctctctttctaagcgcatcagctacagacccgcctcactttgtgagaggttgcagtttctctcttctgcctgtcaggtagtcctaatgcatggtgtgggggagggaggacaagggagaaagaggggcacagaatcttttagatcctgccctctttcaagtcagctctccacctctttttaaaagaaacaaatcattattattttgttgtttttgttgagttgcttttgtgtttgtctaattttagaaagaagtaaaatgttttcctctcacacctctgggaagataatatatctaaatttattagtttagtttgttcatttatttattgttaacttaaaacattcactcccgtgccatttactgggtagctgagtgggtgctggaaatgccagcttagaggctaaaaaggaaattcaaggaggaatggaattaaaatgtaaagtaatgccctcttatctacagtatcccctcgtatctaattatctgtctacctctattgaattatctgcctgtgtgaattttttgatccttgtaagatctctctgaacttgataatggttgaacttgtaagtgaacaaatgatgctcactgagtctgaaattattaaataacattggttgaacctctaccctgtaacatcttttgagctaaactgttccgagctcagttgtgccatttcatcatctgtgtgctcatacattctaatgggctgccctccattcacttctgcagcctgaatgcaggtaattttttctttttttttttgagacagagtctcactctgttgcccaggctggagtgcagtagcgcgatctcggctcactgcaagctccacctcccaggttcacgccattctcctgcctcagcctcccgagtagctgggactacagcgcccgccaccacgcctggctaatatttttgtatttttagtagagatggggtttcaccatgttaggcaggatggcctcaaactcctgaccttgtgatccacctgccttggcctcccaaagtgctgggattacaggcatgagccaccgtgcccggctgagaaaaatcttaaaagcaaatgcatttaattttaaaatgttttacttgagctcaaacaattaagatcatttgaaaatacttcgaaaattaataaaaattagaactgtaaactcaattagaattattattattgagttaaaaatgatgttgccaattcaaatggtaacgtcagttataacccgagtttgctgattcatttgaattctggttgtttgccagagtttttcagagtcataagatccagatagaaaatcaaacctcattctcagcattggggctttctaaagccttgtcagaaatttggtgactcgtgggagagcttatttttctccttttcattgagtcttgctctcaaggagttagttcagatcatcagtggccctactttgcccataacaagccttatgtataatttccacaaaactgcttccccagggcatttgggtgcattggccattttactgaagatttggcagggagagaggaattgacgtcacagatagaacccagctgaaattggatactagatggagttgctcttcaaagacttgggcattgccgctacggagcctgaatttcccacctgtcagttgacacccctttttgtcgctttatttcttcttgtcctcctttttcagggcttttcccttttctctgatccttccctcttagggtataaaaatcaaccttttcctactttaattaatttattctttaattttattttaacacagagcgactcatctctaatcagcttcaacagccaagtgaagtttggtgtctccatttgcatgttcaaggaagtagtctaattagaaatgatctctcgtgaggtctcttctgcctaaattctgggacaatggctatcctccttcctcatctgtctggaggtgaagatgggagtaggggaggcaacatgcattctaggtaccaaaggtagaggaaaggcaaaaccatccgctttgggccagacagggttgaatcctggcctcttcacttcctggctgggtgacctaggacaagttaattaagtttcctgagcctgtttccccatctctaaggtgggggataatactactttcttgcaagttatggaaaggatagaatggaatcacacacaagttgtagaaaggataaaacagaatgacgcttctagtgcacctggcgaaaggcaggcacttaacaactgttagttcccttttcctttcaactgataaacactttccttgagggttacataggtaaacattaaatatttatgaattgcataattcaagaaaaatgaaacttgaaaaggattcttcagattttttgatgaaacaaatcatcgtccccattgtcttttgtgcaaatctgtgtttttgtttgcagtgctgggtttgcttatgacatttgtgtgcaattctcagcaccgtgagacttgagtgagcctaacctctcttcacagcttgataggagttgtaaatattaggtactgatggtatgatttgaggcaacctaagtgactgaagcctagagccctccctgcggtattatttccaagtgggctcatcagagctgaattgataatgaagatataaacactggtgaaggctttgtggcttggtctgatggtactcatacggcacagtgaaaatggagatgctaccggtggaaaggactcaccatctgtctgccctctagagcagagcagaacatacctctgatgattatgtgaccactgtcaattaggctgatttatgcaaagacagtctgtacacatcccatgcagccagattttaaattctagggtgccaggttttgctagaaacagtggccggctgcggtcttgcataatattccatgttctcttagaggcagaaaagaatagactcacgacttgacagaaggtgcttttttcccctgtatcatccagtcaattgtctatgagtctgccaaatctagctcgcagcatctttttgtacaacccctgagctgaaaatggtttttgcatatttaaaagattatttaaaaaaagaaaaatatacaacagagaaccatatgtggcccaccagggctaaaatatttactatctgaccctttatggaaaaagttgttgatccctggttcagagtgtttgaaataactcagatgaaagaaggcaaaatgtaatgatgattgacttttccagttgtaatctgatttgtgacaaccactgtatgcctgttttaacaaagcttaatgggcattacttaggataaatgtaattacgtttcaatatttgtgtcttgctctccctacatagggttattccaggtttgcccaaggaacagagagtctgtttgttgttctagaagtagctcctgtgtctgtcacctcctctccaaggcttccacctgtcgcttttttatcccagttcacccgtgtgaacagcatgtgtttcggctgccatgacagcacgtcctacctttttccctggcttgaaagaagatggcaggggccagctcaggaagaactgctacggagttttttcaccttctcctgctcgtgatgaggctagggagggatttttagcgtatctttaattgttgccgaagtatgaactcggggaagggggcaactgtgaagcagtgatgcatagactaagtctcctggaagaagcagggcttgaattagacccagaaggatgggcaccgtttgtgggagggcacaggtacataagtacagggaacatgtcatggagtgtcctgcccagagtggggaatttatagcagtgtgagatgaaaatgggtcatcattgtggccagtttgttggaaattttaaggtgtatggaattccaattcagttatcatcaaggagtcattgtagcttatttttaaaaagagcgatgtgtgtgtgtgtggtgtgggggtgggggagagtggaatgacaatcatgaaattggctactgtttggtaaaccctaactgggagccagacatttggctaagggtgttacttggaccatctcatttaatcctcacaacaaccctgtggggaaggtattatctctagtttgcaaatgaggaaactaggctcagagaggttcaaacaacttgcccaaggttctgaagttaataacggccacagccaggatggctcttaactcctgccctgtggaaacaagctcaacgtaaaacattcttacaagacagaaaagagtgaaaaagcaaccaaaatcctgccttgcggaaatgcccactttgggtgaacattcttctagacattttttgtgtgtgtatatgcacagaaacttgtaacattttgcataatctgggccaccccatgcctgcaagctttctataaatgtcaccatattctataccctagcgtttcccccctatttaacactaattttctgattttcacaactgggtgcatagtattttgctttgggatgctaccatcatccacttaaccagttctctctagatcactgcaggttcttgagtaggggaataatgtattggaaccttttttttttttgaagaaaaaaaaaataaacaacttttaaactgagtcttatgctttttccctttctttgcagcatgctcttgatgctgacaatgcgggagtcagtccaataggaaactcttccaacaacagcagccactgggacctcggcagtgcctttttctttgctggaactgtcattacgaccataggtacccgtttgtttgctaatatctcttcctctgcaggtcatcttgagtaagggcgcttagtcagtgttttgtcctcatagcatacactatagtttgaggttcagaggaggcttacgaaacactgtcgtttaaattaatgcagtcattgtggtggctttcaacaaaagccaaagcataatgaagtatctctttttccagaatgaaaggctagcaaacctaatgaaaaggttagaatggaaaatatgagttggtcggttgaactcgggttactcatttgagctcaacttccattttaaaaattgtacttcttattaaagttatatagtaaggaaccaaaatattctacaaaattttttataaaaaacagtaacattctgaccgtctcaccttttcttaccttcccagagactgttgctttcatctgttttgattgttgattttaacactcatccccatgtctttaaatatcatgcttgtgctacttctggaattttcagttttggggattttttttgactttccattgtggaagatgaggagttagttccttcttcctgcctgcctcatcacagaagggctcttttcctgtcctcctgtcttcccaatatttaattagatagaagtgaaacatctgcatgattttgactagataaatgctttctgcagctgatcatagagtgaacagtgatgacctctttcctgtatcagtctttgtcttattttttgtatgtgtgtcttttttttctgacacttggtgagttttgtatttttgtcttaggggttaactttatttatttatttattttattttattttattttattttattttattttattttttgagatggagtttcactcttatcacccaggctggagtgcagtggtgcaatctcggctcactgcaacctccgcctcacgggttcaagtgattctcttgcctcattctcctgagtagctgggattacaggcgcccaccaccatgcctagctaatttttgtatttttagtagagatggggtttcaccacattggccaggctggtctcaaactcctgacctcaggtgatctgcccgcctcagcctcccaaagtgttgggattaccggcgtgagccaccgcacctggcctaggggttaactttataagtataatggcatataataattttagtgttctattcgttaaccagcatgtattcgatccctataacgggtgatgatatctcttttctctctttttccaacacaaagttttggtggacatcatcttttaaatgattaaatttgcttatgtttctcttatatgatttgccagctttaaatgataactcttggcactcagctattacatataaggcagtcagtgaacttagcatctcaatttcctttccctcttccactatccactcttattcatggtgtcattctatataagttgtatctcactttattgtgctttgctttattgtgctttgaagatgttgagttttttttttttaaacaaatttaaggtgtatggcaatcccgcattgaacaagtctattggtgccatttttccaacgtcgtgtgctccactctgtgtctctgccacattttggtaattttcacaatagtttcaacctttttcatttttgattatatctgttaaggagatctgtggtcagtgatctttgatgtcatgattgtcattgttttggggtgccacaaaccatgccctttgaagatggtgaacctaatcaataaatgccgtgtgttctgactgttccaccagctggccattcaggcatcccagatccctgaggcacaatggtattgaaatttggccaattaataaccctgcagtggcttctcagtgttcaagtgaaaggaagagtcagttgcatgtctctcattttaaatgtaaatctagaaataattaagattggtgaggaaggcattttgaactctgaaacaggccaacagctaagtctcttctgccaaacagttagcaaagttgtgagtgcaaaggaaattttgtgttttattttttttgagacaggatctctctgtgtcacccacgcaggagtgcagtggtgtgatcatggttcactgcagccttgattcctgggctcaagggatcctcccacctcagccccctaagtagctcagactactagtgtgcatcaccattcctggctaattttttaaacatttttttctagagatggggtttcactatgttacccaggctggtcttgaacttctgggcccaagtgatccacccaccttggcctcccaaagtgctggaattacaggcatgagccactgttcctggccaggaaaaattcctgaaagaaattaaaagtgatactccagtgagtgagcacatgaatgataagaaagtgaaccagccttattgctgatatggagaaaattgtagtggtctggatagaagatcaaaccagccacaacattcccttaagccaaaatctaattcagagcaagcgggctcttttcagttctataaaggctaagagaggtaaggaggcttcagaagaaaagtttgaagctagcagaggttggtttatgacatttaaggtaagaagaccttttgataacataaaagtgcaggttaaagtggcaagtgctagtggagaagctacagcaaattatccagaaggtctagctaagaaagtggctacactaaacaacagattttcattatagacaaaacagccttatattacaagatgccatctaggactttcatagttacagaagagaagtcaatgcctggcttcaaagcttcaaatgataggctgactcttttgttaggggctatgcagctggtgactttatgttgaagccagtgctcatttaccatccagaaaatcctaaggcccttaaggattctgcttgccttctataaatggaacttcaaagcctggatgacagcacatctgtttacagcatggtttactgaagagtttaacctcactgttgagatctactactcagaaaaaagattcctttcaaaatagttctgttcactgacaatgcacctagtcacccgagagctctgatggaaaggtgcaaggagataaatgttgttttcatgcttgctaataccacatccattcttcagcccatggatggagtaattttgactttgaactcttattatttaagaaatacatttcataaggctgtagctgccatacataatgattcctctgatgagtctgagcaaagtgatttgaacatcttctggaaaggagtcatcattgtagatgccattaagaacatttgtgatgaattggaagaggtcaaaataccaacattaacaagagtttggaagaagttgattccaaggctcatggatgactttgagagcttcaagacttcactagaggatgccactgctgatgtgttggaattagaagtagagtgtgaagatgtgactgaaatgctgcatctcatgataaaacttgaatgaattaggagcttcttcttatggatgaacaaagaaagtgatttcttgagatggaatctgctcctgcctggtaaagatgctgtgaacattgttgaaatgacaacaaagaattcagaatattatatcaacttagttgataaagcagtggcagggtttgagaagattgattccaatttgaaaaaagttctactgtaggtaaaatgctatctaacagcattgcatgttacagagaaattgtgaaaggaagagtcaatggatgtggccaacttctttgttgtcttatttcaagaaattgtcacagccaccccagccttcaacagtcaccgccctgatcagtcagtagtcatcaacatcaaaggaagaccctccgccagcgaaagcattatgacttgttgaaaactcagattattattagaatttttggtaataaagtattttcaagttaaggagtatatatacattttttagacctaatgctattgtacactcaatagactgtagtagagtgtaaacataacttttatatgcactgggaaacaaaaaagaaaatgtgtgactcattttattgtggtggtctgaagtctaactcacaatgtctctgacgtatgcctgtataacctcagggtatgtaatttagattttaatttgttaccctgatatttgcatttgttttagtcgtagctctatagttagatatcattaatgttcatctctagtccttttgctgtggtttatctcatgatcacttacttggctgaaagtcatcttcaagtagttgccttaagaatggctcaggggagcaatattctgtgagatcttgcattgttcacagttgtagcttaacatttgaaggatagttgaaacaaaatgaaatccattttattgactcacattttctttttcttttttttttttgagactgggtcttgctctgttgtccaggctggagtacagtggtatgaacatagctcactgcagtctccaactcctgggcccaagtgatcttttggcttcagcctcctgagtagctgggactacaggcgcataccaccagggctagctaatttttaaaatattttgtagaagccaggtcttgctgtgttgcccagactggtctcagactcctggcctcaaaggatcctcctaccttggcctcccagagtgctaggattacatgtgtgagccaccacgcctggctttacattttctttttaactggtctcacaggtgttgctcttctgtttcccagtttttatgcagctgttgggggaaacctgatgccagcctttttttccccacttttataggtgactttatctttttgttcagtgacttaaaatattatttctctttcatctgataacattactaggttttgactcttttattgcattaaagttttcttgattgacatctttaaacattttctttgctgtgtggttttggttttgttctttgggagattacagctatacatatattgtaacttctttgctcatcttctatgtctctcatttctcttctactttttaactcttaaaatctagttttcattttgttaattttattctccctattcctttagtttgtatgttttccacaatgcctgtgctgccatgagctccttccaattttattttttgtttttgtgatcaatagggaattttttccttttcctgtttctttcctgaatttcatagctcacatttcatcttcacttgttgttccatttttccactgatttcttgaatttctactttttggcttctctgtgaagattcttagagatgattatttcatacttggtcacaatttttgtctgattttggaaacatttttctggtgagcctctttccatccattggtaagttttgctactcttttcacattttttttcttatggaagttttatatttatgctgggtcaacttctttttaaaatacctggccccaggcaaactggatattcctggaccagctttctgccaaatgatttcatggagttggggagaggagagcagggtgagtcagggtaccaccttccagacagcacatcctaactctcttcatttctgtgacagagtgtttctgcaaatagggtccttctgtattatttctgtcctacctccctgttttctgaaccagatcaagttcagggtggcttctgctgctctccctctttatcctatgtttcatgcttggtaaaaacagggacatctcttttgaagttcagagtgagaccctcccctttatacttggatattttcggatactttctgaaatttaccactttagggccctgtcatcattttctgagcttcttctttttattttttgttcatatggcttctgtccaatctccgcttcttttggtagttcttacacatatgctggaatctctggattatatccttcttccagctctgctgaaaatgagtttgaggattttctgcccacatacaattgtgaagtagcactgcaacaaaaatcttcattcagaagcaggagagacacccagcagtcactggtccacagcaatgagggacaggcattgagaggctcccccgccctcctggtgggggaaattccttcattcaaacttgtttatactctctaggaggaactccctgccttattgctctctgaagcccagctatgccttttgagaggttctttcctctgaggcacagttttgacaatcaacttcctataggcgcaaatttcagaggctaacgattggtttagcggcacaggtttttgcttttgttttaagatctagccttcaggacctatgttgtttctaggtgaaatccagaaagtcatatgcaacaagaacattttggatgaaggaaaattgccattgttatttagaaacactcttaatctaattatatgacatgctaggtttacacttgcaaatctgcaaatatattggtgttagctattaaaagtattcaagatgcccatgacaccagtgggtctggggcttagaagccttttctggcactctaggccaggttaggtcagcttaatccacagactcacagcgtccaacaaaggaagctgggtggcctgacaccatttagtatacgggcaaaaagtgttagcaacctgaacaacaccagagggcgttgctgtagtggatccaagaagaccaatgtcaggtttcattgtgttcagcagattgttaacctgggaaaaagtgtcacgcattgtaggaggatctattgtacaccaattaaaattgagaaagtctgggccacttcaagaagtacattttggaaaatgctctctgatacccggtattggattcatgagacattagtgtgtatattgaaggaaactcctaattttcttgtttcatgacatggctaaatgaatgatctgtctgctgcattgaaaaacactatggctacattggaaggtgcattaatggtatttattgtgttagcttgttaggaatccaggaacttggtttattgaacaactatgtttattgatccacataatattatgtgactgaggaatggtggctccatctgcctaatgaagaacgtttgatatgcgatggtttttgcccttttttgtgtgtgtgcttacaccggaatctttgagtttgagcaaatggctcttagcccttggattctgttgcctggattccattcacttactcacccatgtcctcattgtcatatccccagtggttcccttccccatgctttgtccccaggcctcaggtgaacaatcaccttgtctagactaagaaatccagtgcttggccacaattattagttcaaagatggacatatgatctggattaggggcttttgccggagctttggaggaaatgacctctctttcttactaaaggtaagtctggaaagagacaggcctaaggcactgccagtcatttttttccccttgggttgttctgcctagaattcatcaaacactaaagaagcagagtgaagaaaaggagtggtgaatggggtcttgtttacatcatttgagctctggatggtgctacccaggaagtgttaagaaataaatgttaaacccccttctatttactggggtcaatatattttctttcgttgtttaagcgagtgtgcgttgagctttctattacctgcaagtgagaacatcccaatacatgctttgggtcagagctcatgcagggccagtgaatatcctctgacctccacagctagtgactgagcctgctggctgctgcagctgccatctgtcatcatctttgagccactgactcttgatttaaagtcttaggcagagccatcctatttgttcatgtgcacacatcctggctgcctaggagctgtttcctctgtggtgggaggcaggacactgtgtcataccaattatgcacaggaaggggggctttcccaaaaatcagaaggaaggtggatgctgaacaggaaactactgcaaaacaaatgtgcatcaaaaccaaaagtaaaatgcaaagtccacttcagtatcattgtacagtgttaacactagagatagggtccttgttctatttaatttagaaaacacaattttctctctcactctttctttcttttaattgaaaaataatgtattgtaagttgagcaccatttagctggctaaattttaactccagagtggaggatctttatagagtcatacagttagagaattccaaagaagcccttaatacaatgtaagtaagaataatgaggtgcagaaataattgtttttccagttacttagtggtaaattcatttgttgcatgtggtcgcaaggtttataagaaaactcagagcccagcaattcttccagttcttcctgagcaattttccactagttaggagtcaggaaagaggaaccgtgagagctgaggagctgtgtatttcattaattgtgaaatacacaaatattggcctgttcccttgcgatcataaaatttgcaacgtaatattgcagacatttttgcatattactaaagttctttgaaaagtgtattctttgatggtttctattggatccactattcacactataatcacatattcctgggaacttaagctgtttctattttagtaatagtgtaacaccatggtgttaacgttgtgaagtgtggtcttcatctctggttgttgccttggaaaggttaccaagggtttgctctgtcaaaggaaatgaaaggcttgccaaatttctttccagaaaggctctcatgagcagcttaaggttatgtacttttcagacataaaaaatgtgtttattaggtagaatgtgtatagacacactttgtgaataatagaatcttttctgaaaagcagcgctactccttagtatcagagatcccttttatctgaggatatcaaagcacttctttttgaagaaggtttttcttgtgctgagatatatggaaagatttacaagtgtatagcaaacggaataccttcaggcacttctccagaccagtagccacgccagaaggaagagcagactctgctctgtcaatgacagggctgcactgcaccctagtccctttctcagtaactaattcaacgtgagaaagtcccacctgcctttgattattggctcagctggtgggtcccccgtaactagcttttctaagctggatgaatgatgctcacttctatgtgcagatgctttttcacaagctgtcatttgtagaaggacagcgagcgatcaggttcttaccaatatctgtgaaatgcgattagattttagtctgtgaggcattttcagattgagccacctgactctgcccacatcagagagagagcctctggtcaggaccaggtggtagccagtcactgcgtcactagcctggcagcctcatttaagggttgtccctatcaaactatcgaggcacctgttggtacttacccagcactggattggatgtttattttttatttttatttttatttttcagagaaggggtattgctttgttgcctgggctggagtgcagtggtgtgatcatagcttactgtaacctcaaactcctagctcaaatggtcctcgcgcctcagccaaccaagtagctggaactatagttgtgcaccaccatgccgggctaattaaaaaaattttttttttgtagagacaagggctcacaatattgttcaggctggtctcaaattcctggcctcaagtgatcctcccaccttggcctcccaaagtgctgagattatgagtgtgagccccacttgatttagatgggatgtttaacctgtgcctttgaaaagagcaatcaccatggctaacatttactgagttcttactagttaacgtgcattgtgctccacatacattatctcatttaatcctgcataaccacatgaggtgggtactgttattagcctcattttatctatgagaagactgaggcccagagaagttaaataacttgcccggtatttcatagttagtaagcagtggagtccagctagattcaccaggaccagctacataatttgtggcacccagtacaaattgaagtggggtcccttagagcattaaaccaagcacaggacccatctaagcgtgggccctgtgggactgcacagggtgcacatccataaagcagccctgcctgcgcagacagactggtgaccataataagaaagcacactctcaactaaacaagtagggctgcacaacacacagttgggccaagatttgactttggcacgtaaacagcaagtggaagcctttgtgtgcactcctcaggcacaagtcctctttaaatgccagctttctcttcctgaaaaacggggaactcttttctagccagaggtgaacagatctgagctcatcctggtgctgtgcgttcattacagcctccccttggctgtttgcccttgtggagttggttgtcttctgctgaaagtcaccacctgatgctgtgggtgctatgggagaacagtgaagtttctggagggaagataggaatcaaccgcctgttttctcctgggactgagttttcctggagacatattgctcagaaacaattccttcccacagtaaagcacaaggcaaacggggtgcttagtttgcatcatatttcacaggtatttaatcttcacatgtaactcttgctttgcatgtaactcatttaatctttaatagctatgggtaggcactttaatagccttgtcttttgatgaagaaagtgagggagagagattaagaatgtgcctatgacctgagagttggtaaatagaagaatcagaacagaaatctgtgtagtctctagttctagagcctacagacaactgtcacaccttacttcaaagttctacccaagcattctagaaggatgagcagggcagtcagagaggcggggtgtaactagatccccaaatccagaaatgtggtcttcccattgcctcagagcaaagctccaaagtgtaagtgctggaattttcccagagtgacagtgttgagggtcaaacagtctctccttatagttcaccaaaggcatggagcacaaatacactcacacacacgcccatgcatgagatacagcatcactcaagaatgatgactttctgtccactgggcagtgtgtcaccaaagaaagatggctgtgaatatatttaaaggcttgtttgagtattgcatcactcatgctcttacccaagaacttagctttaatattatttttgtgttctagtcaacaaaacactgaacaaataaggaaccaattgtgataatataataataataatactttgcattggtacagtactttacagtccattgatttttttctccctgcattttccttgagtacctctgacactaggatttgcagatgttaagtgggtctaaggagaaccaggtagtgtgaggtggaatttgatccagatctttcatctcctcacttctccctgatgctccgtggtaagccacagtgccttacccaggaggtgggtgggggtggtcatctctgaaagctggaggaagggggtgtagcacttgtcaggattaatgagatgcctgttcatccagttccaagcctccacttgtttgcctatgtctgcaatatatttctttctgagacacttggacaacctatattccccaaagttaggctattgtgagacagtcaagctggggtcttcagtgttttcacaagttacttgaatgtttccaagagtcaccataaacctgcataaagtgaaactgtagaggctcatttatttccttttcaatagggctagcttaatgtcagctcgaccattctagaggggtattcttggaaaaatgattttgtccaagttcctgaaagtacctgaaaaaagttctgagagcttttttgcatatttaaatcaaaatcctggtgagtaaaggaaatacaagatgaggaagcctagcctgaacactcattttagaaatggaagctgtaatttagattattataagaggtttgaatgattcagaacagaagattgcaaaagaaagtatccaggtgactcattcccgaaggcagaaggcaaccgtgagttctgcaggcctgtgggtggctgaatgatggactaaccatcaacgtttttttatcatgttgcattcccaacctgtcaataaccatggacccaataactcactcattgaatggattcagaaacaggccccacatgatttacccagatttgggagaatggttagattactgtctagatactttttaacataagattgtaatatcaattggcacaaaaatgaatattaattaatttagactttcatctccatataaagtgtgctaatgctataggactttttcttccagcaatactttctttagcctcatccatatagggtaagcccagtactcattgtacataagttacttatgtaatggcagtactcttaagattgctgcgggtattttcaaagcactatttgaaatacatattagtagacctgactataaaaagattctcttgtattcaaacatccatcaataaacttttagcatcttattaccctcaatgcaagaggtagttgggcggagaggtaggactcagagatgatgtggagttcccagtaaagagaaaaaaaaaccagatggggcgaaacttcactggcggtggggagagacagcacaaagccttcccttccctattctttcctgtttttagacttcccagggtaaggctgtacaattcatgagtcctttctaaccttgtactagaccacatttcctctttaatatggggtacccattacccttcaagacagccacagtcggtccaggtggagcccatgggtaagactgtgaaaaagaagctcttgtcaaatctaataagtgcagtggtgattccttcccacgcattcaggtctcgctaaactagacatgcccatgatgcttggtgtttcagaaaaaggtggtatcactttttgtcagaaatgaaaatgaaagttctgagtgaccatgaatttcctaaaatgtgttaatatccaagaaaccttaaaaccgtttataaggggagaaggaagagaagcaatggaacaatgttgcgaattgtagagggcctttgaaatgaagttctactccctgaagctcataaggtgggggaatgtacaaacttttaaaaaagtctgtgagttctttggtcagtatgctaatttctctgccactctccctctttttcatatttctcaccagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgagtgagtactgtgtcatatttaaattctaaccactgtgatccagttggctttagcctgacaggatccaggaggcagtatcaggggcattgtctgcttttaatggaataattttaatgttatgattgtattttctgttttggccaatggaagtcaaacatcttgcacctaaactcccttctttgagtagcttcctattttagagtgatatttctgcaatcacaacacaagagggttaagtatggatttgccaacacagattttttgaagaggtgagacaagttcagtttctccttcaagatggaagatggggttcctcattgtgtttgtaatgatgtagaaaactgtaaatccatccattttgttgttggaactcccttactccgttttattttcaagcacagtgtctttaggctaatcctgcttcttccagaagcctgacttctccagacactgctctgtgctttgcacctgtctcctaatggtctctctctctcccatctctcactgctgagtgctccctcagaaatggcatcctgatgtactacttcctactgaactgttgatgattgctattgccttagtgggttttttcctttctggaatatttatctttaaacaagagacaactatctcaactcaaggaatttatttactaaaattaaaattaattaataaattattcctggcattagttgcaggcatgagtggctgagtgattaaaccggggttcccaatgccctttaactcgcactcatttgtatgctttcacagaacacctgttttgctcagatgtaaggtcacttctgccctcttactcaccgctgacctaattctcaagtctttcaaaccttcctcagggaatgctttcttatgatgacttaatatttacaaatgacattctgaggtcttttccaggatctaggaatggtggccaaaggcagatcagctggaagctctaaagctgtgcttttttccccctctaagaactcttaaactttgagttcaaggctgtctctgcaataatggctcatacttctctttagaagaatgcaagggagctttcagatgagcagtttcagaggctttttaaaaagagtagaatgggaggaacgaggcaccatagctgggtgagccattttataatctcactgatcctgggtcagctgcctcagtttactcatccacaaaaggggatagaatttgaatctactttgtcaggttttggtgatgattaaatgaaatgatgtgtggaaaagagcttgtcatatagggcagacatatagagcccagggcttctgtgtttctctccaagagaagccctcatgggcaggctagccactcatccgggtttcatctgaggagctctgtggtgtgtgagttttactggaatgtcccacagcctttgctccttcatgctggctggccggtggcctcattagaccgtgcacctgggctccccagtagtctccatggaaaccatcagtgctcagcttccctgcttttcagatgtttagttcttcctaaaccagacatagcagccctgtctccaagaactcttttgaacttcttggaagcacccttttagctgctgcctcatggccctctgacttagagaaaaaagaatctggtagtttgaacactcagaacaggattcaattggggaaatgactgatctggcatttttatttttatgtagcttctttagagctcagtttccttatttgtagaagaaaggattggactaaaagtttttgaaatcctccttagcagaaaaaattctagttactatatttgaagtgatggaagaggttgcaatcatctggacatctgctactaaatttagggacttagtctcccctaatgaatttccgactacaaatagagtatatggttctccttccccttgaagctgcgtctcaaatggaccatcaacagattctgatacagagccttagaaacctttatgctgattgtccactcagctccttgcagcgccatcaaagatcaagattcttttaggaaggcgagacagttgcatattattgaattggcagtgcacaatgaatgcatttgctgagtattggagggtgctattggaaagggtgaccgaattccagggggaatgtaagcacacttcctaaatatacgaacaactgatcctgcagcagtttgcttgctgcatgtaaagttttggtagaaaatctcagttttctgccattgatttaaactacatttaaaagtccaattacgtttaggtggttatttgagaaatgaaaattgtataagctaacaaagcttggggttgtgaatttttagttctcatgggggaaggtttatgtatttcttctgctcaatgagtgttaagcccttctcttgatctgttatgttttctctcagctcttgggaagagaggatttacggtggagtaaaaataaaatctaaagttggctttctgccgggcatggtggctcacacctgtaatcctagcagtttgggaggctgaggtgggtggatcacctgaggtcagaagttcaagaccatcctggccaagatggtgaaaccctgtcagtactaaaaatacaaaaatttgcagggcacggtggtgcatgcctgtaatcccagctacttgggaggcggaggcattagaattgcttgaacccaggaggtggaggttgcagtgagttgagatcgtgccactgcactccaacctgggtgacagggtgagcccctgtattaatcaatcaatcaataaataaagtaaatataaagttggtcttcaagatgcctgaatcctgaggtgaccctgttttgggtccttccaacacatcccaggtctgatcctcattttaaagaattgctgagggatattggattacttagaaatgcttttggttgcagaataataaaatgcctgactattggagtttttatgacatgaataaataagaattcttctcctctggagttcagaactaactgtgaaatggaggagtcagatggagatcaaattgccagctttattgcttataagctgatcagagaatatagctttagctttgtttccgaaagggcttacagtcactttaccctgaattaggaccttgctgctgcattagtttttctattgctgtgtaacatatgactacaatcatagaagcttaaaacaacacttttaaatggccttcttgcaccaccacttaaaatgtttaattttgctctcagatgatgttcagaaacaaaggaaaggtaaaagtaaaggtgccaaattatttgcagatgtgcataaccaaacccaaatgaaactaaaataagaatgctcacaattttctttttttttttttttaagtggagatgggatttcactgtgttggcaaggctagtctggaactcctggcctcaggtgatctgccctccttggcctcccagagtgctgggattacaggcgtgagccaccacgcccagccacacacatttttttaagccgggtgtacagaccaaataacatattaaactagatgtaaagaaagaaccaaaagtgaattcaccagaaaagacatgccactaagacagaatgtaaattctgtagaaaccagagtactcaatgcagaaggatacttttctaccagaaagtgcttgccaacaaacaaacaaacaaaaacgccttttacagacccaagagggatgcaaagttctttacttaaggcaccttttagccaaatcaaatcacatataaagtcaaaaagaactcgccaaagggagggagtctgagaatctgagaggagagtcacccagacagaagaggcaacagacagaagcagagagcagaaagggctcagtcagtactgcactcagttccagggacctctcattcctctgaggtgcactcactttgatcccacttctgacaccatttatgtcaccctaaataacatacagacagaggctcattgaaagaaaatgatatttactcagggatgggcattgcagtggtaacatacatgccagtttaaactatgtgtgcattcagggaggtaaagcaaaaaaaaaaaaaaaaggtttttaaaggaaaaatgaacaggattacataattgttttgagctaattatccttgaatacaaggatcaataacaagggtgatgccagtccaaggttggacagtcagttgctgggtagatgtcttcgcagaaatgcttttctgcataacgaggtgatgggttttgtgcaaggttgtagtttttgcagtcttttatgatagctcttgtaatcaggcatttgtgcatgagaatccttccttcctggctttccctgactctgtttgtcagagttttaagcacaagtaaccccattttgattctgacaattttcatgctcccaacactcattaacaatgggttaagaatttgaacccttatctcacatagcaagaagcctggaggtacgttgactcaggcttgtgctatcagctccacaatgtcaggtgtatccagatttgttacctctttctgctctgttttccttggcatggtagctcttcatcctcagacttgtcactcacattgcaagatggctgcttcatgaccaaatagcacgttttcacccaacctcatatcaggaaatacaaaaggaactcccttaaaatttatctttttttagagcagttgcatattcacagcaaaatggaggggaagatacagagatatcccatatccccttgcccctacacacatgtgcagtctccctcattatcaacatcccgcaccagactggtacatttgttacaatttatgaacctacattgatgcatcattatcacctagagtccatagtttacattagggttcactcttggtgttgtagagtctatgaatttggacaaatttataatgacatgcgtctaccattatagtatcatacatagtatttcactctcctaaaaatcctctgtaccctgcttgttcatcaatcccgttctcctaacctttgacaatgactcatgtttttattagttttgtcttttccagaatgtcattaatatggtttggctgtgtccccacccaaatctcaacttatatctcccagaattcccatgtgttgtgggagggacccagggggaggtagttgaatcatgggggccagtctttcctgtgctattctcatgatagtgaataagcctcacgagatttgataggcttatcaggggtttctgcttttgcttcttcctcatttttctcttgctgccaccatgtaagaaatacctttcacctcccaccatgactctgaggcctccccagccatgtggaactgtaagtccaattaagcctctttttgttcccagtttcagatatgtctttatcagcagcgtgaaaacggacttatacagttgtgtagttggaatcatactgtatgtagccttttcagactggcttatttcacttaaatatggataaaagtttcctctatgtcttttcatggcttgtagtccatttctgctgggtggtgaataatattccattttctgggtgtaccatagtttatgtatccattcacctactgaaggacatcttgtttgcttctaagttttggtaattacgaataaagctgatataaacctctgtgcacaggttttttggttgaacattagttttcaactcctttagttaaatacaaagatgtgtgatgactggattggatggtaagaatatgcttaggtgtataagaaattgccacactgtcttccaaagtggctatacaattttgtacttccaccagcaatgaatgacagttcctgttgctccacatcctcatcagcatttgctgttgtcggtgttctgaattttctcaattctaagtgtgtagtggtatcttgctttaatttgcatttctctgatgatgtataatgtggagcatcttttcagatgcttacttgccatctgtatatcttctttggtgaagtgtctgttaaagtctttggcctattttttaattgagctatttgtttctttattgttgagatttaatgtataatgtgtaatgtattattattattattattattattattgagacagagtctcactctgtcacccaggctggagtgcagtggtatgatcttggctcactgcaacctctgcctcccaggttcaagtgattcttctgcctcagcctcccaagtagctgggattacaggcatgcaccaccatgcctggctaatttttgtatttttagtagagatggggtttcactttgttggccaagctggtcttgaactcctgacctcaggtgatccacctgcctcggtctcccagagtgctgggattacaggcatgagccactgtgcctggccatattttatatattttgaattatattcctttatcaagtatatcctttgcattttttatctagtatatcctttgcaaatattttctcccaatctgtgggttatcttttcattctcttgatagtgtctttaacagagcagaggttttaattttaatgaagtccagcttatcaactatttctttcatggagcatgtgtttgttgtatctaaaaagtaattggcatactcaaggtcatgtagatttcttcctatgttaccttctaggagttttatacttttgcattttacatgtaggtatgtgatcacttttaagttgatttttgtgaagggtgtgagctttgtgtctgcagccatattttttgcatgtgtatgttcagttgttcctgtgccatttgttgaaaagaccttttttttttttctccatgttgtcgcctttgctcctttgtcaaaggtaagttgactatatttatgtggttctattttgggctctctattctagttcattgacctatttgtctattctttctccaatatcatactgtcttgattactttcgctctatagtaatttttttttttttttttttttttttttttttttttttttttttttttgagacggagtctcgctctgtcgcccaggctggagtgcagtggcacgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatcttctgacctcgtgatccgcccgcctcggcctcccaaagtgctgggattacaggcgtgagccaccgcgcccggccacgctctatagtaattcttaaagccagttagtgtcagtcctccaatttttttcttctttttcaatattgtgttgacatcagctccttttatggaagaaaaatctttcccagaagttaccctgtagatttccccttctgtctcattgaccagaatgagatcacattagcatctgcaagggaggataggaaaggaagtatcggacaaaggacgatagtattgccataatggaccagtgattctcaaagtttggtccctcaaccttaggcatcagtatcccttggaccatcggcatcggcatccactggaaacttgttagaaatgaaaattatttgtggtcgtggtgggggcggtggggctggagctcagcaatctgtgtttaccaagctgtccaagtgattccaatgcttaaggagcagaggaatcatgtttcatctcttggggctgaacacattgctgtgatgaacaaaattagaattctgttagcgaagaagttggagtaagcaaatgataacgtctcacatagatgtcaattaactgctagccactgagatcactcatagagaagatgtcttcactcttccttgtcataaattaggtggctgttgggatccttgaatcaatcaagataagctagcctatcacaaacagcctactcccactcctgccagatctgctgcaacccaggcagcttctcaggctcaggggctagatagggtgggggaaacagctgagcgctgcttgctggctcttcagagcgttgtccctcaggtagagcccattggcccgagctagttaccaggtcccattcgtagctgcaaagggggtttggaatgcattcttttatctccaagaatagtagtggatggtaaaattgttgcgcactggtatagtcatgttcatatgctctaagatgcactcctgggtcccactctagggtgaccagcctttcaggaatttagttccaggtcgtttgtgcatcactcttcggggggaatactactattgtgagactcatagatttcacacctgagaaaatggagcctgtgaggtgacttgcctggatccacacagtgaattggtggtaggacctggattagaaccactaatcctgccttaacctcttccagatgggctgaaaatattaatgtcagattaatctacaccatgaaaccaatgtggagtttagaatattttagtataccatactaattaaagtaaaaataattcttcctgagttcccagggaaatatctgggcagttagcatcccaaatatctgcttatttgggatgaaggagggctgacattggattctgaagcaggttttggaagcaggcggcctctttctcccctgctgtggggtagctgtcttgctgggccaggctgattatcacttgataggatgctgtaggaaaaccagtcaaattctggactgattctcattttcttggctccaagctggactttggcctctggtaggaagtacctgcttctttttttccggctcggatcagcaggctttctggtatttcctgtaaaaccaagggacacctttttttttttttctttttctttttttggctttccccccgccccaaggatatggcagaaatgtttatttgcttatggatccaaatgattctgggtgtcactgacaaataataaaacattaccctagacttacgagtgccaaaattacttggaaaatttagaacaggccacatgtttaagatggaagtgatgacaatctcaaagtgctaatacggttaaattagtggactgatcaaccactttagattccaggaaggggcatgtggcggaagccaaagactcctgcaggcctctgccatgtgcctggcatggatcaaggagaggcttttaagaacacaattggcaggaagcttctgtttctcccaaggcatctttgagctagcattcagcagcaaaagggttaacttaaaataattactatttcaagaggcaggcgcagtggtccacgtctgtaatcacagctctttgggaggccaagacagaaggattacttgagcccgggagttcaagaccagcctgggcaacatagtgagaccccatctctgaaaaaaaaaagaaaatcgagccgggcgtggtggctcatgcctgtaatcccagcactttgggaggcagaggcaggcagatcacttgaggtcagcagtttgagaccagcctggccaacatgatgaaaccctgttcctactaaaaatacaaaaattagcctggcatggtggtgtgtgcttatagttctagctactcgggaggctgaggcaggagaatcacttgaaccggggaggcagaggttgcagtgagctgagattgtgtcactgcactccagcctgggtgacagagtgaaactctgtctcaaaaaaaaaaagattcaaattacttgggtgaggtggtaagtgcctatagtcctagacactcaggaggctgaggaatgaggattgcttgagtctaggaggttgacactgcagtaagctaggatcacatcactgtactctagtttgggcaacagaatgaggccctgtctctaaaaatatttttaagtaaaataaaaaaataaaaattattatttcaaacagatcaaaatccctgttttggaaactgggtattattttcagcattgtaggttcagctacagtttccaatacctattggtaatgaaaatgttcaagggtcttggctgtgcacatcagcattgcacccaaagaggcaggggaggagggcagagtggtaggctgtggctttagtttaagaaatggctgcctttcagtagtgtagaaaagacacaatatcagtgaacttcagtttaccagtgcccatatgtctctggagtatctgcttctatgtcatgcctgccctagtacataccatattataagttcctaacaactaactcagtaggattaatgttacataataatgtgagtttatttatttatttattgagacggagtctcactctgttgcccaggctggagggcagtagcatgatctcgcctcactgcaacctccgcctcttgggttcaagcgactctcctgcctcagcctcctgagtagctgcggctacaggcgcgtgccaccatgcctggctaatttttgtatatttttagtagagacgaggtttcaccatattggccaggctggtctcgaactccttacctcgtgatctgcccaccttggcctcccaaactgccgggattacaggcatgagccaccacgccctgccgtgagtttatttttatcagagagaaggccctggttttaatgtaaacaattgctttcttccttttcctaggcggcaagaaggtaggaagtaattatttgaaaatgcaaataattttaaagctttatcaatcaagtctgttccaaattagtttaaggattttctgtagctttaatgatagggccagaatgtacatttggggtgacctacatatatgacatccacaaaacagactacacaacatttcttaatgacagtccatgacagtttttccatggacggctccttctttcctcccttcatttaacataggattgctcagcctcgatactattgacattttggtctggataattctttgtcataggagttgtcctgtgaattgtgagatgtgtagcagcatccctgggcctctactcgcttgatgccagcatcatcactgcccgcagttatgacagccaaaatgtctccagacattactaaatgtgtcctcaggggcaaaatcgccctagttaatttgaccatagctatactgggatataaggggacaattgccccaaagactaccaggtgcatgccctggtcccctgtccaaatcttccacacgagctctggtgcctccaccaatgatcctaatcagtttttcagtgctagcgccattccgactcagaactctcctccttcagatgggtccttaaagagggctttgcagattttatactccgggaatgagatcatttctcaccaagaaagcaaaaatgcctggagacttgactctgatgagtacacataatgacaaattgttctgctattattcttcactaggcaaaccatctcagcactaactttaactgacccatagggacttatctaatgtatggttcttctttcttggcttacctttcataactggccagtatccctttggtgtttcctgttgtcttctgaggtcattatagaacgttttaatggcctttaaagtgcatcttcactcttttctatgcacagtaaagatatcaaacattgcctaaaatagaactacttaaaatactgcctggatagcgtttatcatttaaacattttccaggtagctttaacagagtctctctctgtctctctgtctctctctctctcttttccccccggcaagctttgatcacaggtaacttctgggaatctgattgttactttggggtgggaagttattcatgaacatctgcatgccagaacctttgtagggagccttggatcggtcatttgtctgagaggattttgttgagataatactgagtattatggcactgtgataccaaagcctagatataagtcactgatatggtttggctgtgtccccacacaaatctcatctgaactgtagttcccataatcctcatgtgttgtgggagggacccagtgggaggtaattgaatcatgggggagattattcccatgctgctcttgtgatagtgagttctcatgagacctgatggttttataaggggctttaacccctttgcttgacactcgttctctctcctgccatcctgtgaataggtgccttccaccatgattgtaagtttcctgaggcttcctcggccatgcggaactgtgagtcaattaaaccccttttctttataaattacccagtctcgagtatttcttcatagcagtgtgagaatggactaatagagtcgctaatctgttttgagggtttattatgccagatactgggctatctgggctttacctagagtaagctgtacagtaagttaccctgccaaagagatcattattgtttcttaattatatgagtttggaatgcttagactggttctgtgacttgtccaaggtcacacagcccataaatgacagaactagacttccaaacttggtctccctgccccagagtgcatgaatagacttagtcattccactatatgccctttcttctttctcttgcaatgtaggcatagcatctgatggctcagaggagccttcacaaaaggtttagtaagacctggggacagataaaaatggctagttgagagaaagatattgggcctgtcttcatctgctttaaaaggattttagttttctgacttcatgctctctctcagtgtgttgaattgcatcatagcctctggttctttatgtatctgctttagttccctaataccagctcattattagttaatatctctttctttgtgttctcttttcttggaggttaatctaagatttaggtgtccccttgctcatgtctgctgctatgtgactaatacaaagatgggtttatattctggtatcactataggacattaaaagtaatgtcaaaaaccacaattacttttgtaccaacctaataaaagaggggcctatactgtaccaatagctgacttgttttgacccacctctgcgagagcagttgccaggcaaagatagtccccactctgttcttccatccactgctctactttgtacaacctgcttaatgttaaaaacaggaggaaatgcacagctcaaagccaagcctcttggtgccctgagatagctggccttgtcctccaaagcattcttctttttctgggctcatcagaatgcctcaatgctctgcttcgatggttttaagagcatagagtggcttggtgtggtgactcaagcctgtaatcccagcactttgggaggctgaggtgggcggatcacctgaggtcaggagttcaagaccagcctgatcaacatggagaaaccccatctctactaaaaatacaaaattagccaggtgtggtggtgcatgcctgtaatcccagctacttgggaggctgaggcaggagaatcacttgaacctgggaggcggaggttgcagtgagccaagatcacaccactgcactccagcctgggcaacacgagtgaaactctgtctcagtaataataataataataataataataataataataataataataaagtaaaataaaaagagcatagagtttgagaccatcaccaccaagattttaattcccactggggatttaactcagtcctaaactcaaggtctgctatgtcaagtagtattaaatatctcttccttttaagagccattttagctctttcctcatatctttcagatttggctggttttccctaaggcttctgaaactcttaaaacatctctgatagaggaaactatctagaaaattttatgggtattcattatcagtgaggtctttctcattgaagagataatcacttcttagaatcccaggggtttcattaagtattaataaaaggttttatatttttgcattttggggctagtgaaagtctagtgatgctttaggtctacaacatggtaaactgtatttaaagattccaggtgcttttgagttatgaatttaatgcaagaattctattagcaatcacatttttactagtattataaaatcagcataataggtgaatgatttcctatgttcatgctttatcaccaattttcacaggttagtttggttcctctggaatgcactgatttaataaaatattaattctttgctctcttcttatagagaactttttaaaaaattatcgtaattttttttttctttttacatttagcctcatgttacttctgtgagccaagcaagcaatgacctactttggtgtagcttctaacaaattaggttcctgaaaattgagaggtgcccttattgaattgagtgtgctcatcacggagctgggtgtgtgatctatgtgttcactgtaggataagttttagatgactggcatgtcagtagtcattgatactttctagatagctttatgactttttgccttagggaagggaaaatgtttagaatacacatcattattgaaaggtgtgccagtgttctgaaccatcacaccccaaagagccagctcccctgggaggtgacagtgtgacaagcatgtgcagccccatgctgagcaggctctgatggctttgcatagtgaagggctgccaacaaactgcactctcctgaactgaatccagcccaggaaatgtgcattcctgttagaagtgcactttgtatttctgggggagaatgcattgctttgtattttctgagaggagctgcatttgtgcatcataagttttgacctaatggttttgcactatgtcttggaagtttactgctgagttttaggctcctgctcatagatagctgtagttctcatcctataggtggtggacccctaggagcctgaggtgtcgttttaaaggatcagtgaatccttttgtgtttcaagcattgccagtggacagaataaacaatatgtctccttaacatgtgtgctgcccttttccaaatgtgtgtagaggggttgtcatcaatgattcatttcagttcattttaaagggtgactcccgaattcatagtatctatagtatcttttttttttctttttttgagatggagttttgctcttgttgcccaggctggagtgcaatggtgcgatcttggctcaccgcaacctctgcctcccgggttcaagtgattcttctgcctcagcctcctgtatcgctgggactacaggcatgtgtcaccatgcccagctaattctgtatttttagtagtgatggggtttctccatgttggtcaggctggtcttgaactcctgacctcaagtgatctgcccgccttggcctcccaaagtgtggggattataggcataagccaccatgcccggcctctctctttctctctctctctctctcgatatatatatatatatatatattctcactatcagttagtaccaaaagttctattgttgtgtggggatcaaggatatttttaaccttcagaagggagtgccatactcaaaagttgagatcactggtctttcaagttagcatcaatttccatgacattctgggctttcttttttctgtggatttaacattttcatcctggccatagtcattgttacaaagattttttttttttttttttgagatgaagtctagctctgttgccaggcttgactgcaatggcacgatctcggctcactgcaacctctgcctctcaggttcaagcaattctcctgcctcagcctcccaagtagctgggattacaggcacctgccactgcgcctggctaatttttgtatttttagtagagacggggtttcaccattttgtccaggctggtctcaaacttctgacctcatgatccacctgcctcggcctcccaaagcactgggattacagccgtgagccaccgcgcctggccagaagttttcttttcctctaagttactcccaggagttggtaggatactttagagcctgcttcaagattttctttatgcctttttttaattgtgttaaagtgtgcacaacataaaatttaccatcctgtttttaagtgtacagttcagtggcattaagtacattcacattgttgtgcaaccatcactaccatcatctccagaacttttccatcttcccaaatgacaactctgagtctgttcaataataactgctcatttcctctcccccagctcctggtgaccaccattctactttctgtgtctatgaatttcaccactccgggaacctcatgtcaatggagtcatatagtgtttgtccttttgtgtctggcctatttcacttagcacagtgtctttaaggcttcatgaatattgcacatgtgtcagaatttccttcctttcaaggctgagtaatatccccctgtctgtatataccacattttgcctatttgtttatctgttgatggacttttgggctgtttccactttttggttgttatgaataatgctgctatgaacatgggtgtataaacatctattcaagtccctgtttttaattattttggacatatacccagcagtggaattgctgagtcacatataattacagatttaatttttctgaggaaccgtgacactgttttctacagtggctgcaccatttcacattcccaccaacaatgcccagggattctgtctttccacttcctcaccaacacttgcttttttctgtttttttttttttttcctttaacttttataggcccaaatgacagcgtttggtaaattgctgtctgactgcctctaagtcctggctgctcccatagctgctgttctatcactctggggactaagtggagaggctgtgccgttagccttgcttccctcttgcaccttccctgtctccctccctgccctaacctacagctgtgtccctgtgagtctttccttcctactcgtcagcttgggccctgtgcgcagagctggtgggaggacgggtggctcagtgccaggccgactagggcctctgcatacggatgacatccagtttccaccagaccttttttctactctgaaatccttttattcacccaatcatgattcacttttctgttcttcactgtggctgttccttcatgctcctcgctaggtcaacttgataaacaattatcgaataacacttttttgtgtgtgttctcaacactatagggatatgtggcaataaacaagggatagtcctttctcttaaggagaaaacagccatgcatcaagaccagtgtccataatattgtgcagaatgataccagggctagggcaggcaggctctgaagtcacaccaccttgggtgaatgatccatgctatgtctacttcttatcagctatgtgacctcaggctgtgcctcagttttcttatttgaaaaaatgaggataataatggttcctgtctgttttggcacttagttgacacttgagagcagtgtctgccacatagcctcaatcaatgctattcactattattgtagaacactgttagctatgggagcccagagagggacttgttaagtctagcttgtatatttcacatcacacaagcacctgccttgtcttgccaatggattgttctgctcaagtaaagcataggggcttaaagctaaatgttactgtgcctttattggcctgtatccctgtaggacctgctcagtgctaagtgctttggaggtgttcagtaaatatttattgattgtgaattgattagagaggagagagacacgaaccaggtctttttccaagcacccaggatgtgtaagcttcacaaatgaagagatgcttgctgatgctgccctctgtcctacccttcctggaaatgggcatggaggtgggtggggctggagaagtggagggggccccagaaagggtagcgacagagagaaagaaacccatgggcaacagggtctgtatctgggacgggacctcagccatcaagcatggccttgggaggagaagatgcactggccgcgatgcagcgagccctttcgaaaggcaaacagcacaagcaagagtgcagacggcaggttcgtcggctcctctggggctcccccaggggatgccgttgccattcggtctgcgtgaaggaggcaggttgtcttcttcgtcgtcggccacacttcactggctgcaagtgttcacgcagatgtgctcatgtgatcttaccacatacgcagattctagtaaaaaaagaagaaaaaatccaagaatgagtgagaatttattttagctacatgctgactgcctctcagcttgcccgtgctcttaccagatcttgaaaacaagggccagtttgtatttttataaaaatgcatcaaagtgttactaaaagatcctaaaggaagactaaagtttcctccgaaaagaagcctggcccttcaaataccaacaagggatcctcggaagatgggttttactgagctcaaacactgtctcttctgtttagatactgtattattacatcatttcccctctcagattgagtgatgtttcctccattatttgttccgttccttggcagaagtgaatttcaccatgaacaacatctgcagtctttctatacgagcctggggaatgcttgaaagaactgatactaaattattattattaatatttgtttgtctacctatccactccccacccccaggtcccctctcactcccgagtagtcacaaatgggtgtatcgggcatctcgtctcagttgtcaggactgtcccttctcattctaaactattttgcagattagcttgagcaattagaatcaggaatagatatcatgtggttaaaataaaagggaatttatctacaatttgaaaatagattacagagaacttccatgtgattttttttaaaaaataaattttgctgtgtactataacagagttggcaccagagctaacaaaaaaaaagcaagtatcaacatttaaaatgcagtacatgacatgtaaatgccatatggtattcttgcaatgttattaccactttctttctggcatccttttcctgacattgctgtatgcttcttgactctgctgctcttcagaaagcctcaattgtcctgagccctttaattctgtatttatattaggtgtctctctcttttatctaccctttggaggcttatcaaccttttccccaaggaagaggaagaagaggacctgtacagatggctgtataaatatgtgacacctgcttccgtgagccactattggaagagtttaagagttgatggtattgtcccctgtctagaagatgagcacacatttgcttctcttctcctttctatttttaaaaaatgatcatgtgcctttaatgatgtttctagaaatgtcttgaattcaaattattttctatttttagggaaataaaaaaggaacccaccaaccaaattttctgaaaagattatatgggtcaaaatgttaaaagtttgtcatagttaatatttcctaaagtaagagccttggtgatcgtgtttggggagaaatctctgcttcaccacgggaatgtcagtggatctctgcgtttgcactgaatgtgccacattctttcatctccagacttttgcgtgtgatatttatggtgtttcaaacaatgtctgtaccctcctcctggtctcagctcaaatgtcagttccttggggagcttttcctgacttctaaatgaggtcaacaccccccccaaataacatcttgtagaccccaagaataacattcatctcactgtattgatggtgggcatccccatcagcctatgagttgtgtgaggtcgggtcccatctgcctgttcaccactgcatcttcaggtgctagcacatggcctggaacccagagagcacttaatccatacttgatgaatcaatgaatgaacattgctagacataaccttatacatcttgatatagaaaatgaccttgaagctggactaggtcccagttacttgagaggctgaggctggaggatcaggccagcttgggcagcatagtgagacatcccctatccctcctactctcctaatcctgcacaatccccctctaaaaaaagataaacagagtgaccttgggctggcgctgtggctcgcgcctgtaatcccagcactttgggaggctgaggcgggcggatcatgaggtcaggagatcgagaccatcctggctaacatggtgaaaccccgtctcctctaaaaaatacaagaaaattagccgggcgcgatggcgggcccctgtagtcccagctgctcgggaggctgaggcaggagaatggcgtgaacctgggaggcggagcttgcagtgagccgaaattgcaccactgcactccggcctgggcgacaaagtgagaatctgtctcaaaaaaaaaaaaaaaaaaaaaagagagtgaccttgaaatcgaaactagtattgtatgcaaataaatggcaatggggaaaaaaagttcttaggctttgaagtacaattattttgaataaaagatgggtctgtagggagctgctccctgctaatgcttattgccaatggtattcatatgcagacacttttacctcatcaggctatacttagaagtgtaattctacagacttatcaagtcaatcttcttaaatacagtatacaatttaccttcacccagtggttctgaaccctgtaatatccaatattcttttatagcatatatttatgaatactcctttactacattgaaatgaatttcagagacagtgcactttgccaatacagataattctgaaaaattcaatgcaaattttctagctataatataaaggagaaataaatggaaagtaatgtttcaataataggtgctctgttatgaaaccctaggagacctgctgaagcagtgagtcttggcatctatacgtagaatgcaatatctccaaatgcagattggttcaggtatgttgtgttgatgactaagatgtcacaaaggactttttctccagtggtgtggttttccaaaatagagaacaactctcagcaaggttccagctaatctatttacattagagtcagattcttaaaaaatttggtcaactttgaaaagatgcaaacaatttgtgtgtgtgtcttcacatgtaaaagggagttaggttcttggctcagataattgtagacatgagtttttctcagtgggacattcaaagctcatgctaaatgtgggatggttctgtgatttgtggcactgattgttgtattgcaggacatctgaacgtctttgacctcctcccagtacatgccaaacgtgcccctccagttgtgacaaccgcaaacaccctaacaagtttagagaccacctcctagggtgttgtaatctaaacagggttataaacagagcttccagggggctcccatgtaactttcaagaatttacatatttaatttctattctcgtgaaaatggccatgttccaatagttaagcctcttcccttgatgtatttcccatgccattaatattcagttctattccacaaatatttattatatgcatatgtgtgtgtacatccatctgactatacctttctatgttatgtacctttactagaattccaaattataaaatcctgtcagtttatctcttgctagatgaatggttttattgtttttatagaatatttgctttaaacagtactctcatattttcttgaggtgctaaaatagaggaggcagctgtagaaaaatgcactacgggccaggcatggtggcttatgcctataatcccagtactttgtgaggccaatgtgggcggatcatgaggtcaagagattgagaccatcctggccaacatagtgaaactccatcttactaaaaatacaaaaattagctgggcatggtggtgcatgcctgtagtcccagctactcgggaggctgaggcaggagaatcacttgaacccgggaggcagaggttgcagtgagccgaggtcacgccattgcactccagcctgggtgacagagtaagactccatctcaaaaaaaaaaaaaaaaaaaagaaaagaaaagaaaagaaaaatgcactgtgccaggcacttagaacattgagatgaaggagcacactgtgtagtagggagacacatggatggatggacagacagtgatgcaggttgagcagttctatggacaggggaccatgcaagggtgaaggaacatggacagcagagagcaagaactggagagggcttcctgcaagaggtaatgtcagaattgtgtgtgaggaatgaacaggagtctgacaagcattaaaaagggcgaagaaccttatcctagcagatggaacagcccttaaaagggcacagaagctaaaaagaaatgagctatgaagccatgagaagatgtagaggaatgctaaatgcatattgctgcgtggaagaagccaatctgaaaaggctacatgcagtatgattccaactacatgacattctagaaaagtctaaactatggagacagttacaaagatccatgattgccaagagcctgggggaagagagggatgaatcggtggagcagagaggatttttaggctagggaaactattgtgtatgatactataatggtggatacatgtcatcagacgtttgtccaaacccataggatgtacagcaccaacagtgaaccctaatgtatactatggattctggatgatattgtcagtataggctcatcacttgtaaccagtgcactactctggcatgggatgttgatagtggggaaggctgtgcatgtttggggcgggggctatatgggagatctctgtacctttctcttaattttgctgtgaagcaaaaatggttctaaaaaaatcaaatcttgaaaaaggcactgaagtataaaatggagcagtattggggcaccaataaaccatccagtctctccagaactgcaaactaactgctactacagcaagagagaggggtcagcaactacctgcctgcagcgggggtaggggggagttgggggaaatggcggggggtggggtccctgacagtttcctcagaagtgggttgacgtattctggaggaggaggaggaggaggcagcatgaggcagcaggcaggatgcatttcttgaactggatcatggccaggtccttacagctctcccactgccacctttggcaaacattcctgggatcctgaaggctcagacaaggcccatccctcttatgttaccatggggattatctcttcctccttttctcttttagttttccctccaaggaagggttgtcactccttttccaaaaggaagaaggaccaagtgaatgattttcaagggcacagtgctgttatttctcgagggaacctctgccatgttcttgagcatgttgctcgttttctccttcccttctcttcttagccctctccctctcgctctctcctacctctcccccttttcctttttctttcatcacaaagactacaaagagtatacatggtcactgtagaggccttggaaaatgcaggggagtgcaaagaagaaagtaaaatcctgtaaatatcctttgtccaaagaaatccaccactaacacgttgataatcgtacttctgaatcttttctctgcatctacatttggccccaatgcctggtgctccactggccccacagtacccctcccacctgctacctaccctgtccaagtttccctgccctcgggtactggcaggggttgtcaccgtgtcctggccacagcctgtgccttccctgtgttactccatcagctccttctggattgctgacctctgctctaaccactgatcgttcatgacaattttgctacccaccttctgcaggtgacagatccttctgcctcagaagggggagtgctactgtcctgctgtcctagagctgagggagacggacaccactctccccggtaacactagattctcaggaatagatacaacaccttccaaactgcagctgacaccagctgtacattgtaacaagacttttaagatttaggaatgtcagagagatattacccacagcagttacatcacatctgcttacagtctggctgttcttggagcccagaattccaggcctgttccagggtgtccaattgagctgtgtccttgacctgcctcgaggcagctgaagccagcttgccctgacctccaggagtagctgttgcaggcaggcagcttagctcaaaatgagagaaactatggctaatttaaacaaaaatgaaaataattttaaaaaggatattggatagctaccaaatccttgggatggttggaaacccaaactgggaaggtaccttgttaaaaacaatgaccaaatcacaccatggaactggtcccggaggaagccactgctgtgtctgcccgggcatatacagggcggtggcccctggatgctgctgcaagaaccatccttgtgactgctcctggagtggggcataccaacattggtaccaccatccctggaatggcttccacagggtccctgtttctttatataacatccaagatatgtctgctcctgcctgccaccccacctcccatggaagctccccgctgatgctttcacttccatcttgatcaagggcaaggtttaccttccatgcccaccccactcagggttccagtccctcaccctctgtcggaggacctaggaggatccaggactcttgagagctgggctgtgcacaggtggtgaatcaccagcagaaagctctgcatctagtctcttcctcttggcctccagactggacgttttgcttcccaccacccaccccccgcaaccggaagactctaggaagatctcgtccctcccactgtacttttgctccaggctgagtggccattccgccttctctctgtctgtgttcctaacccggtcttgcctactgtctggaagaggagaaagtggttctgtaagtctgcctctgagaatctccacacctcttttcagaatggtctggggagtggcgggtgccagtgagacgaaagaggaggacggaggacagaggactcttagatgactacttcaaggtttaaccctgttacatctgcatgggtgtggttcaaagtctgaattatgtctttatggctgggaaagcctgggtcacatgcttgtctcctcatagcaggagaggctgggaaagtcagtaggtggtacattgcagcttctgtactgggaggaggtctctgtctttcaccaaactaaagaaggatgttcaaattattggtgggcaaaaagaatgacaaggatcctctgacgtggacatgccctgtgatcacattagctctgtttggtcacagcatgatagtggagtggcttgggcgacctatggcagtatcattgataatcatttaccatacaccacaggctgagcgtcaccagggttgatccaattccattttctaatctttctcctaacatggggtgaacatcaggaggcctggagatcttcttttgttgcttttagattctcagtttctggtcctctgagaagaactgttcaaactgttcatgcatatctctactaaacactttgcaggagcaatggaatctagaactgcattttaaagagaatactcttgtaaaggaaatagtatctacagagatgcaaccctaccaaagggtggggcactgttgactactttatcttatggagcatgtgtccctggagtcacagccttgggatgcctacatctgctttcatttgcatagctaaacagcccagtctcttcatgaaaggtaatagtctactttattcattacatttagctccatgaaagagtttgcatataacttaattgttttaagaggaaaaaatgtaccaattaaaagccaggacatttattatgcatgttcagcaatcaaaataggcttcagtgtagccttctatttttttttttcttttttgagacgtagtctcactctgttgcccaggatggagtgcagttacatgatctcggctcactgcaagctctgcctcccgggttcaagcgattcccctgcctcagcctcccaagtagctgggattacaggtacctgccaccacacctggctgatttttgtgtttttagtagagacagggtttcaccatattggccaggctggtctcgaactcctgacctcaagtgatccacctacctctcggcctcccaaagtgctgggattacaggcgtgagccactgtgcctggcccagtgtagtccttctaagcaaatccattctaatcaaatgaaggaacagtgctcctctttaataatcataaataagtgatagatgaataaggaaatgaatcatgtatgcatttatttgtccacaacacacaattggagctggcatttcctggaggcatttgtataaaacttagatgagatcacgtcccctaggatgtcaaggtacttgccctgattctgccatgaggcctccaatggaaactttgtcaggagtagaaaacagccaatgtatgtgaagtccaagttcattggcacctccctagcctccttgcagggttgtttctctccatcactaatcccctgttttggatcatttgcaacaactccctttactacgaagagggaatcttgaggtatgagcagtaaatatggagactgtggtaggcaaacagttccacagtgtcatgaggtcccttttacactctctcactctgtggattctttccccttcacaacacgtctgatttatcacaagctgtgattaattatttccttgcatgactgtttaatgcttgtctcaactcctactagctctgtgagactgggggccattttgttttactcaccggtgaagttagctcaatatctgacagagagtaggtacatgataaatactcattgaaaaaaggaatagaaaagttatagagttcagctatattcatagcttgaaaaatatgctaaaggaattttctcatttgtaggtgttcctgtccagttcccttagtgcaggccttcccagtgtagggtttatttctgcatgactttctataaagctgtatttccttcttatctaacttctcgttcctagtctaactagaaagttcatgcatatccctttctcccttctctccattttctttttatctctgaaacaattaggtacacacgtagctgggaagccttcttgtatgcctccagaaaaattctagatccctcaaactattgttctatctcttctttctgtaccccaatttttttctcaattatgctcttaaattatccttctgaaagattttctaattttgtttgcttcttgttgcctttttctcttctagttcacacacctttctctgtaagatttcttaatgcttattttattattatttatagttttatgtggacaagcatccctagatgcttacattaaaagtatttgtctaaaaaaagaaggaaggaaggaaggaaagaagaaaggaaggaaagaaagaaagagagataaatatggaaagaaagagaaaaaaaggaagaaaggaagaaagaaaggaagaagaaagaaagaaaagaagaagaaagaaagagagaaagaaagaaggaaagaagagaaagaaggaaagaagagaaagaaagaaaaagaaagaaagaaagagaaagaaagaaagaaactgtctattgggaagggcgttgtttactgcttatccagcaatacccaggtatttgtataggtgttgacctaaatctatctgaccttgaaggctgtcttcaaatcttctaacaggcaagataaataaggtcacagaaaatgcatacctgtttgtcatttacctttattcctgggcctatagatagttcttctgtctagtagcctctgggctactcatgggagtggggatagggatcatatgacaactttcttctcttttacgtgttctgggtactcttggatactggttccagggaacagctgcatagctaagagatgggtgggaaggacaagaaagagtaaagtgttcctagaggagccagcgaggcaaggggtgttttactgacctagtctgttttatggctacatgagaaccctaacactgctctccccttgccctggctgcttttccaggttcttgtccttcccagacagctctagccagggctcagggttccttaatggctgtcccaatccactcttcttttagcagagcacccttagcaagaaacccactgtaatctcaccctacttttctgcttttacaacatgtcttccttccgggtgaacattcacaagctaaagaagggaactcaccttcccttgaggagagcttgctgaacaccagaggatttcacctctttcccccttcataatggaataatcactgagctttctgctagaataaaaaaatcatgggccgggcacggtggctcacgcctgtaatcccagcactttggcagaccgaggcgggtggatcacttgaggtcaggagttcaagaccagcatggccaacatggcgaaaccccatctctactaaaaatacaatcattagctgggcgtggcggtgcgctcctgtaatctcagctactcgggaggctgaggcaggagaatcgcttgaacctgggaggcggaagttgcagtgagctgagtttgcgccactgcactccagcctgggcgacaaagtgagactctgcctcaaaaaaataaaataaaataaaataaaataaaataaaataaaataaaataaaataaaataaaataaaataagacaaaggagatgataaattaaagcctaacattactatattccctttatactgaagaatatggtttatatctgtggaaagatgagtttcctaatacaacctcagaattagataggagatcacaaggggtaactcccaaaaggaaggggagaggaaggggctgggttaacagttcctgggtcagaataagagttgagtggccatgtgtattgcagcaggtggagctccctatacaaggaaagcactggggcggaaaatgagcatttatcctattagaatggtcttgtgccttcactcctgtgcactgcttagccagggaactgtgcccttacaccttgttagccagtggaagaagagtgagtctaccttttagctgtctgtagcattgttactgtagtattattgtatgcttctgtttatgatggtggagaggccatttgagatggaggcattgttcatcatgctgctgaaatttgagtaggataaatttagaatttggataggtgagcagctgggaggggcatcttttgggattgtcaggagttactcagttgatgtggctcatcagcaggtgtcccattctccttacctttccatgggctttctttcatgcttcaaccaaagagaaggacccttcttcagttaaggatttgtctggatgttttctacatgtggtgtgatcgcttatgagttttcctgcctctgagacctaccttctgaatgcctgactgacaaagatttaaaggtcgtccattacagttggcatgcttttatattccacatgccagagctacaagaatgttattatttcctttcttctctcccaggtgatatatttggtcacctaggtgtcattaggtactaagctttgccttcaatatctaccagggtggggcaccatggacagtgccacaaagaccttttcagacaaaggctcagatcttcctgctggactttgtgtgcaagaggaaggaactttttcttttcttttttccccttctctctctctctctctctctctctctcccttccctccttccttccttctgtttcttccttccttccctccctccttccctcgaactgccatgtcccttgcaactagaatggtccctgacatttaaggttttaaataattatgtgcagaatgaattaaatgccaaatcttgtgttccaatagcgtattatcttcaaatgttaacagcaaccagttttttagaatagaaaacttttgaaaattttaattaaagtcttcctgcagtggaacagttgatttttttttttttttttttttttttttttttttttttttttttagtcggagtctctctctgttgcccaggctggagtgcagtggtgcaatcttggctcgctgcaacctctgcctcccgggttcaagtgattctccctgcctcagtctcctaagtagctgggattacagacatctgccaccatgcccagctaatttttgtattttttagtagagttggggtttccccatgttggccaggcaggtcttgaactcctgacctcagcctcctgaagagctgggattacaggtgtgagccagcatgcctggcctgagtttttattatttgtgaattttatttttttccatcccagatgcacctatattggtagtctagtgataaaaacaatttacccatatataccaacatctttttcaagaactttgcatagtgaaaccagcaaagtactgaactggccagtctgtcataggtgtcttgcaacatgactcagagtcagaagctggatataaacttttttctgtgtgtgtatatatgatccatttgtgtattcggcttttgagtgggactttttcagtaggcttcttgaaggttccacttcactattctcactgatgtgtgcttacagcatctctgccatggagattttaggcagagagtgtttaaaagctctactcatagtttatagaattgctagtgccacaaggccattcattgtgatgatgaaattattagttataagtgaaccttctaaaataaatcttggaagaaaacatgttataagaaaatgaagtcagtcctcttactaggcagttcccatcatctttccattttgagaaattatcctcagttcagatgtattactatggtgatgtgtttgcatttcaacaaaccaaaccaagccgtaaactgagctctgcatgtttagcttctgtcttaggatttttaccgcagtgtctttattcttgagtaaaatccccgacatcctggctagaaatcacaatgaataaataatttcccagccagacaaaacaatctgaattgctaatctcagaattctaagaaattacataaagatgcaaacaatggggattaaagagggggtaaaaattaaatgaaaaaatagcccacaaatgaatggaaatatacatgctctccaaaataacattgtggaagtaaacaaaaacagacagagaattatgcttaatgagaattggacatgtggcttagccctctgaggcctgaaacaagtaaacacttcccgaattgtcagtccatacatccctctctcaaaagagagctcttagaactggctccctctcctcctgtttacgaagcttacttggtctttggaacaattgcacatataattttaacaactaaatgaactctacaggagatgggttttgagtacttaaaaaattcctatagtttgtatcaatcagatacgggagatagttttgcaaaatactgtttgtgtaaagagaagggaagaacatgcgctctagtctaaccaatcaacaaagtgtgaaaacacgatttagacagaagtacaacgaccatcctatcagttctacccaaatatcatatcagaccatctcttccctgataacagttttgttagcctaaggacacattagctcagttagatctgggctctcacagagctttctgctagcggctctgcttactggtaagtaagccatgcaattttgcctagcaaccccaccgtggaaacacagctccattctgtaagtggcagggggatgtggcagggaggcagggagagtgaggtttgtgcctctcagaatccctctgcagctggttcctgacatcgcaaacgttatctgcaattcttggcagtttcggaaggatgatgaaaaatgggacggggaggtggctgagcctggggttttggaagtaggatggaattaattggaaggcaaataaaaaagcttccaagattgtgagctgcgactgtctgagagctcaaaccagagttggcaagaggaaccaaaggagaatgaggacattttttgtcattgacaatgaggtatacaatatatccaggaaaggacaaccagcagcgacctcctgaagctaaacagagattatcttaagccacatatgagggaacattcctcaatggcaaagagaagcattaaatctgggactgtctacgtctaaggaaaaatttgagcatttacattaaaatggcctgttaacaagcattgaatattaaccaggcactgtgctaagtgtttgcacacttgtttaatcttccaaacaatccgatgaggtgggatttcttatctccattttatagaggaaaaaaactaatgcacagagaggttgagaaacttgcctaaggtcactcagctatttagcagtggggttgggatgtgtctcaggcagtctttccctagactctgtgctcttaaacactactatggtttttcagcagcagtgaacagttacagggctaatggggataagaaaactgaagatcaccacacggcacatgagatggtttgtgattccattgtgaaagctgcagtttaaaatgttcaattaaggcaactttttttttttttaaatacctagagggcagcaaaaacatgggtatctagaataacagatattgctaaaaccttacgcccacagcacttctttttatagcaaagtatgggtatacacatattttcatacacctacacacacatacacatgcaagacgcgcatttcttaagtccctaaaataccctgataattaaatgctccaaacattctctgagtgtgacccttggatgtctaggagaagcagcccaggaacacacttgttagccggggcaatgagtagtggtgaaatgtttaccttgctgataaagtctccagtagatgatgcaattaagatgccacgatctagcctttgttatacacctccttgtctgccgtcaaacaaatccaccgctgtccttccccatcttccctcctgcccatctcctgaagtccaggaacgtctccagcttcctacgtacttgcagtcctcttttgccaacctcaacctcatttagattgcaattacattcacatcttaatttatgacttaacaagcatctcacaaacatttaattcactttaacttcactatgcatttgaggaggaatatttgaggaggaatggtactcccattgccagcaattagattgacttaatgatctatggcgaaatctccttttgggctttgaacttttcatacatttctgcaaacaaaactaggctaattaaagtaagttcctggattctcagaggggcttacctgccttcacaaaatcctcctgtaatatccaacatggaaatttatgaaatagacaaaactttccctgcagttttcaggtaatttatcttgttacgacactttcatgtgtggaaaagtcgatattttcatatatagtttcaacaatatcaataaattgtaatttttttttcagatggcttctctgaggagattaggagggtttctatatcaaagcatagatcaaattatttttccctgttcccattttatataccagatgccttcttaggagttagaaaagtacctcctttttacaaggaaggatggcatttctttagcttttcctggacagatcacccggtgaccattttttattctcagtcttccttcacagaagggacagaggactgcccattttcagcaggagttagtctgatttcttctgttagatgcagacgactttgtttgacaactttctttgggttggtgaattgttgaattacttgaaaagctgtttccgttgttaagcactggactgagaattaattacatcagaattctaatctcggctcattagtggcatcattttatgcaagtcccttaacccctcttggcttcagttttgcatgtgtaaaatgaagtatataaagcaaaggtctctctgtgcttggtgcgatgaagaggatgcaggtctcatggtacggatttcctatattgattgccccaaatgtggtgtacgtttgcagaaaattcatctaggcaatgtagaaaggccatacattctggtgttaaacacatcgttcatatatttatgctagtatatgataccagggcctcctgatgacagtctccagcaccaattctgagaattgcgaggatttttcagcttagagtttttcagcttagagtcaattccagtgtcgccttcagcacatccaaagagaatatgaccgatgctaccagtcctgctcctggactccactggtatgattcctttgccccagtatcagtctaattcccattctagatgcttttttcttaatgacccaacaactgactccttcaggagctggcatgagatgagatttgtttgcagagatgtataaaaatttcaaagccccaaaggagatttcaccacagatcattaagtccatctaattgtcgtcctactacccatttagatggggaccctgttatgctaactcctatcctgtctcttgtgagtgatacagtcaacacacatgatgatcacagcaccagctcagacaggtgtgttttaaaacaaaagtgtgttataaatgtacagcctcagcagggaaaatgtgggggcgaagaaacacacaaatacttggctagagtcggtcacaggtgaagatggggatgactgtgttttccgtttcatccaaacattttggcctgactcagataattttttttccagcatattctgtttgacacaagggaaacggtgcaaatccatcaccaccattgtggaaagagctccaaactcattctcacgaatggtggatcagtaatactacatgacaaatggtagcatttttgggaaaccattatatttgcaccagtgagaagtcagaatcagcatttgggctgcagtcatggaaccatgcaagaaacattcaaagcattggctaagcaggatttttttgtttgtttgacctggtgtccacgaacaggcttcagggagcctgagaacctcctagaccacttgaaaaattctgaatgcacttttctaggaaagagttcacagcgttcatcaaatttcctccaagcagccaatgaccagagaaaggttaaaagtcactgacacagtaccgttttctgtgcatctatatcctgaatccagggtgatgccgctgacttgcctatctttctcctttgctcttcctagaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcaggtaagcaccctgggcaggccaggcactggggctctggcgggaaaaataatctgttggctgtgcttttcgcaatcgataaaagatgttgcgggagaagcaaatgaagatgactcagtgtcactactgctgtgaagaggctcatttcaaatccctagtcctatgtaatataaataccataggtttttttctgctatgaaaagaaagccaaccctttccttctcaggatgcttatttcccttatcgtcacacaaattatgcaagactaaagtgaatttctcattaaatcttgaacttctgaattgaattaaacctctctaatccaatgataaaggctgtgttaggaagtggcacataggaaactcagatgagattagcatagaatttggtctgcagtgacctgcaggttcagcttcctgactcccaggtgagagccattgtctctgcaaacgttgtcctgcacatgcccagatacaaagctgaggactttggtgactatggggagctgagaactgcccagagggaatataagctcatggattatgcaggagtgtatatacaagcaatagccttccttgtaaaaataaatgtggatgagctatgtttaaggaagtgaaaaaaaaatcatcaatttcatctagggccagggaaattgcaaatgaaatgagatttagtttcatatgtgcaccagtttcccaaaagtgtggtagaaaggtacggatagaaggaagaggccatccttctctttttctaataggatagttctagatgttcagacaagtgatcagtttctactacaagaagtgaacactttgatcaaacaactctatcatctgtcacaagtttgaaatgtctggatggagtgtgtgtgtgtgtgtgtgtgtgtttcctttaccagttcctggtgaagtggcagcctgacctgagccctaagcagactgtttttttttgtttttgtttttgtttttgttttttttgaacagggtctccctctgttgcccaggctggagtgcagtggtgtgatcatggctcactgcagcctcggacctctggggctcaagtgatcatcccacctcagcctcctgagtagctgggactacagacgtgtgccaccatgcctggctattttttattttcattttttgtatttttcgtagagatgggatttagccatgttgcccaagctggtcttgatctgttgggctcatgtgatcggcctgccaaagtgctgggattacaggtgtgagccactgcacctggccagactgttcttgtttggcgtgtgatcccagcagtgtcttgatttctccatggaatactgtgcacatcaggaggatgggttctggtctctgggagtctggcaaacaggaaattctggaagagattgctgaaggctcatcaataggggcatgcgtgcctccctgttaattttataatacaaataactggcagagtggttttgtagctcttccaattgggcagacaaagactgaattccactttgtagaaataatagggttttttttccccttcctttttattggttaaggactaagaattgcaaagtgactaaatttagttttttttagcttttaactaaaaattgatttttagtcagtgtgactaaaaatcatttacagaaagcctgtagcctgggactctacccattttccccttacgcacagtgctcaaccatggatgtctagttagtggcctcaagctccgaagagagactgtacagagaaactgagaaaagtaagaggaacagttatagatgtattccagttaatcccttggcatcatccgtagccggtccgtgggaaaactcagtggtgtttccaatctaaggcaaacacatgtagtggcagctggaattttgaactatttcacaaacatctttaagtatccaaagcataacctgcagtgggtggtgatttagagctctctgggatagcactgggctgtcctgaggactgtctattataagatacctgtgacagacacagatctctaaccaatggctcagttcagtctgttaatctgaggcacaaatagcagaggcctgggagtgagattttttaagtgatgcttttattatttgttatctaccatggactgagcacttagtacaaactagtactttaccttatctttacttacctagtaagggcacaacctacacagtcccaggcatccacagttttactgcccttgtcagtgattacagagccatatttcctttgtcctgaggtttctgtagaccacggtctcttaaaagtcacagtgctgactgcagttaggccagaccccttccaagctccagttttccgagcttacacagaccaatctggagaatgcatgcctgaaaagactggaagtttatctctatcttttggtaacagtctgcgagtgatagggaaggttgcccaatcattggaaaacgatacattaacaagagttgatggttgctgtgattcgacatagtatgaactctactagaaatgtaatcagatcattgatcctgcaggattgattgctgatttattttgcagctgactcactttaggacagccttacaatatttcgcaactctgtctgggagcacacacagaactccgaatccagataagcagctcataaagggatacttagaagggtgttgactgcctgcttcattgttccttgttcactagcgcaccctagtgaccatctttgctgggtaatagtgacttgcaaaggtaaatatttactcccagatagcccacaggagaaagctacagatttctctggcgtagcacagaaacgaaatgaacctcaaaaaccacttactggtgcgggaactcagatcgtatcctacagctctaatgatgcaggagagagttgtctgaaaggaaaaaccaaaagcagctgcaccaaaccgaagggggcttggcacagagaagttggaattctaacgttaagaagtggcagcagctgtcgagcctcatggtctgctgcgctgtgttgctgattgggtttgagcttgtcgagaggagccacaggtcacatttcttgcccagctgcctttgccgtaagactcagtggcgctagatgtggttacaaccttggtctggtgggaaagtctgtaatcactcatcacctaatacgatagttaccaatccattgctagtatctgtcatcttagaaatggccactgcctgcttccttaggcaatagcgtttcccagagagagattgaggctgatgtccgttatttccaggagcttcctcacttctttaggacggtgggttgggcttgcaacctgttttgcatggctgcctccagcagtgtctgtaggaaggttagaataaataggctaattattcagaataaatgactggtcctttcaatggaacagccagtcaatgcaatcaggcaactggccaatttggtttgatggatttttactgtaatccttatttataaaataaagggattggcctcaaaggtcccttttagttctagtttatggtgactctaattactcagcctaactgaccctttggagtagcactatgtaaacaccattcctcagttagcattaaatcactattgcttgcatcaaaatcccagtaatgccattaaagctaattttactttcacacatccacttgtctcttagtaaatgtatgggtgcttaagatggaaatggttccaagaattccaaaccatagggggtgatatgattatatttgatttttattaaaataaatttagagaagtttaagaaaaaacaatgacaaccaggcctgatctgttgtcctgtagttcagagttattcatccttaacgctcaggtcaagcattagtaggtcaagttggccactggcgttttttatttctggtattaaggttagtggtcaagaatcgagggaagtaaagccttaagttaggcttttttgggtaagggatgggtaccccccttgccctctaaccccggtccaccttgtacacagcaaacctaacagctgagtgttaaacaatgatggatgacgtcttcactacatggaatggaatatgtgttctctgcaaagaccatatgctagatcatggttaaagtaacatttggttgttttcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtaggaccccttcctaaccctatgaatgttcctgagaacagatgagcttgtgtccagaattgcctgtctctgtcctgtgggctggagtgtttctggctcggttttgcagggggagcggggggcgggtcataggcttcctcatgttgaatcagtccttcaaagctaaggagaatagaatacagttatttctggattctttttttggcaggtgagaaaatatggtgattcgtttaccagcccataaatcctggaaaaactagtaaacaacagctgattttaaaaaaatgaaaatgaaaataaataggagaggtagactatggctgagtgtgtgtgtgggggggtgcagcctgtccttccggtctcagggtctgtgcagaaaggcagttgaacgccaagaatctttcctgattcagtaagaaactgaaatcatcgaacattgaccagctacggggaagtgagcccaatgggcctctttcacttatcccctcttggttgtcacatccatagagacaaatatacatccctgaggaagggccgtgcatgtaactttacatgaagggaagtaaaggaagacatatgaaggaaagatagattttgtgattaaaaaataaatattcatgtagctctcttaggaagagaggaaaagaaaggaggaaggccaaggaaggagaaaaaaaagagctaaaagaaaggaagggagataagaaaaaccaaagaaatagagggccagcctctgtttgcttcattctgtataaaaggccccaggagaaagttgctgaatggagagatttcccacatcagtttcctgggcccatatgctaattttcctggtttatataagtaagccaggaaagtaagcaatgcaatttccagaccggttccccagacagctaactgacctgctgaaaatcagctataacaaaagagaagggaacaacatgaatattgactttcctggatgcacaaatttgagttcctcatttgcagagggaagcatgggacttatactgtctgccctgttcattaagagccaagaaatttggtgctgatcctcaggcaaaactccactctaaggaggcctgttctgtgggctttggcagaataggccgtcttcctgcaccctgactgggggaagtgggttaccaggtgccctggagcatcttcttaaaccagggaaagccccacagcacatgaccatagcatggcccagatagggtggccacccatcccagttttcccaggactgagggagttcctaggacacaggactctgttttaaaactgggacagcctcaggcaaactggaacaagttggtcaccctgccaggatagaaaaccagaaaggcagggagggcagaaggcctgctgaacatctgctgtgcccaggactgagtgaggtgcatttccttgtctcaggtgagctatatatggtcactcaagtgtatgttgggggaatgaggccatgcaattgataagagagagctggaagccaggcctgtccaactccacattttaacctctcctgcaggatgccgtccccctctctttaagtcaccatctccaaatctgaggcttcttggggttgcccaccacgtgtgtctccctgagccaccttatttactagccaattagggatgggtgtccaggtggcagaagtactagggcagaaggtagcatttgcacctccccctgggcatgtgctccgtcacctcctggcctccccgtggggacacccgagggctgtgggtgctgggaggccaaggcagggaggcatttgtcagcatattgttgctcttctgtctcttggccaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataatcacaaacacatcacactgtggatatcaccttaaccaatgacagaagcctgctgagtttggtctttctcacaggggtaggtagtccacatgaactggcgagcagtggtgaaaacatgacatcaactgctgcgtggttaaaggccaatcatgcattttcctcagtgggtgcaatggtgacaataaactgatttggaaatgtccatgtactttggttataacttgttttgataagaggggtagaaataccaaaacaattgccttgcatgatgccagtggcttgctgttctgtctagctgatcctacatttttacaaaagtagacatcctgcatttctgagacacactgaggaggaccatggcatctttccatctcagggctttttgtcccttgggtgtcttagggtagacatagtgataagatccaatctcgctatctccaaacaaaaagaaaatgtaccccttgtacagtaagcttgaaatgtttttattgcttgcagcgtaagtgccattaattccatttaacaatgatacttagaaatatttaaaatatttcattttacttttatgtttgggcattcctttattctgaaaaagtcaccactgctccttgcttgtttctacatctcacatcggttactcactaaaactggaacaccctagactgattgttcccaggcaaacgataagctaacacatcataattatgattggtctgtgaggctagaacatcccgcagaggaaagtcggggaatggctagtcataggttgcatgatgattttaaatgggtttgtatcagaaaggggaaaatacatactcctgtgtatgcctcagtctttatcataattggctggttcacagctagctctttgggccacacgtgaaagcatttggacctggcaacaccaggcagttgctggttatgggtgttctaggctcactgctaccttttacagagttcacgggattttacgtaactaacccgcagtgtggatttaccaaaagatcacagcactagcggagacttccagaaactgtctcatgctttctgacctccagggaaagttgtacccacgacatcctcaaccactggtaccatggaagacctgtccctgcccatttctcaaaaatgcacagctcttccctgcctggagcacatgaagtcccatctccctgtccccagacctttaggctctgttgaagttctggcattgcttatgagacccttcctgtccaaggaaggtctaagtcaactcctccattggactggagatgaggctcactggtgacatcctgtgtcgactcagtaataaatagtcacttgggaggcgatgtttatgcaggtgtggatgttgagttttactatgggaatcattccagcctgacaaaatgtgttttaaggaataggtagataactgggacttcctctgttattctaacaagtcgaagcttcctaattaaactgtccatggatctcacttatttggtttccactctgtgttatctggtacgttctttgtagcagtgtgttaaaattccaggccctacggccaaatctggcagaggcttccctctcatttatccagtgccttctgtgggccaggcacaggattaggcactttatgaacgtcagctcattgaaacttcacgacactatgtgggaagtatttgcaaacccattatatacacaaggacacagaggctcagggaagctatgttatttatccaatggcacacagcaagaaagtggtagagctggtattcaaagtctgaccaaagtctgctttcaacttcactacagtgtctgtgtcatgcatccttgtgattgtgtgtgtttgtgtgtatgtgtgtctttctagcttcatggacacagcttacagatgtggggagcagatatggtggaatctccaccaccaagagggcacaaggtctttgtgtaaacatggctcaaagggttgcccctgcagacacctactgtacatttatttggt

SEQ ID NO: 12873 - DNA, 4959 bp, Human
cgctcctcagccaaatcctgttccattctcttaatcaccagccaagccactctcccgccactactttccaccccgatcctccctcgatcaggttccccagctcgcataagactttgcctgccagacctcgaaagtcataaacccgggggatgaagtgggaagactgtccaaggagcaatggagggaacctagttgttcttgtttttcctgtttttcactgagttcttttatgcctttagtcctgaggcgcaaacagctgttgtagggctgcctaaaggtccgaaagagacacccctcggcttggaaataacgaggaatcgtcgtgcactgaaacgtgaggagagactgcagggacccctggagctggagctttcgggagtaacgaagctgcagctcctcgaaaataggatgggttccccaaaataagagctcttagggatctgaggcttgtattcccttgagtatctaggaactgggattgcagtttgtgcttgcccccacctcccaagagaggacgagagcgagtgagtctctatgcctgggctcctaaggaaactctctggcagagccagaggagccccagacatccccacccccccgtcctcactccctctctcccccccaccagagcaggaggaagaggccgattgcgttccccagagccacccaattggtcgccataactcacacaataaagtggcagcgcggcggtcagtcttgccctccggcggcgcctgtgtggtctcagtgcaggagcccgcgatctaaccaattccagcttggctcggagaccgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttgcagtgtgtagtcctggagaggactcctgaagataaaaggaatgtagcctttggccacgattggtggatcgagctgatgggttccctggcggacattctccatggacctgtatggcaatttccctatgatcagagttcttagccatggggacacaaaccagaaatagtgtggcctccttcctggatcccaaaattgggtagtttgtgatgccctttttgtgtctgcggcctgggactgagggctcaagtagcgaatgggtctttgctgccagatcctcaggcagaggtctctggagaaaccctctctgtgggagtgattggggtaaaagtgacattgctcaggccaagggacagagctcctggtgccgccggaccgcgccctctccggataagtcgagaggcgccggttaatggaaaatgcctccgctgcaacttaaagccggtagaagcaagccgggcccagaaagcctgcggaaaacgaatcgcaaagccaatcacgaccaagaagagtcccaggggacacttgggcagagtcaccctcttgcccgatgtccccagctgctgaagccgggcctggaaacccgcagacagttagtcttcgctcaacctgatttggctctgctggcagcctcgtccttcgccatcgaacattgcgggtgttatcataatactctgaagggggggaaaacgggtcggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggtttgggccgggatgggaggtggggttcaagggagagtgtaaggggaggtgaaccgcctgggggcgggcaatagacagagtacgggctgggttgacgtgggttggggctgtgttgcaggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcccttttggacagaggccttgtttggggagggggatctggggctaaggctaaggcttttccttcggttccttctctgctggccccagaagccaccaagagatttacagaccaggccagttgggcctccttgctttcctcagtccctgagaagcccgtgagaaacgtgcggaagtaccagtgcaactctggctggccttaaggcttccacgttgggggactgaggccaactctccttgctcctggctggggcatttgcacccaccgctcattcttgctccccggtacctggatttttctgtttccacccaattcgttctccctttccccctctctccagccccttcagcgtatagcagtcgcctagttagggctcagagtggaaggcctcctgagggaatggaaaggactgtgggtacaattaggtctctgcagcagaagccctttgtggcaaggccaggatcttcactctggagaaaggaaagggcaccatccaccctccaccctcctgtctgccctggctgatttgagagaacaaaagccacactagatcttcagactttgggaggaaaagggagggaaggggaggggctgggtagtggggtaaacttggagatatctcgaaatgagaaatgcgaaataggctggcctatttccagctgggtagaatatgtggaaccttcatttcctgagatgggatgagagagactgggactccagacaagtgccatctccagacaagactggcaaacattgccctactcccaccttctcaaacatgcctaggccaggcctatgaaccctgtaactggatccccagaggctagctctggtgaaaggagctgttggtctgctttgaagctctgttgcacagggagagggaaaaatatccaggggaggagaagggagtgaataagaggaggaggggtgctgcactccaactgtaaatatggctttccagttgaggtgagtaaaggtgttggtgcatctttctttcttcaattaccttaatggaaccccataaggataggcaaaaatccttctcaagagtcaaggggaggggaaggaagtctcttagattctctgccccgctagctgctcttgacaaagcaaagaggaccagaagttcctctcaccgtctctaccatctgccaactctaccagaggcccagctactgtgccccttctgaggcatgtctggcctgtcccagtggagactttaaggccctgggccctgccaggcttgcctcatggaggcaggggttcccaaatgccaggtggagttgttctgggtgtactggagtgtcccgccttaatctcagtgaaccaagcctccccctgcgagctcattccactatccctgcctcttctcccctctccttctgacatgtagcactcctccttcgcaattcctagcatgatgcacaacaactcaaggattcaggattccttcccaaagtccagtgatttcttttcagtgcaggacctggccctaaatctggagtgggcccctcacagagagccctgagccttagcccaactgacttcagttgatatttaaactaatttcattttctaggctatctaatagttatcatgcatgttttgttttgattttgtcaaaaacagtagcttgtatatatcagacacaatatatacaaatgttttgagtgaaaataaatatccaggtctgagccaagctgtcaaggagctgaagtcaatttttcaaaatgttttggattccaccttaatgtttttcaggccaccaaattcgtttttcttttctggttattgtttcaccgcgagtgttgactgttcgttaaatgagaaaatggcttccgaggcagtcaggaaatggtgtgtaaaagcctacaaaccaaatatgtttggaatatccaaaagggaaggaccatggcagatctgagtgtgtctcacacattaaggggactctcagcttgttgcaagctggg

SEQ ID NO: 12874 - DNA, 39032 bp, Human
gcatctagggtctaaaatgtaaaaagactctcacgcttgggctcctgggtttacaggactctgatggtgaacttaaattttgcattgctcactgggcaagtgtcttaacctctctgtgcatgggatcctagacagcacctgcttataaggctaatatgagacctaaaagcattaaaatgcaggaagtgcttcaaacattgccgaacacacagactgtatggcttttaaggtttttttttttttgatacagggtcttgctctgtgacccaggctggagtacagtggcgccatcacagctcactgcagcctcaacctcccacgcttaggtgatcctcccatctcagtctcccaattagctgggactacaggtgtgcatcagcacgccgggctactttttttattttgtattttttgtagagatgaggtctcactatgtttcccagactggtcttgaactcctgggctcaaggcatcctctgcctccctaagtgctaggattacaagtgtgagccaccgtacccgacctacacagactatatgtgtttgccactattgtcattcactaaaaggccaagaggggttgatgatacctgcccagggcattctgaaggctgtgctggccaggaggtggggggtgagggtccccagggagggaggaaccaatctttctggagcactcactctgtgcaagtgctgggcacagctggcaccctctcctgtagccccacatcgatctcaagaggcagagactttcacatgcccatttcacagatgagagaactgaggaccatgagcaagaggctttccagcatctcgcagaggctgaactgggatcaggcaggtgcgtcaagcctagtgcttgggtcccttctgcttcgcctaggggggtgccacagggtctgacctacctgggttccagcctcctctctgctgctgttgcatgacctcaggcagccccctctgtttcctcatctgtaaagcgggcatcaaaacagtgtctgttttggggccgggtgtggtggctcacacacctgtaataccagcactttgggaggctgaggcgggcagatcacttaaggtcaggagtttgagaccagcctggccagcatggtgaaacccagtctccactaaaaatacaaaaattagccaggcatggtggcacatgcctgttatcccagctacttggaaggccgagacaggagaatcgcttgaacccgggaggcagaggttgtagtgatctgtgatcacaccactgcactccagcgtgggtgacagagcaagacccgtctcgaaaaacaaaacaaaacaaaaaaccagtatctgtcttggaagtgctgagaacagacaagggaatatgaagtttgtgaaatgttgagcccgctgtgctacattcctgtaaaacacacacgtgcacatgcacacccacgtgcacacacgcatacacataaatgcacatgtgcagatacaccggctgacagtgacagcacacttatgtgtgtgaaatgctttatgtgctcaatttcttttaaatctcacaggaaacacacgctatgaggaactacccacatgcccacatcaggcaggaggaccccggcgggtgcaagggtggaagtcgtctcttcatggctgcacccttggccagtgccagtccagcagcctctttcaaagaagcttttataggcagatagtttgtcagcccagctcgaaatctgaacaaggtagcagccgagcccccacccatccggctgcactcccctgcatgtccagccccgagccctgtgtcaagcacacctccttgggaggagaccgccccagcctgcaaggaagtgctcattatggagagtggagagtgacaggccactcccggccacgtctccaagcaagccggtgccccctcctcctgctgccaccgcccactgagctgcctgggctgcagacgccctggtcggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcatcctctgtgggtgggagtcagccttgaggagaggcgatccctagacactgccttctcctgtaagtgctcccccagaacgtggcaaggcaggcgtcttcctatccgtgtgtgtctgagttgtgtggtgggcagatggggctcacccccaaaaaaggacccttatctgtgaatcaagaggcaaaagacacatcacaaatgtgccaaagaatcgtgcctcacttttgccttgttacaaaagtatgcttgctcctgaaagacagcatctcatttcggaaccccaggatttaaacggagcattccgtctccatgatcagtaccaaatgtttgtgaaatacacttatgcattcatgtggttgtttattcattcagcaaacagaatgaatacactctgttaaacagaatttagcagaaaccgctctggggaaggcactctgtggggtcctgtggatacaagataaaggaggtaccagcccccatcctcaagggtggcgtggccgaggtgcagaggcagttgggtgacaaacgatggcagtacaaagagaaggcatgaggcagtgagtggcaagaaacacatgccctggggccagatgtctgggtgtgaatcgggctctgctgctcattagctgcgtggcttctctcaggcaagctgcttgacgtctctgaaccccagcaatctcatctgcaaaagacagagggatgcatttcttcacacaactatgtctgggtcgccactgtttaccaggtactgtcctaggctgtggggatacagacctcacatctctgcctggggaactcaatggggggctgggggcagcaaagaataaatgagagagatctcatttattagtatgtgcagattgcaagtgctgaggaagcaataaagcaggaagggaactaggagagagaatggggtggaggaggctatcatttttggttcctcccaccccccagagatcacagatccgcagggacggagtgagccaggacgatatcagcacacagagggctcaagaaggtaatgctggcacccacagcacctgtgtgaggattgaatgtctcagtatgtagaacgtctttgcaacatagcaagctggcagtgcatcttggcagctttcaatcaaataattgtgactttgtttggtgttgcctaacagggtagcatgtaggttccttggggtagggcagggttctgtttcactaatgtgtgcccctggtgcctgccattaagttgacgcctggtacattcttgtgggtgaattatgagcggctgcagtggtagcacgggatgcgtgtgcagctcttccccaggagagtcagacagggtttttagggttggggacagtggacctgtggctttaaaggataaataggagtttgccagctggagaagagggaagggagaatgattaatgaccccaggcatagtggggtgcctgaaactgtattgagacaaatctgggcctccagggctcatattctccatgttcggcacatgctcgtggcgggagacaggaggacttcgagaagtggaaagagtagtagagtgacatgatgaggcgcttggagaagggaaagctcatgtgagatggtgtagtcacctaaggcttcctggaggaggtggagaccttgactggatcttggggaaggattaggaattaggaggaggaaggaaattcctggaagaaggctcagcatgagccgaggctcacaggcagaagtggtgcatctaagagctgcttgggagaccagacctggccagaggggaggcattgaggaggggtgagagactcttctcagattttattgactcctccatgctcttctctggtgcaacaggatgatttaaccctcaactgtagttagtagcactttggttctacaaccatagagagattgccaatatgtcatctgattttatctccaccatgtcccaagatgtcataggagccagcactgtgacatccacataggagggtcagggttgatatgcgcgggggatttgggggagtctctaaaacacaggcctgggtgggctgcaggagctgattcacttgtagccaccactggtcaggatgcaagtgctttgaattggctcctcgctgaattgaaactttccctggttatcaacagatattggcctccttcctcagcgcctagacataggtgaggtttatgcagaacaactgtgccagccaggcacggtggctcatgcctgtaatcccagcactttgggaggccgaggcgggtggatcacctgaggtcaggagttcaagaccagcctgaccaacatggtgaaaccccatctctactaaaaatacaaaattagctgggtgtggcggcaaatgcctgtaatcccagctactcagaaggctgaggtggaagaattgcttgaacccgggaggtggaggttatagtgagccgagattgtgccattgcactccagcctgggcaacaagagtgaaactctgtttcaaaaaaaaaaaaaaaaaaaaaaaaaaaaaactgtgcctcagagaaagccctgggcgaagacaggctgttcgcctgtggctcagaggacagggagggctgggaagagcacctggcctggaacttatcacagtgaaatctctaatgtgctgtgcaatcttggaccactcgctgcccttctctggtcctcagtcctcacctgggaaatgaagatggagaacctatgactttcatggccctttcgttcgacagggacttacggatgataggaagcagcccccacatgcacaaagtcgagacttccccgtgaggcaccactccctcaccctacgctgagtgagaccttcagccttggccctgaccctcaagggctatgggctcgtcagagtgaggagatgctggctgtgtgctgaactggcttgcaccccctctggagagccagttttgttccacacagccatgatcacaaactaagttatataaacttacagttaaatcatttgtattaaaaagaaaggaaagaattttttttttttaagacagagtcccgtggtgtgatcttggttcactacaacctccacctccccggctcaagtgattcttgtgcctaggcctcctgagtagttgggattacaggcatgtaccaccacgcctggctaattttttgtatttttagtagagatggggttttgctggtctcaaactcctgagctcaggtgatccgcccgcctcggcctcccaaagtgctgggattataggtgtgagccaccgcacccagccaggaaatacttcttgttagaaatgcatcactttccaattgtattgctccgttttgctattctcttggctcctggggttttatgtcttttgcatccgtgtggtatgaccaggagagaagctactccacatctcttcccactcccattcagtggcctcacgtgggttgcctgaaatcaaccatgctgggagtatttacaccttggaaattggccagggctacatgaggagagctggtggttcagtcctgaccaagcgcagggctgcctgtagcctgctctagtctctcaaagcctcgtcccccggcagagtgagttttgtgtagcggactggtctcttagagtggggccggttaatgtcctgagtgctgtttatgcttcttggtctaagcatgcagagacagtgccagagatgagcacgcttgccttccattcccgtgggaggcccttaggagaagcttctaatgagaagtgccgggtctcccgccttctatctctaagaccttcaggagtttccttctcctatctgagcctcggtttcctcatctgcagcacgggacacagtagtgcctgctttgcagggctcagtaaaaagaccatagagcccacagttccctgactggcacagaactgcattccctacatgtgcactacggacagatttaaaaacccattccaggccgggcacagtggctcacagtggctcatgcctgtaatcccagcactttgggaggccaaggcgggcagatctcctgaggtcgggagttcaaaaccagcctgaccaacatggagaaaccccgtctgtactaaaaatacaaaaaaaattagccgggcgtggtggcgcatgcctgtaatcccagctactcgggaggctgaggtaggagaattgcttgaaccctgggaggcggaggttgcggtgagccgagatcgtgccattggattccagcctgggcaagaagagcgcaactccatctcaaaaaacaaaaaacaaaaagcaaaaaaaaaaaaccaaaaaccccattccagaaccaaatatttatgagaatgaataaaacagaagcagaacgtttgtaaatagtccaataacctttccatggagctcagtcggttctgtggacttggtgtttttggtttttctttcctggcattagatgaaactcctgagaacaatgatttactgagcgcttacactgtgtcagggcaagagtttgccacgtattcgctcttgggagcctctcgacaaatccaccgggtggggcccatggcagccaccatgcgggcctcggtgctatgcagcccctggcctgggcaggctggcccctactgtcagtgtgactgtgggtctgttttcccctctaagcacccctccagggcagctggaaatggtggttcagtttgcaccctgcccagagatgcctgtcctgctgaggggggctgggaggggctagagcagccaggagctggtgccactttctctttcaaatgcatcctgccagacggggggagggaggggagcattgcattgtctatctggaggcaccccctgtgctaatagcagtaggggactgtaggagccagcagtggcccacaacttgcattcctcagttccccatctcctttcccccattatttctgtgagctcttgagagccttccaaacatccttttattttttgctgagatagcaagagtgggagaagcagatggcctggagctgtgctttcaccattccatgagttctgaccttcaccttcatctttgtaccgtaagcatctgtgtctgctggcctgaaggctttctctggctgcaggagcctgctcagcccacacacagtcaggccaaggtgccggggaggtaacacctgtaggagcaaatggagctggagcccgatggcccagctggcttctcaactttggtgggacacgagtgaggagtgttccacacggtttctccaaggtccactgggtttgagctctagtgcccaggcagccacctgctcattaacactccctgaagggcgccttccctttcctgcccagcttcccactccccagctggggcttcctgggatcccctcccaaatgtactccctgcactcgaatcctgtcggatccatgctgtgggttgaactgtgtccccccaaagatatatccaacccctaacttctgatccttgtgaatgtgaccttttttggaaacaggttcattacaggtgtaattagtcaaaataagatgaagtcatgctggaggtgggtggttccttaatatgaaccccgttccttataagaaaaggagaaggggccaggcatggtggcccacgcctgtaattccagcactttgggaggccgaggtgggcggatcacccgaggtcaggagttcgagaccagcctggccaacatgctgaaaccctgtctctactaaaaatacaaacattagttgggcatggtggtgcatgcctgtaatcacagctactcaggaggctgaggcagtagaatcacttgaacctgggaggcgaggtggacgttgcagtgagccaagatcatgccattgcactccagcctgggcgacagagtgagacttcatctcaaaaaaaaaaaggaaaaggagaagagacatagaatcagagacacatggagagaaggccatgcaaagacagagggttgcagaggtcagagtgatgtatctacaagagacacatgagggaccagagaacatgagggactgccagccaccactggaagctgggagagacattgaaaggttttctccttagagcctccacaaaggaaccaaccctgccaaacacctggatctcagccttctggcttccagaactgtgaaagaatccacttgtgttgttttaagcccccagtgtgtggcattttgttgcagcaccctcggacacgaatacagtctgctctgggcatcaagggagtcagcttctgttggttgcaaccggcaacgagacatttcacagataaggaaactgaggccattgcagagaatgacttatctgtgctgttttggctggggacaagtggggctatcactatatccccagagtctgggagctttgtctgctccttgaaccaggtgagctcacaccctgcgggacttcatcatcaagactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggaggggggactggaaggaatgaaaagtccatgaatagctgacttttgagggggaccttaggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaaggccacgggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggcacctctcgggaattctgcgatggcacatagagtccttgtgagtcctctgtgtccccagcaccgagaggcagcctctcagcaagtgtccgctcacggtgcccactccggctcgtgggtcatcgtagcttcacgcccatctcctccgaggcctctccctgaatgccccattatgatttcccttaaatgtttacataagagcccagctcttccttcttagcatttagctctgttgttgttattggcatgatttgtttaggtttctctctaactgcttttgcagatgaccacaaaaagcaattcgttcgccttatctgtgtgctgttgtgtgtggtgtctctgacttgtcctgaaacagccacgtgaagtcagggccaacgtcttctggttcaactcggaactccccatttccagcccagcgcccgaaacccagtgggcctgggaattatgaatttactgttgaatgaatgaataaattatgttaaaaccttccggaacagaatagaagggatggaaagttctagaggactctcgggtgcactgactgacaatgacattgttgggaagacttggtcgactttgccgtctcgtgaatttctttctttcttttttttttttttttggcctccctctgaggaagtcccattaaccttgtgccaaattctgtccccagagcccagtgttaagggccccgggcaccaggaaatggcattcatctacgcacgctgaactctaagcccactgttccggggagcgacatatttttagatgtttgacgtccaaattccagaggaagagcaagtaatgcttagaggaaaactggctttcttcctccaccacgcaaaccagtgctggggtgcatttttattggtctggccgctaagctgctggaactttccaaagaagggtaaaagctcctgcatgtggaaggaagggggtggtgagcactgagggaggcatgtgggtagctttggtggcagctctggagattggattctttttccctaaatggaagtggtttataaattcttctactgattattaaaagaatgatgtttactgtaaaaaaaaaaaaaagtcaggcaacacagaaagttataaattagtagaaatgatctgaattcttcctccaagatgtaaactctggtgacattctggggtgtctgtctagattgtttcatgaagcagttacacacagcacacgtgttttctcttagtggtattttattcgtactgattcagatttcttttattgaaatgaaattcacatgacagacaattcaccctttcaaaggtacaattcagtggtgtttagtatactcagagtcatgcaaccgtcctaactgcctagttttggaacgttcccatcaaccctacaggaaaccctgcagccattagccgtcagtcctccttccctcttcccgcagcctctggcaactaccaatccactttctgtctttatggatctgcctgttgtagacgtttcatggaaatggaatcatccagtatgtgctatttggtgtctggcttattcacactgttttatatgttgcattttcacttaataatctgtgggaagtatgttaacatggtggatcgacatcttcctttctaaggcctgcctggtgttctctgtgccttcacttatgtatccagcctcttttggttgcacatccagcttgtttgctttaattgaatctggacttggacttgctgaattggggttcccactgctgcagcccaaaatgggcatttccccacctgcttcctagggatatcagtggcagaatggctttgcaaatctatttttgttcatctatatgaacaaaaggtcatatagtttcactcttgtcacccaggctggattgcagtggtgccgtctggctcactgcaacttctgcctgcgtggttcaaatgattctcctgcctcagcctcctgaatagctgggattataggcacccgccaccacgcctggctagtttttgtatttttagtagagacgggtttcaccatattggccaggctggtctcgaactcctgacctcaggtgatccacctgccttggcctcccaaagtgctgggattataggtgtgagccaccgcgcccggccaggaatcatttttatccaggtaaggcatacagaaccggagggttcttgtctaagttgtaccatgaatgtgtgctcagtggctactttgaaatagacttactgtacaatccctgagcaggaatgaaaataaaagctggaaatcacgggttgctctggggttttcaggaaggtgtcgtccgtctggggtgagtgtcctcctttctcagggatttcatgtggcattattttgttttcatctgagaggcaacataagctgggagggaagggctgcaaagagggggccaggacaaatgtgtacctgggggcccccattttgactccaccctgagctggggctgggccacaggagggcagagggaacactttgggacggggagggagcccctggactgaaagaatgggaagaaattgacaggcaccattgggaagcaactcccagttccaggctcctgggtcaggaacgcccatggagtaggacagacccaggttcgagtcctgcctctgactcttctcagctgcttgctcttgggcaaatgcttttagtttttttgtgcctcagtttcctcatcagtaaagtgggtttagaatagcagcagccccagagggtgatactgaagattcagtatgtgaggacccagcacagcattggcacacagtaagagcttactaaatgctgcctcccttgccataagcatgaatcacacagcccaggctctaagcctggtgtctgtgtatggtgactgtgtgcctccgtttcctcacctatgcaatggggacagcagtggtacctactggggagggctggaggcgacttcaggtggtcctccgagggcagtgctcttgcacatgctgggtggctgtttccgcatggccccttctcttaggaactctgcgagttgtttgccctggtcttatccagaaatgatgaggttatatccaatcccacttttcactgttgctggtgggtttctcgtacgtgtatctgcagcctcagctggactggagctccttaggtttcttctgcatctgctgagcatctaacctaacgctgtggagatggtgggcgttcactaaatcatctgggagtgaattgagggaggatacagcggaaatgaagaaagactggaagatatgaagaatgaagttactatgggacgagaggcttctgagtccattgattaaaaataaaaggagccaggcgtggtggctgacgcttgtaatcccagcactttgggaggctgaagcaggcagatcacctgagctcaggagttcaagaccatcctgggcaacaaggcaaaaccccatctctactaaaaatacaaaatattagccaggcgtggtggcgggcacctgtagtcccagctacttgggaggctgaagcatgagaactggttgagtctgggaggcggaggttgcagtgagctgagatcgtgcccttgcactccagcctgggtgacagagtgagaccttttctcaaaataataataataataataataataataataataataataataaaaggaataaaaatcaggtgaactatggattagcattgcccgtgctgagccgagcacacgcaggtgtggtctcttttgatcttcaccacagacatcggcagcaggtattacttttgtgtccattttgcagatgacgctcagatacgttagtgattttcctgtatgatcgcacagccatggggttcaaacccagacgcgtcagactcctacacctgagcccttaatccctgtgcaaagcagcctttgatgtataagagatcatgagcttcggtcccttccatcttgggatatggctcctaagttcttgccccaaaggatgtggaggttcagctgtgaaaaagagttaggaagcgttccgagtagaaggaacagtgtgcggaagcctccaaggccaggaggagcagcgaatcctcagaaactgaggatggccgagtccagctttacattttgaaagcatccttcctcatctctggagtgtgggatatcaagacccactcccctaattcacatccgcattaagtgagcataggagtgtgatgatgcttgcccatagcacagccttacacaaacaaaagggctgcccccacacctgtgcaggacccctgctctgcagaacccactgcacagggcccatgtgcagatcagcgagttaatgcatgttaagcacttagaagggtgcccagcaaactgccagggtgtgttgaccaccatcatcctcatcttcatcatcatcatcatcatcacagcttttgttccacccgaagaatatttactgagtacttgctatgtgccatgcactgttctacgagccagggacacaggtaagaacaaaaccaagttcctgtccctaggagggagaaaaacagcaaacaaatgagttcataatacacagtccacccaagggtgatgaggtgtgtgaagctccacaaagcagggagagggggaagggaaggctgtatgagcagatcccgggtaggtgagagccgggcagatatggtgggtgggcggggaaagagccagtgcaaaggcccagaggtgggactgggtggctggagagaatgagtaaggaggggagtgctggaagagaggtcagagacgtggagggggtcaggggagtcaattccagtccgacctctaggccaagaaccttggctgttaactcctttaacccatggggccagggataaattggagggtaagctgttcatgtctctgagtaaaagctatttcccagaactccagaaaacgccctgtgtttagaaccctctttgagtgtcaccttgcgtgacatgaaatatttttcaaaacatgtaatcctttaatctgggcctctcagtgaaatcagtgctttatcactcacgtccatctgttgtttcagtcacgcagtaaataactcgggagatgtggcttctaaggcgcttatctctttgttctctccaaattctgagaatcgacatttgaattttcctctgagacggcggcacagctcaaattgatctctgcgtaccctcccatctgggactgccattaaggaagtcccaggactgggaggcatttgtggtgggtgaaaagtgttttgcttctgatcaccaggttccattaaatttcataaatgaggcttcatcgaaaaataagctgggcggaaaaataagccgccccctcccgacgacgtacggtgtattcttaaccaccctccgaaggaggctggggcgcctgtcatgttagattaggattaaaaattgcggaccccaacatgggtccaatgtagttaattctgcagcaagtgaactgagagctaatggcgtgggattatgcacctgctgcggctggaaagttattggtggtggttacaggggtgagggagattgggcggagaaaggggtgataaaaggtgataaaaggtccacgctctggtctcccctctgtctttggggaaaaccattcacctccttaaggcctcgtctccatatccaccaaatgccagcttagtggtcattttcacttttcgtgaatttaacagccaatgtttacaagagtaaaaagaagggttctctgggtgaagcagggatgggggccaggggcccccctcccaggctttcctgccgcaccaccccccgctcctgcttggccattcctgctctctgccccgcatgccctcagtctcaggccctgaggctccctgggggcagctgaaaacctctggccttggtgattccaccaattcccaggggcacccggcccggacctgttcccagggacctggtgccccctgcagggcactggtgacaccgtgtgcaatttgcagctacccagataggcacgcaggaaggactgcgctcggtcccagccaggcagggacagacacagcctctgctctcagtgtggggtggcgagggcctaaaaatgaagaatcatactagaaacatcccgacgagtctggggaaagctgccctcagaaggctgtttaagctgaggactaaagggtgatttggccaattgaagctgatgggaggccttccaggcagaggaccagcacgtgccaatgatgatcggtggcactgtgctagatgccagcctgagtgtagatgcccgcctgggtgtacactccatcctgagtgtagacaccagcctgggtgtagacgccatccttggtgtagatgccatcctgagtgtagatgccagcctgggtgtagacgccatcctgagtgtagatgccagcctgggtgtagacgccatgctgagtgtagacgccagcctgggtgtagatgccatcctcagtgtagatgccagcctgggtgtagatgccagcctgggtgtagacgccagcctgggcatagatgccatcctgggtgtagacaccagcctgggcatagatgccatcctgggtgtagacaccatcctgggtgcagactcaggataccccaggagggaagttctgtagggagaaactgatgcttgcccaaggtcacacagcaagtgagtggcagagaggatttaagccctagagccgggatttgaaccaaggccgttagctgtggagcccgctctggttgcccgtctgctctgccggatgagacaagctcagctggaggaaacggtttgaagagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgaccaaatccacaggtgcctttcataaagcctctttgggctgcagtttggagaatggatggatttggaggcagcgaggccagggacgaggccactgtggaggcactgatggggacttgggcctggggtggggttcatttatagaatgtgcctggcagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctcttccggtggctgctggcaatcatggtcactccttggtctgtagacgccatctctgcctccctcttcacatgactttcttgtgtgcatgtgtgtgtgcgtgcgtgtgtacatgtgtgtgtggggggggcgtgcttgtgtgtgtgtgtgtgatctccctctgctcccctcttctcagacacttgtgactggatttagggcccactggaaaatgcagaatcatctccccatgtcaagatccttaacctaattgcgtctgcaaagaccctttttcctttgcatttaggattccagggagtagggcctggtgtctttggggacctttattcagccaactgtatgtgcaggaggagacacaggaggctcgaggccctcccttgaaggggtcgctcactggttaaatgcgatggcggatttctattaagacaccgagaaagagtgacaagggagggtgggtgtgggacatagaagcgggggtggtgtggccctaaccctggcctgggagggctggtgtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacgtggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagaggctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgcttttttttttttttttttttttagtggagaaggggtttcgctatgttggccagcctggtctcaaaacttctgagctcaagtgattcacccaccttgacttctggaaatgctgggattatacgcttgtgtgccacagcacctggcccctatatcttatttttgaactttttattaaaacataatactttgggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaacaaacaaacaaaaaatacttcaaagcgtataaatcctacgtgttcagctccatgaattcccccaaaataaacacaccatgtaaccagcccccagaccaagaaacagaacagagccagtcccaagaccacgtgttcccagccagtcactgcccaccagattcctgacttctcatgccagacatcagcttggcctgtttttgagctgcaaatataagtggaatcccactgtggtgttctcttttgatctggcttttttcctttctttattttctgagatgtagcgatgttgttgcatggatttaatgattctgtgtataatttgtaaattctcaaagctctatataaacatggattctaagaaatccacacatatgtacatatacatatgtacatatagacatatgtgtgtacgtatatgtatacatgcagacatatatgtatatacacatatataccacatatattatgtattatgtatcatctctctctcacaccgggtagatacttaagtaattgtccttcagcaaacacaccaagatttgcttatccttttgctctgggctttcagttatttcgtgccgactgttataaaaagatacatggtatcttctgaccttctgagccgccctccgaggctggctctgcctgcttgctgtttctcacaagaggaaacgcaggctcagagaggcccggcgcactgcccacccccttgcaagctccgggtggcgccgggactcgaacgcgcgccccagagctgctgacaccgccctctccccgcaggccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccaggtaggtcctgggcccgagggagggggctgagggaggaggacaggtgaacagagctgtcccgggggaggggaagaaaggagctgggcttaaagctgggccacctgggcgggtctcgggcgcctccactgcgcacctgtgaactgggacgggcgctccttgagcaggcgtggcgctgctgtgcagctgctgtgtgtcccactgcccctggggacttgcgttgtaggagatgcccttccagagaaaatgccacttcctatgaaaatgggatgggggcagggaccctagatgcctccagggagccacagtccagcagacacccattcccgggaaaatgcccgctgataggatgcgggtgcagtgggatttctcatttaaaagatcacgattcgaggcttttctttaaaataccggaccatgttccctgggctgccaccagctggaacctcaggtgcccctggatgaggaggtgtcctctagcttcccactcaccccatcaacccaccaggcccgccacacttctcatgcctggccctggggtatttgaggtggagaccaggagcttagcaatccagatggggcgtgccccagagaggagcgggtgcgtggcttcagatccaccggccagctgtcactttcttgagtctcctctcctgtgaaatgggtggatcacctgaggtcaggagttcaagaccagtctgggcaacatgctgaaaccccgtctctactaaaaatacaaaaattagccaggcgtggtggcaggagcctcaaatcccagctacttgggagactgaggcaggagaatcacttgaacccaggaggtggagcttgcagtgagccaaggttgtgccattgcactccagcctgggtgacaaagtgagactctgtctcaaaaaaaaaaagaaagaaaaagaaaagaaaagacaacgtgcagctcacggtggacctgccactccaaagtgctcagcactgcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccgtcggggacagtaagtgcggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagcgatgacaggggactcagcacacttaatcatgctcataattacagtcttataatgctcatcaagacagacagggactatttcagtactgcctctgggcaggaactggccgctgctccaggccaggcagcctcctactcagccttcataagaaaacctaaatgttgcccctcatggtggacaagcacataaaggcactcccctctgggtggacttatcaaaaatggtgccccttcctctggaatgtgacctgacatagggattctagccttgcctcctgcctatagcaggtgcttttgagcagtgcacagatgatacaactgtacatggcattcccaatagccttttcatacatcatctcgtttcacgctcacacagcttgatgagatgactgttatcagccctgtgtcacaactgaagctcagagaagctgaatcatttgcccaaggtcacacagcaggcagacctgcagtttccatccagttgtctgactgtagagaagtgttcattgccttaggccgtgagtgtgggaatgtggagcccctgccctggcacctgtacccacgtgtggggtccttcattgccaggaatatcctcccccagacatcccatggctcacttccttgcctcctttagacctatttccaaaggccacttttcaggaaagatttccctctctcaatgacagcccctccttggccatttttaaaccctccatccctgtttaatttttctctgtagcgtaatctggaagactgtgttttacttgtttgttcattgactgttctctccccacttgaaggtcagccccacagggcagggagtttgtctttcattcactgctgtaaccccagcatctaaaacggtctctgggcatataatactcaataaatattcactcattcattcattcactagccagcaggaagagcaatcatactactagtgagtaataacaacaatgctgtctaacaccagatttcacaatcttggcatattgacatttgggattggttgattctacttgctgggcaggggggcgctctcccgtgcactgtaggatggtcagcggcttccttggcccttccccaccagatgccagtagcaacctctaccccaagttgtgacaaccaaaaatgtctctaatctttcctaaatgctctctggggaacaaaatcgctctgcattgagaaacactggtctaactcaggccctgttccaggcaccttacttcttcattgccatgtggatttgggtctgtccaaagcagacccagagacaaggacttgggcccaggttgtttatttgggaggtgatcccaggtagttccagtgaggtcatgaagagctgagaccccagggccaccaggcctttaagggtcttcaactagagtaatggggagcccggaccaagtttcactactccaaacatttgcttatttccctgctgctcagaagcctttgatcaaggcaaaagagaatacaaacagcacatattactacgtttcccacctgaaaatgtttcctaacacgtggtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattagtaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactagcttgaacccggaaggcagaggttgcaatgagccaagattgcgccattgcgctccagcctgggcgacaagagtgaaactttgtctcaaaaaaaaaaaagaaaaaaatacagacttacagtccgggtgcagtggctcactcctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataagaagtaaataaataaatagaataagaacttacagtaagaaaaaaaataaaacagtctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtacccccgaacctaaaaattaaaaaaataaagtattagttagagaacaggctatgctgctgcaacaaaaagacccataaatacagggacccaacctgtgaggcattttcttctctctcagctattagtgcagagacagacatttgtggtaggcaggtagctctgctcgcaaagccatctagggacccagcttccttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccagcccacagtgaaaggttctatcactaaaagcaaagggtgaaggtgtgccaggaaccatagttatttctcccatggggagcctctgtgctgtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgcagaagggctgatggctgggggcttggccagaatcaaagcccagtacagaataagggcttcgactctccccaagaatggagcctcctcctggatggagaattgaaggggagggggcttagggttggttttcaaattcctagaattctagggggttcaccgctctctaatgatgaagcctccccgggggtgggggaggtaccaggaggcagagggcagtttctggaaggaacagcatgcaggtcgggggcctggaggcctaggaggtgcgagcgggcacccttgcacacctgtggctgtgcttctgactccacgtccatctgtgtgttgtgtgactgtgtccgctagagtgtgcggccgtatatgcaactgtgtggctgtccttgtgcctgtggctgaatatttgtgtgtgtgtgtgtgtgtgtgtgtgcatgcaaaagtgtgtgactgtattgtgagtgtacatgtgtgggtaagcgtgtgtgtatgtgggtgtggatatgtgtgtgcaggatttgtgtgtggggatgcgtgcgtatatgtctgtgtatatttgtgcgtctgacttgcttgtgtaaatgtctgtgtccccatgcgactgtagggctgagtgtgtgtttcagggtgtatccgtgaacatgtctatatggatgttgctgagcctgtgagagtatgtttgggatcaggtgagcttggactgcctgtgtttgtgtgcgtgtttgtgggtgtgcacgtgtgccacatgccgctgagtgagacccagggcctagcctggaacctggggtacagaggcgaggccgcctctctgggtgaggtgcgttccctgcacccgtcccgggagtctgccttctagaccctagcatgtgcacctgtcctgggagtcggccttctagaccccagcgtgtgtccctcctgcagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcaggtgagtgtggcaccccagccctgatcctggctcctgccccagtccccttctccctgtaagcgcctctcacccgcatggacgacctgccccaggaagcagccccagcacctgggcctgactgagagctcctcacatcttccccctgcccggctccttctttcatggcccctaccctttccctgtcacactagcatgtgaccgaagctcttgagccagcagactggctgcaaaccccagctctgcacctcccagctgggcgacactggggttaatttcttcctatctctgagcctcagtttcctcatctgtaaaatggggctactacatgctgttgtggggcgtgactgaaatcataagtgcagagcagtcggagcagccctaaggaatagtaggtggtcagtaagcactggatgttttatatccacgtatgtgtagatggaccccgacttacgatggtcaacttaagattgttagactttacgctggtgcagaagcaacatgcattctgtagaaactgtacttcaagttcccatccaaccattctgtttttcactttcagtatggtaatcaaattacacgacacattcaatattttattataaaataggctttgtgttagatgactttgcccaactctaggctaatgtaagtgttctgagcacagttaaggtaggctcggctaaggtatggtgttcagtaggttaactgtgttcagtgcattttgacttaagatattctcagcttgtagggggtatatcagtacataactccattgtaagtcaagaagcatctgtatctgttttcaaaatgcattgaattagaattgtctgagaatccttaacttccagaacttctgccaggactgttcagtttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatgaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccctgtccccgcttcggcatctcatagccctaatagctaaggacaggaccctcagacaagattggtgataattacagtgaccctatttgccgaaagtatactggggagtgcatgatctgccaaaacctctttttttttctgatttgagaatgtttttctctgaagtgtttcaagaaaggcatagacgtaaaatcagtcatgcatttaatgtcattatcattgcagataaagtgatgcaaatcccggaatcctgaactttgaagaaattatctacaaaaggctttgaaacaaagagatgcctttttggtttcctctacattccacttgctatttgcagggctttgtttggggttatagggtggcttctccagccagatagcctgggctgccacagctactcagccccttactgctgtgggcagcaaataacataaccttttcaggcctcatttgccttttctgtaaaatgggttcataatacttgaggtacttcacagggctctttgaggagtgagttaatctgtgtagagtgtccatcaattcacaagcacagtaaacaaccttcactgttttatcactgcttgtctctagacactcaatcctgccgtgggtgggtggggtgtatggtcctttggaggtaaaaccgcaagggcctgccagccactgtgaggctgctggagtgtggaagggatagccttttccaaaagagagctgtggggcgagttgcgagttcgttgggctatgccaccatttataataatgacggcataataggaatgccttgggcacttgtctttttcatcccctgatcttttcattcagccctatgatgtctaagaccaaggtcaaaccaagtcaaactagttcttaagggttcaaaccagttaaaaaaattcccatttcaagacagagctaaggaaagagggtcagtcattcagtggtgaccacaccagtgatgcctactgttaacatgcacctttggagtgctctctttaaattaagctttgctgcaagcctgcaaaaggagaagtagaaccaggaggcagtgctgcataggtttcagagtgcaggctcagaaccacagaaagaagtccaaagcctgtaactttcttcctccgtggccttgagcaggtcacccaacctctcttagcctcagttccttgatctgtaaaatagagatggcgatggtaaccatagtgactacttcatggggtagttatggggcttgagtgagagaaacacgtatgaagtgcttagaatagcacctggcccactgtaggtcctcagtgaatgtgtgccaccatcatccctgtcttcgtaaagggaggatatgagttcaggaatttacccaaaagatgcagagctggaagagctggaattccaagactgtccaccagcctcagagcctgtgtgtgtgtgtgcgtgtgtgtgtgtgtgtgtgtgtgtgtgtgtgtgagcttcccctcccaaatgaacgatttgaggcttccaaatggaactgtaagtggaattccccctagccttgttctcagggggctgacacttagcaataattactggtaatttactggtaattatatataggtttgaaaacattttgaattccagcaacttcccttggagcaaaaatctcaggggaagggtggcccccttgtcccagccttaccaaggaagaagctttttatttaagtttttaaaaactgcatatttgaaataatttcagacttataaaaatgttgcaaaagtagtaccttgaatcccccacccagattcaccagttgttaaaaaactaccgttacattttcctttatgctctctccccacttataaatctacgtgtgtatttttctggaccatttgagagtaagcgacaggccctgtgccgacacctaagatgccatcctcccgtaagagaggcttctagcgggtaccaatagtccttcaagtttgaccatccagcacctggaaccaggcatttgaggggttcacattttatgcaagaggaaaatgaacactgacatgtatagtaaatctggtttttcagagagtgggttcagggaaaatcggtgcatttttctgagtaggtttgaggtcacacagaagctgagctgcgggggctggcccctccttgtcctgcccaagacactgcttgagaagaatgaagtggggcttgtctagccttgagtgggaggcaatttgagaaaagtgacgagtaatcatttttggtaataaattataagtgattatatttggcctgaggagggggtccggggtccacatttacctctgtctccttgtggtgttatgggccagaattcacccccaggtaaagggggagcaggaaagttttggggagctcccccagcctacaaaaaccttagccatttgctttggaaaatagttattgctgcagttgctgatcagcaggcgctgacccaccggagggcctggagcggttccatggagcgttagcaccttgaccgataaatgtccgtgctggtcccaaacagcctgatgatttttagtatggccacaaaacaaaagaaaaagaaaatgtctggctaccgcgcatatgtgcttgattaaccttatagcagaaaaggcagcgctgatcaccaggatggagaagtgagctaaatttgagagagattgccacattcaagcatccacatgtcctggtcacattcctgtcagcaaatgctttcctgctaccatggggtgggtagcacggctagtcatgggacatgcatgaaattgccagcagttgaccactttttacacacaaagatagaattttcatacggctcatcctaatactgcatagatatgttttaaatgaaattgtttcttttaatcctcacaataactttaagaggtactaattttatgcctatttttaggagaggaaactgaggctcaaagaggacgagtgaggattcatactcaagttactttgtcatttgcagtaatgacatcagagtgtctcttgggcagactcaaaagagtgtcatctcttccccctgtgaacatattttgtaatgacatttactcaacagtgtgttgaaatttggcttccagttcatctgttaagacaatggttttggccgggcatggcggctcacgcctgtaatcccagcactttggcaggctgaggtgggtgaatcacctgaggtcaggagttcgaggccagcctgaccaacatggcgataccccatctctactcaaaatacaaaattgactgggtgtggtggcgcatgcctgtaatcccagctactcgggaggctgaggcaggagaatcacttgaacccaggaggcagaggttacagtgagctgagatcatgccactgcactccagcctgggcaacagagtgagacttcgtctaaaagaaaaaaaaaaaagacagtggttctgaaactttttgctctcaagaccgctgtaccctgaaagatgttaaggagatctcacagggctttcctttatgggttgatggctctggatattatcatattagaaactagagctgagacattacaaatgctcatgtagcctctgaacaattccattgtacactagtgagatggtgagactgaaaaacacaagtaattcctcagtgttattatgacaacagttttggccttctaaactcctaaaagaagttttttcctctcacttgttttccagatgggcgaatcctacgacacaaactttacaaagaatatccaggtaaaagaagaaactgttctttctttccagagggcacaaaaaaaaggcagtgaacgtttcttatgtgaagaaaaaaataaaagcccagggctgagatatagggaacaaaatgggacctgggattaagaaacaaaatagaagacctgtggtctgatggtgggcagggagttgtgagtcacagaggagctcatggtaaacatgacctcatgctgaagagcagagcctggaactgctcatatttaagcctctgctactttcattcagagaattggaaaacatgcctgataccactcttccattcatccatctaatcatccatcgatccatccatctctccatctattatttcatccatccattcatccctccatccatctacccacccatccatctacccaccatccatccatccatccaccgattcatccatccatcctctcattcatccattcatatatccatctattctttcatccatcttcctgttttttcatccattcattcctctatcaatctattcatccatctattcattcttccatccatccacccattcatccatccatccacatattcatctatcttttcacccacccatctatccttttatccacccctttattccttcatccctccatccatccgtcctttcattcacttacctattcaccaatcatccattcatctatccatccatccattcatacatacatcctttcacttatccatctatccacccatctacctttttttttttttgagatggagtctcactctgttgcctaggctggggtgcactggagtaatcttggctcactgcaaactctgcctcctgggttcaagcagttctcctgcgtcagcctcccaaatagctgggattacaggtgtccgccatcatacctggataatttttgtatttttagtagagacgaggtttcaccttgttggccaggctggtcttaaactcctgacctcaggtgatctgcccgcctcggcctcccaaagtgctagatttacaggcatgagccactgtgcctggccccatccacccatctgtctatccatttatccatccatccactcatccatccacccacccatctatgcatccacccaccatccatccacccacccattcatctatccattcactcattcatccattcatatattcatctaatctttcatccatccattttttcaagcatgcatccatccatccattcctccatcgatctattcatccatctgttcattcttccatctatccatctatatattcatctatcttttcatctacccatctattattttatccacccttctattcctttatccctccatccaaccatccttatatccactcatctatttgcccgtacatccattcacccaaccatccatccatctgcccattcatccattcatgcacatatccttgcattcattcatctatctcttctttcatccattcatacatccatccatccacccatccacccatctacccatccatccattcacctatgtatccattcatccatccacccatatatccatctatctattcagccatccagccagccatctatccatccatccatccatccatatatccatccgtccatccacccacccatctatccatccatccatccatccattcatctacccatctatccatctatccacccacccatatatccatgcatccatccatccatcatttatccattcacccattcacccatccatccatccatcatttatccattcacccatccatccatccattctcccatccatccgatatgtctttatcaataatttacagcacatattttctaagtattactcatcagtctgtgctgggggttggagctacatttgtgaacatgacagacccagtcgctgctgtcatgcagctaatatcaagcagaaaattcagacatgaatatagcccaagtggttattttatgagaatagtgacaagccttcctgacatcacatgctggatactatgaggacaccttagtccaggttgtgagaaaaggcttcctaaggaggagacatgaaagctcagcctaaagaataagaaatagtgggcagcagaatggcatgtgtgaagctcttgaggtcggaagcaatttggccatccccaaagctggagtgtgtggtgagctgtggaggtggtgggaggtaagaccagaaacatagacagagctggtgacaccagctggggggcctggggagggagaggaggcactgcaggtggggactgagtgaactcagctgggggagggaggagagggccaggtcaccaggcttcatttggcagttcctggtgagccacgggggggcattagagcaggaatagatacatctaccctaacagagctgtgttcttttcacagaaggtgactcaaagaatgtggcagaacctggaaggggacaacagaggcactttcagtaaagcaacggcaagcaggtgagtgggcagagagcaagagtcatggccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctaggctcaagccatcctcctgcctcagctttagtctcagtagctgggactacagacatacaccacctcacctggctaattttttttttgtattttttgtagagatgagttctcactatgttactcaggctggtcttgaactcctggcctcaagcagtcctcccactttggcctcccaaagtgctgggattgcaggcatgagtcactgtgcctggccttaactcttgtttatatccattagcctatggtaaaattgtttttgttatatagtaggtcattttgcttaaagttgcagtttccaataagctatccatgatgttaaatgaggacctactgcaatttcaaggcaggaacgtaggagaactttgtgtgtgatcagaagcagaagcaattctgtatccctctgaatcaaaaatccaagaccagactaggtcgcaactttccttttcattcctttgccttgatgtctccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttcgtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcataggtgcatgcaaagggctgtggagttgcagccctaaacctgaaaatctacccagcccctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatttcaacattttgggagaccgaagcaggcatatggtataatcccaggagttcaagcccagcctggcctggccaacatggtgaaaccctatctctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcctcctcatctataaaatggaactgatggtaggggaggagttaggaactaaataagatgatgccgtgaagacgtcacagtgagttcagaattgggtcttctcagaaaggggcatcttcctggtgtttctgatggtggcggtggcggcggggagacgaaagatttgtgactctgtggtctgccctgcagtggttcaccctgacccttctttgtctctggtctgccctgcagcggttcaccctgatccttctttgcttgctttccagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccgcccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgagtctctggtgttttgtgatactttgtcactgtttaattcaggggtgggaagcagcgtgggtattgctgggatgaggtgtcagctaggctctgctcctggaaccctgtgttagcatagagcccctgaagcagaccttgggagggggatttgttgaaagtgattcattagggcggttcctgggaaaaactggcatgagagtggggaagcggaacaggaggagacagtcagacgagggagaggtgacgagggcccatggagggcacctttgctgcaatccctctgggggtcttggaggaagcctgagtcccaccagggctggctccagggctgtgcatccagaaggaccctatgcttggtttaatgatctgctgtcaccatttaaaaactcttagtcattgttgaacaaggggcctgcttgttcattttgcaaatgatgtcggtagccctgagccacactgtggagtcggtcccactggggctggacagcggaacccgagtatgcgtaacgcttccagcacccatcagtgggtggcgaggctgcccctccccctaagagaggaggcagcccacctgctgccagggagggagaggcacaaaggcacccaaggggacatcggcagagcccctggggcaccccggggctctcccattaaatcatgggtgccccacctgtgctagacggcttgctcgcactggcctggggttggctgaagtccccagggctcatcagagctgaggacagaggccctaagggactgtgcacccccagctagccacatacagtggaagcaaataattacaagcagcagagactccagggggcctggcaacgtctgtgcatctctcagatgaggaaactgtggatcttggagatctgaaaggacccacccaaagctgtgaagtcagtaagagccaaaaccaggattccgagcaggcagtcccaccccacactcaggctccagacagcctgctcttctgctagcctggcctgtcggagctgactccctcccgccactgaggtgtagaagggacgcctgacagtgtgccatcctgcggaggactctggagtggaagggactgggctgagctcatccctactccctggagggctgctcactagatggggtggagacactagagcctgttcagcctgagttccaatcctgggcaaggcacttgccctctcagagcctcagtctcctcttctctgaactgggtgtaataaaagtagctggctttcagagttcctgtaggtattgcgtgagatgctacatagtaagtgctgagcacacagggatggttataattattatcattagccgggcacaatgcacactaattctcttaatacaaaacctcgtgaaaagagtatgaacatccgcattttccagctgtagaaattcagcctcagagaagttaagcaagttgcctaggctcaaaaagaaagcaaatgacagagatgggctttgagcccagagcttctgatgcccaagactagacaggctggtcctaccttgtgttgagtcccaaccaccagctgggcggccctcacaggttactgaacatgcctcagcctcagggtccacatttctaaagtgtcaacgagaactccaacctcattatgattattactgtgaactcagtcacgatcatatgaatgggactggactgtcaagatgcaaataccaaggcaggaaggtggtcgtatactgccaagtggtcaaaaataagacctgctttctgctttcaaggagcccaagtccttgagggagtgagagaaatgagagagttatgatccagggtggggaaggcacagatgggagcaggggccggaggtgccaagagagcccagtgagggatgctaagccaaggcagaaggcagggaaggcagtaatcagggaagacatcctggaggtggtgatgtgctagttggtcataatatctgaacacttctgggaacgtgtgcatttcaaggggaactgctgtccctgtt

SEQ ID NO: 12875 - DNA, 30291 bp, Human
  misc_feature (1)...(30291): n = A,T,C or G
ttcctccactgggaaacactgcatggggaggtggggagaggaccaatcatccattctaagaatattcaggagctggtgttgctggctttcattctctcttccctttctgaaacctggaagtatcctttttcacttttcagctaaaccatgtatttacaactattttcaacacgttttaaccaacatttccatgtttgaagccaggagctttagttgccattttgccagaagttgtttcagagagttttttttcacaaaggaaacaggctattaaggcaacttctcaagaacaggccttcctggatccctttcctagctgtttttagactttagagataccataaaatatttcctaacattattctttcattaactgtaataaaataactgagtgtaaatctcagcatattcaaggatatatttatttttctcctgagtttattaggcaacacacttttaaacacatacaataaatacaatttgaagtgcgtgctttatatcttgcatgatgtcgtttgtgttcttatgcttgtctccattagtctattgccatatagtaataaagctttatcaaatcaaacctttataatggattccttgaagatacttgaaaatacttcatagccaatagtttttacacaattggtttttcaagcaatgaatttccatttaaataaaatatggatttacaatacatagaaaatttacaaggagttataaaacagtgggaaagtatgtctagcctaaacttttgtgcatttagtctaggaaaatttcacatccctctttccacacctataaaaccaaacagaaccaggactgacttgaggaaagcaattatttatctctgctgtgtctaactaagcaagctgccaaatgtgatcatttgcctgattggaaaatcacataaattaagactttgccatcaactttctttcaagtaaggaaagaaaagcatttcaatatagtaatgcaaaacaagtggaaattgttattgaacatttacttggacgggcactgtggaaaattattccttgtccaaccacctcctcagctgtaactggtagcacaattcttgacccattttacagattaggaaacatgagtttccagagtttattggcactcacgtggctgttacatcgttttgatgttcaaacgacctactttattcaaagtcaggtagtacagtctgctggtgggaaatacagtattactcaagggacttcaaaggaacaagaagatgtttgagttgcacagtgagctaaattatgcaagttgcagaaatcctaggtggatagtacgacacctttcagatcagtttctaccctcaagggtggcaacaaccttgtagatccattatggattaggtttctaaactgttttggtgttatgaacccctagagtcttctggggaatccaatggacctcgtctcagaataatgttttacaatgtatagcagaaagaagagaaattatattgaaatacacttctggcatttgaccccttaggatttttccagcatttctactctgcccacctctcctctcatgtctaccaaagagactttctctactttattcagaaaggtaaatgagagacactcaaacaggtctgtaggttatgggagtagcagggagtatgggatgggctactgaggagctgtttttgaggtgacatcactgtctcccttcctttttcccttccctctggaagcctccttacttctccagctcttccttccttccccacatcaagtccaatttttctccttttacttcttgtctatcctcctcactccttgctcagccccgcccgcttttctaggcccgcccctccagggccccaccctcaggccgctcctccagtctaggccccgccttctcctcagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaaggtagcggccaacccgctggaggaccgcggggcctagaatgcgccggggtcgacctccccgcagggagtgcggggcggcagtcgcggaagggacaggggcgggtcttctccggctcaggaaggagctccgcccggaccctgtctcaagctctggagctagcgcaggggcggtgcctccaagtgactgccgtgcagatccaggggagttggaaggtcacaggagttcagcctcaggtcaggcccgacggggcatgtagttagaagttaatgacagttgaaacgtgggtcagctggttcctaggcccgtgcacacgtctgcaagggacgttgatcctcactctccaatgcgtgtcagtggcatatgggggctggggtgggggaggggcggtatcttagggcttggatataggaggaaaagaaacagaacttttcaaggactggatgtgcagggtggtgtcaggggttgccgagaagggccctactgttttagtgactcgtttcttttggttgttgccccttccttccaagttgctcttaataagttgagtccgaatcttcaggcaggagtaaagatgtaggaggaatgggattggttgttgaagtctttggaatcaggtagccatccaggtggaaggcattgcccctgaggcctgtcatccaaggcttgtcatcagttgctttgtgtaatagtcgcagcatggcaagtaggttaaaagtcgcctgcaggtaatgtgggtgaaactgaagtttcctaatacaggaccaggatattatagtgttagagttaggaggatacctcatgctcacctggttaaaccccaggtttcataggtgaaagcaacaggcctcaagggtgaagtcactcctgaaatggcccagataagtgaatagcagaggtgggattggagggttcatgatcttgtgaatgtcaaacatgtggttgcctttttaggcacttgcatttttgtttacatcaaatatagtgtttttatattttaaaacagaaaacaaacgtttgcaatatttagaagttgctcacctgttaaacaggaatgaaaactctgcctgtctcattgcaggaatgaaaactctgcctgtctcattgcagggttgttagggggttcaaatccaatctgtcagatatgtgtgaaaatttgatagctgtaaataactctacaatgcacaggacagtgaccccatacctctcccggggaagaattatccagtcccaaattgtaatattgccaaggtcaagaaaccctactctaaataaatggagaatataggtattatgaagaaatttcctgtctaaatacatatatatttgctttggatgcagtccgtccctctccagttagtgggactgtaaaacatgctatttggaatacttacaaattagtagggctggcctttacataatccagaacacagcagatactgcaagtggctaagctgccatatttactttttttctgtatacagatgttatatcttgatggattactcactcaacaaactctgaatgcttgctgtgtactaggaccattgggtttaacaagatgatcaagaagttcacagtctagaacaggcagaattaatttcttagggtaactttaaaaggtaccttagtttgaaaattgatacattttcagaaaaagtctttcttttaatttttattttttagagatgaggccttgctatgttgcccaggttggtcttggaactcctgggctcaagcagtcctcctgcctcagccctcagcctcccaaagtgctgggattacagggatgagccaccacacccagccaggcaaaattcttttatcttctctgctattccatttttcttaccagccacatcaaggctttggccaagttttgttgattcaactgctcagacgtgtctagcatctggcttatttcctcccattttctttcctttatctttgctactttgggtactcagcacccctcacttagaattgcagtgacctcttaactagtttttggcctaccagctctctgctcctgtctatcctacaccttccagtgcagtcaaacatctgagaagcagtgatcttatcactaccttttcagtggcctatttattgcagaaataataataatcatcactgtaatagctaacatttattgcatgatttcttataattcaggtgctaagtgttttggaagtattgatttactcaatccttgcatcaaccctatgataaggtactatgatgatcacctttttacctatatataaatgaatgcatagaaaggttaagttggtttctcaagattccagctaggatccaaacccagctgtctgcctccagtcctgtgtcttcaacatgctcctgcattgcctctccaaacagaaggcaaatgctgcctggtgggtacactgaactaatttggtctcaactcacatttccatcattctctcccattaccatagacctgacatcttctcctctagcgagcccagaccgctgtgccatcttccctgtatacagacaaggcagttgaggtccagggaaagtcagtggcatatacaaagcacacggctaagaagtggtgaataaaactgggatttagatccaagtccatctgcccatgaagcccctactctttccccaagccacacacactctttttctaataaagcttccagcatgtgggatggaccgtcttaggagggtgagtcctcattattggaagtacagtactgtgttggagaaaaaactcaaactgtttttttcattatctcaacatcaccaacaacacagaagcacagaagactcctgtgaccaaatgtctgaggatttctctccaaacaccaagtaagcagtcagttttgcggtggacgtcagctaggtgtcctcctgttcagtgttgacactacctacctggaaatagtgtcagatcccgtaggttgaggtcccagtcccacaagattaaccccctcttccctgccacttgtaatgccagttgaaagccccaggttgttttacctgtgcttctgaccaactggctgtaaataggggatcccatgaccccctccttggattcaattaatttactagagaggctgacagaactcagggaaacacttgctttcatttactggtttattataaaggatactacaaagtatacagatgcataagatgagatatgggggaaggatcttggaacttccatgccctccttggatgcatcaccctccaggaacctctatgagttcagctatccagaaactctctgaaccccctcctcttgggtcctttatggaaacttcattggctaggcatgattgaagcatggacaacagtgttgaaatatgactggacagaaagggtctgatctcatattaatagactgattggggaaacccaagaaggcctgtccagattcttctggcctctccatgcgacattccttcttccagggtatgaggcaggaccctccctggaatgaagttcttgcaactcttggctcaactcctgaggcctaaagtgcaccaacgtacaaaagactgtaacgagggctatgagagttatgaaccaggaacagtggatagaaacctgtgtgcgcgcgtgtgtgtattggatgtacagtactggagtatgtatgtgggtgtgtgtgtgtactctatgggcaatacacacacgccggcgcacatatgtttacacacatgtgtgaatgatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatacacaagcatgtgtgtgtgtgcatatatattctaatgcacactcaatgcatgctcaagtttgagattctaatacacactgaagtttgagaaccattctgccatgtatcatttcattcaatcgtctcaacaactctgaaaggtaagtagtatcctggttttgcaaatgaggaaactgagacacacacacacacacacacacacacgtatgtatatatatatgtggaaaatactatatgtgtatatatatacacacacatatagtatatatgaatatatacacatgtatatgtgtgtgtgtatatactaatcacactcatcaatgaatgtgatccacgttctcatcaatgaataagttctatgttcatgtatgtatgtgtatagatagatagatagatactcttcttttttatgcattatatttctaaccagctgctgaatgatgctgaggctactggtccgggaatcacactttgagaaccactggtggatggggagcatctagcatggtgctgaggcagttctgacattgagagctaaagtcagaggcaggagaataccctagagatgagatgcaatggaaattgaaagatgaaagtgagaccaaaaaatgtcttaagacaaaagcaacatccattttagggctccctctccctgatgtttaagttagtggtcacttgggagtaaatgtggtcccctgagcagtgctgagaagtttccctgagagaagggccatgggtcactgagaaaagctcttccagtgatctgcaagtcaggcccttgcaggaacttcaggcttcgttaccatgccattaaccactgcccatagagtgtggaaccagtgcgcagaggctcacagcttcaatttagagaaaataaatgttggactgaaaagctctggctgatggcttgacttattaagtttttaaatctaaatatctggcactgtgagaaggggcagcctaaattgtgtttttgtccttgaatagggcttctaatcaaagagtttggtgaggagcagacagtactttcccagggactgttcttccctgtgctcttgacctactaaaattctcaaagaccagcatgactggaaaaactgcatttgggcaggctgggctgagagaaagtttggcctttagagagaaacacagatccatctcacaggagaagagatttcactctatagatgtgaaatccctactcctatttccccagatgggataataagccaattagcatcatgagccccattacttcaggattgtaaaactgttctgctcctttctgtcatccttctgattaccagcgtgattgatagaatcattcttgagccctggtcacttatggagctgaaatttacttgtgggcagagccaccatgtctccaggacacccgtctgcggcattctacttcccaccatagaccaaggccagctccttcttttctgtctcccttgagtgtgcaactgggtagataagttagagtctcagtttttccctctcctcgcatctgtcttaggataagcctgtgggtatgaggccatgcgagaatgctggtctcaaggttcagatttggtggaaggaggggagaggaaggagtaagatgcctcccttctgtctccaggtataagccaagctttatgctctcactctgtctttcaccagattgctgtatggcgattacaggaggtggctattaataaaacaaaacactgatatttcattcagccttgggaatcccttgagaagagagatgacttgtagggaagggtataggcattctgaatgcttggacataataccataccaacatctggagtgaaccagcaggtgaatctggggcaatgctgaatagaggttcttgtctctatacatgtgccttttctggacattttgcagaacatctttaagcctcagttttcctgtttgaaaagtgggtttactgatggtccatacctcgtatcattatttggattaagtgggataatccatgtaaaagcacttggatcagtgcctgctgttcagttaatactcagtaaacatcagctatgagtattgttttacccagctgtgtgcaaccctgaaggattagacctatcacattttcttagagaggtcttaaatattaaatcagatttagtcaactatctgtctttgtagagtcttggcacatacttcccagcagcagctgcacctttgacttctgccattagaactgctttactttgatgaaaaatacttatttttcataccatctgagtctattacttgccccaaagtggatggacttggacagcttttagataaatagattgggggtgtttcctgtccctctgaggaatggaaatgagcgcttctgtgagaggcaaagagaactcaatgcacactcatgagtgcattcacaggatttgagaatatgtgatttatcaagaccaccttgtagttagtggtgtaaattcagataaacaccataaattggaggtaatgagtggtgcctttctccaggcctggatgggtgatgggacatctacaggagattactcctgtgtggggattgcaagtgtcatttgcaaacattacgacattttgacacatctcatatgtaaatgcatagcatctctttcagagtttattctgtttgggacaaataagtgtactgttgacaataatatttctcagaatactttaaccttgtaaatataattgaaaacaaattgcacagctgttttttttcacgcatttgaatcaccattgctgagaaatataccagtttaatgtttcgacaagttagccagcacgatagcatctcaaaaattagtgataacagtaacagatttcctggccatgcattcccctgtctccagcctccatttcttcacttataaagtggagttaatgatgcttacatcacaggattattgcaagtattcatgattaagcccagcctggcttagagcaggttcactgtagatattggttttcctgaaaatgtacattacagttctgaatcccagttctttaatctggaaaaaggagattatcgtacctaccttgttaatgaaatagtaacctaccttattaatgggaatgatatctaatatttactaagtacttattatgtgcaccacataatagaactttagatggattatctagtttaatcctcataatcattccatgaagtagaaacttattagacccattttgcaggttagtagtggaagaggttagattctacccagacggtgaatctgagcccatgctattaccaccacactgtcttttctgactagcttttctgatttatgagacagcactttggaatagtatatggaaaaacttggcacagtacctcatctgttgaaagtgataatattcatctttctctatacctgcctttctcctggttcctttctgaacccttcagaagcagcatctaaaaaaaaatacttcttctggccctttggaggcctgttgggcaaacacaccaggcttagggactcaggggagcatctcagtgggaggtccgttctgggtggcctggagcaggagtactggcttagggaaggaaagggttcccatccaggctttgccaccaacagcgtcatcagctgactcttggcaagtcactcacattacacagctaagctaagaccccttcctgctctaagatcctgtgtgatgggtcttctttatctttatcattagtttgtggtctggaacaatgatttgggaatgacatgcagagaaaatacagctaaataaggagacattgtagggaatagaaggggccagtgtgcaaagacacaccatttctttctgtctgtcctgttactagctgtaggacttaggcaagtaagttggcctctctaagcatcatttccttctgtaaaggtagagataacaccaacttccctatctacatcacagggctatcttagctgttacatgagagaatgaatataaaacgttggaaagtggaccatgcttagaaaaacaatgactagtattattgaaagaatttgtagcaggtcaaagggattagaaaactccttcaaatacaaaatacatgacttttgttgtattgttaataaatcatcaagggaaacagaatccagtctgcagtcaagtagaagcctctgcttggtttcttcttgggatcaagatatagtgaataccagctggtattcactatatgtactatagcaggtatatataaaaatatatatacctactggcattatatatacacatatatatctgctggtattatatataaaatatataatatataaatatatgtaatatatattctatatataacattatatttatgtagaataatatttctatatatatttatatatattttttctgagttagttattcaaaggagacagtactttttataacatggcatgtagggtcttgtacgcatttgtgcaaaactaaatgttgtatctcaatttaatatccattaaagtgtccattatctcttccttgacagtacattttagcaacatttatgtacttctgtactgttttaatgaatttatgtataattatatttcttgtaaatattcataagtcttaccagcactattctgtcagtctacttttttaccttgatgtcagatttttaaaaataaatctggacttggtaaggagagacttgtattcaaatggattatttcaaggagttagggaaagaagtattacagtaggaaaagtgctttgccgataagctctgcaggcatcttgggagttgcagagccgttcttttataaagaggagcaaagaacgttagaaagaaccatatgcggggatgtgggatgaaaggatggcatgatcggatagcagatcagagaatacttttccctgagcccagcctgttttcaggagggactgtatgctggctcaggtttaggatgggccaaagttcaggggcctggaggaaggagaaaagttcaaccagttgggttaacaagcattttgttctggttgatcagtgggggtgggcagcttagctaatcatttataagacaaagaaagggaaatctggagggtctgtgtctggccttgtcataggtaaacgggggcatccgtgagtcttatctaagtcatatggggaagggtagtggatcttcacagtaaactttatgaaacacaaaaggtaggggatttcttaaccttcactgtaatctaggatgacagggttcaaataaaattcagcattgttgataaggaccactatgtcaattaggattgtttttagctacaagtaatagaaaattggacaatcaatgacaaacagaggcatgtttatctcacctaataaataggtcagagttctacctattggtagagtttgctgtcattgatttagcattcagtgatgccagcaaccctctgagtctttctactctgtttctcatgttgattgcctcttggtcataggatagttgcagcagttccaaccatcatgtccacatttaaaacagggataagtcacacggctacctctccctgcagaggagaccagggaagttattggctgtttacattgccacggggttctcttaataaggagaaggagtgtttaccacatcaagtcttatgtttcttctggcagttgcattctgtacatgatactggctaattctctacttccaacataatccttttactatttgaattgtaggaaactaaatgtcttataactggagcattagaaaagtatccattatattttagtctagataaggaaattgagccactgttagaggtggttttctggaggagcttcaggaaaagccaagaatctcttgagtaagcttctttggagtcatttattcaaatgttagtaagcttggaaaaataaaaccgatattgcaaaagatttatatctctaattttaagagatcttacacatcagatcttattatagtagcaataaaagttttgccaaataagttttgctttttcatatcaaattgtttgtataaacaatggtgcccaacgctggtgagatgctcctttggaactggtgagaggaactggtgagagtacacacttggtgcacacgttctgcaaggtttgtaaaaagtataaagagccttaaaatgttaatctacttatcctaaaatttatctgtaagaaaacatttgtagtaaaaaaaaaaatagaattatggaccaagtattctatacaaacataaatattctggaaattttttttcataaaaatatttggaaacaaatttttttggagaataattgagttaggtatggagtcttcataacctcagtataatatttagttaaaaataagaatacaaactatttataccatgtgattcccgtttgataatgtacagatgtatttatttacttaaaggaaatatgtcaaatattatcagtagatatttttggattatggggttacatgtcaccttttaaaaattctttttgtcatttttataaactttttaattataaaaaactattttttaaaatatgaagtaaaaatgagtgtggttgctgagatcctttttaaaaagaaataatgggtgagaaaatgctttgattcaagaatgtggaccaggctgttcagcgcttggacattgtattgatgaagtaggaaaggtgttgccgtgttatggagcatttggttcctctggagctctggcattgctcagttctgcctcgaagggaatgtttaaaggaagttgtcgcaatcgttcattcttctgtactcacgcaaattatggttgttctatttttctcttccttgagaacttcctgttctcattgtctgtgccatataacaggatggaagtcactatgggttgtaactacattcaggagaagaagagaaccagtgtaagggaacagtgtgttttaatttatgcagatatccaatgctaacttatttaaaggttggggaggtcattatcttaacacataagaattcttgttgcttagaatgtgtggaaaacaaggcctcagtattcttgaataattgctatttgtctcccttccaaagcctatgatgaaaacaagtgtgtatgagtgtaaatgtgtgggtatgtataaatccttactaagttcaattgtgtgtgtgaggggagggggcaagagagagaagatgtttatcttcctgacatctctcatcagaccctgaggtctgcccttctactggggcatccatggcatggcacataaggggttcagatagactagtttgatatttgctggttggaaattcttggtataaaatcacatgcttttagagctggaagattcttatggattcattttcaattttacattcattttttgccaggtactttcacatacatctgagattcctaaaccgggatgtatttatccctaggttataccacccaagctagaagacccttaaagcttcaggatctctagaaagattcagcatgtttattccttgacttcccctcaggccatggcacagtgtttacagagagggcttcattcatgcatgattaaccagtaacacggccttagcgcatggatgcaagagttcatccaaaagtttatgttcgttcatttgtttctttgcctttgtgttgaaattaatctaatagccattgctttaattttaataatagagcctttaggcaaagctgagggtcaggaattgtaaattgtcaccgtacagagagtgaaatgtgtgatggggcaactctaggccaggaccctcatggacaagaatatggcttaccaaggaaacaagggaactctcttgtactttggaatctagaaaggccttttcccaaatcaaaggaacttatatgatttgaagcagatttcttttgtttttcattttcagtcttttatacagaatcaaaaagaagcagttgttgaaaaattctgtcttggaattgataaaacaatgtgttgggtttcactatgccacatggctatttaaaatataacctctctcgagaactgtagctgcctatgtgacacccttacttggatgcttaataaacatcttaaactcaacttgttcaaaagagaactcttaattaccccaaaagcccaccaatcacctcttctccaagttttttttctgtcttagaagatggcattcccatctgcccaacttgggttatgaaagttatccttgattctttgctttccctttccccaggatctatcaggaattcctttttactttacctccaaaatatatccttaaatcactgactcctcgccatcactgttgttacttccctgttcaaatcaccatcatttcttatctgaactattgcactggtcttctcacccatctccttgttctctgatgatctattttctaccaagcagcaagaatcacctttaaaaaattaatttgattgcgtcattcttaaactgaattacgaatcagatctggtcatccctctgtttaaagccatccattagttttccatagcaatgagaataaaatctttacctcttaccctggtttacaaagtccttggggtccagccctgacaaactctctaacctcagctcctgccactctctcttttgtccagagttctccagaccccaggttctttaaagatgccagcccaccaatctgaggaccttccttctaccaggaacgggcttttcctatcttcctatggctggcttcttccaacatttggaacaagatgctctgataaatgttaactctcatagaggcctttcctgatcacctgattacatagatgtcctccccatccctgcccttgcaaggcatcatttatcacacaactcttcttaccctatttaaattacctagatggcacttatagctatctctagcactgctgcctacctgaatttaagatctctgagagcagggcctgcacctgcttttttatcattgtgtcaccaagaccacagaggaggtcagtgtttggtgtggcatgaacgtcgtcatcagctgcttttctttttttttttttttattatactttaagttttagggtacatgtgcacaatgtgcaggttagttacatatgtatacatgtgccatgctggtgtgctgcacccattaactcgtcatttagcattagatatatctcctaatgctatctctcccccctccccccaccccacaacagtccccagagtgtaatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcgtcattttttatggctgcatagtattccatggtgtatatgtgtcacattttcttaatccagtctatcattgttggacatttgggttggttccaagtctttgctattgtgaatagagccgcagtaaacatatgtgtgcatgtgtctttatagcagcatgatttatagtcctttgggtatatacccagtaatgggatggctgggtcaaatggtatttctagttctagatccctgaggaatcaccacactgacttccacaatggttgaactagtttacaatcccaccaacagtgtaaaagtgttcttatttctccacatcctctccagcacctgttttttcctgactttttaatgattgccattctaactggtgtgagatggtatctcattgtggttttgatttgcatttctctgatggccagtgatggtgagcattttttcatgtgttttttggctgcataaatgtcttcttttgagaagtatctgttcttgtccttcacccactttttgatggggttgtttgtttttttcttgtaaatttgttggagttcattgtagattctggatattagctctttgtcagatgagtaggttgtgaaaattttctcccattttgtaggttgcctgttcactctgatggtagtttcttttgctgtgcagaagctctttagtttaattatgtggaatgcagctttctctcaacttgggaaccaatagacatttctacctgttctgtttttatagaagactggactttatgagtataaagtctttggtgttctggaggactgctcaccaactctactggcagacatctatatggactcagattacagaaaacaatgggaccagtatgttaaaggtgagtgatgcttgcttttctttttttttagacgtactttcacttttgtagcccagggtgaagtgcaaaggtaggatctcagctcaccgcaatctccgcctcctgggttcaagcgattctcctgcctcagcctcctgagtagctgggactacaggcgcccgccaccacacctggctaatttttgtatctttagtagagacagggtttctccatgttagtcaggctggtcttgaacttctgacctcaggtgatccgcttgccttggcctcccaaagtgctaggattacaggcatgagccgctgcacccagtgcttttttttttttttttttttttggatcattaaaaagtagatctattctgaccagatgcagtgactcacgcctgtaatcccagcacgtggggaggctgaggcggacagatcacttgaggccaggagtttgagaccagcctggccaacatggtgaaatcccgtctctactaaaaatacaaaacttagctgggcatggtggcgcatgcctatagtcccaactacttaggaggctgaggcactaagaattgcttgaacccaagaagcagaggttgcagtgagccaagactgtacttcagcagggacaacagagggagaccctgtctcaaaaaaaaaaaaaaagtgtaatctatttttatttattcttgccagtagaaaaaaataaaattaacttctactacatagtgcttcctattaaattttggcacaaaagcattttaaatgttggactgaaatgcacttttgctattgctaggacttgctccttacctagttttagatcctctccacagtttgctcttggggctcctttgctgccacttttaagttgtgtgatcctcccatgtatctaggttgtcatgaaaggggaggaggtgcggtccaagttttggtttgagagttgaatcaaaattttccaaacagagaagaatacatgtatgtgaggaggtaagagagggacaggatgactggttaagagcattctaggctcagggatcagcattagtaaggtcaggaaagcgtgaagcaatatgttcaatagccgccagcagtttggtgttgttgggttggttggagtaagagaacctatcctaggtcttcgactactgttagtactagttctactactactattgttagtactgctagtactagtagaactagctaatagaactagtactagtagtagtcgaagagctagggtaggttcttctactactaggcgaactagggcagctgttgggtccagatcctccagggcctagcatggcgaccaggctatcggtcttagatttttccctgtaagttatgtgttatgaaagacatcacacagggacttctcctgccacttagagctggagtagcctctgccaacccagtcatagtggaatggaactatgaaactagccaaaggcacataaagcctttagtcaagactcttggttgcaagtaacagaaagccaactaaagacagtgtaagaagagaaaaaggagtttattagttcatggcattgaaaaaagtccaggggtttctaactttgaggacagctgcaacagggaacttaaataatttcatcaggattgtttctttctccatctgtagactctgttttcttctgtgttgacctaattcctaggcagattcttatgtcatggccaagatgtctgccagaagatccagatttatattctaaccatatgaataaccccagaggaaggagaattctacttttctagggatgacagccagatgccaggattggctcttgtcagctcagcttggagtttgtgcttattttctgtggacattcatcatggttttgggcaacttagtgttctcaaatactcttcctatttagggggcagtgggatgcttacctatccaagggaacagccagacactgtctgtccaggcctcccttgcagccaagatacagtcatgtgacatagactctgccaataagacccacatgtggcttcaatttggaaaagagccatgtgaggaagcaggcagcatggaagatccatttttcagtgaccagtgatggcatctgactttagggaaaacaactgctgagtctctgatgtttgctccccaacatcaacagctttcactctgggttctcatccagtggaagcagcagttaggctttgctggaacaatcttgaggttggaaatctcactctggtccatccgagagctttactaaatcactttttgctctcaacttgctagagtgactaactacgactctggacagatctgccatccctgaattcgtcaccatggccgtgtcttgctcattttcccagccctgaaattactgcagagtcagtcttgcgaaaccatgcagctgagaagtaggggaagggtgatgccctgaaggaaaattgagatgctcaaggggcgatcaatgctgagcatgtaaaagcaacagatgtccacctctccctttcttttaaggactctcatcagcctcctgtgaccttaatgggctggcacactccttaatctacagtgtgcttctaatagattttctttcaaaacctaaattatccctccttaccatctcctccagggactttgggctcctttaactggaggtagaaagaagtttactgcacagcacagtctggggacagagggtgtgcatgccattaaatttctttgctatctccctccaagagttggctgctgtttgcacataatagtaagacggaaggattattagggaaatttggtcaccctagctgtggcatagtgcaaagaaacatgggagagaagaaagaaacttggggtaagccatagttctgctgatctctaactattcaagaaggacgttgctcattctggaaccttcatatccgacctatgaatgtgctagactgggtgactccgttccaggttagctgtaatggatcaaggaatcctaaaggggaattaaagggctcagaagcaaaactattggtactctagtgacatctggtggttatcctgaatttaaaacctctgactatttttttgatgtctgattttgtttcattgcattctatcaagaatattgattatgctatagaatggccaagatttgttggcttcttttatttgtgctgtgtttttctatccactagactctgtccctgggcaataagctttcagtggaaattaatcggtttgacttttttctagaattttataccttatgagttagtggtttatcataacctaagaggtcatctttttttttttttttcttgagacatggtgtcattctgtcacccaggctggagtgcagtggtgcaatcatggcttggctcactgcagccttgacctgctaggcttggatgatcctcctacctcagcctccagagtagctgggactacagacatgcaccaccatacctggctgatttttttgcttttttttttttttatatatagagatggggtttcaccatatttcccaggctggtcttgaactcctggacttgagcaattgactcaccttggcctcaaaaagtgctgggattacaggcatgagccaccatgcttggcctaagaggtcatacccttattagttgtagctaaaaaggcttccagatgcattaacttcttttgctttcctttagaactctatgaacaagaatgcaacggagagactgtggtctactgggaagtgaagtacccttttcccatgtccaacagagacgtatcctttccacaaggtactcattccctggccctctaagtgtttctgtgttcctcagctgcagtctattgcagagaggtagagctggtttctcagcaggcacagataacattgtctctgattcttgcagcagcatttgctaaagatattgcttcttgtatggtgtttggagagctcagagtgtgatttctgggcccaaccacatgaagtgtctgtaattttggtcactggagagcagctcttactttcctaagaagtttcctaggccttgaaattgtcaggccacagaattggggatctggaaggaacttcttataaaaagtgcttgttacagctccctcagtctacagaaggaaaaagggctcccaaagaggtgataggacagaggcacataggtggttagtggcagagcaggtgctggaactcaggcctctgcatttccagctctctccgcctcccccatctcagtagaccccacagcaatccctccttgattgttggctctggacactgactgtaagcttcttcccctcaatgtccttgtttatgaaatgaagcagttgaatgaaatgtagggaggcttggctggcactgtaaggtcttcagaagcccccttaggactaagctggggggctaggatggaattttgggggtgggtaggatggaagtaggatgactcctaggtaagattttgactccttcaccatgctcttcaatcccagcagcggagtgttttacaggttcaatttccatgtaagatccttttagcaaagggtctcttggagtcaaaaaaaagtttggaagccactgaattagatgaactgccaacacttcaaaggtgttctgccaaattttaatcactatatcaagataattcttcctccgtggagtatcagatgatatctatcacatgagctgagaaagttgggggagagagtggaacaatatttgctaaaaggaaaaagtaaaaggtgtaggagaaaggaacccagtgacaaatcaacatctctttcctgaaacatttaagaactttacttattagtgtataagagcatggagcaatagactgtccaatgtgagggtggggcaacagggggcgctgtcaagacactgaggtgggactgaacgcgggtggctcacgcctgtaatcccaacactttgggagtccaaagtgggcagatcacttgatgtcagagttcgagatcagcctggccaacatggagaaaccctgtctctattaaaaatacaaaaaaatttagctgggtgtggtgggcgcctgcaatcccagctactccggaggctgaggtgggaggatcacttgaacccaggaggtggaggttgcagtgagccgagatcgtgacactctactccagtctgggtgagactctgtctcaaaaaaaaaaaaaaaaaagacactgaggtgggtggaggctgagacggctgccatgttatagtaagtgtaattgtgttgtgcgtagtgactttttgattattttaggtttttgattcctttgagtgggaaacccaaaattctgttttatgaaagtgtaactaacaaactaaatatctgagctccatccaactatgaaattctaagtaggttttggagccagatctgggataaaaattcaggtttcatcacttcagctgggatgtgggatttttggcaaggttcttttcctctctgagcctcacttttgtcatctgtagtatggggatactcataccaaactcacagggtctttgtaaggatccaaatttaagctgtatgtcaagtgcatgatgttacatgataaaggctcgataagtagtgattcctgttgtttcatagactttcattatcctccctagaatagtgccgtaaacttaagggttcttctgtcaaggctgatggacatgaaatggttttgttattcttggtaaactagtgttagcccagagaggacatctgcctacgaaatattcatgtagtcccatgtcttcctatggtcatcagctgtaacattgcttgaccatttactatgcataaaggtcagtaattagagcattgggtgaggccagaacaaagaggaatgacaccattgtctgtcgagtgcttactctgcccaggtctttctctaatgcccccaccaagcctgtctgcaaggcagtgttactccctttcctacatagggaatctgagtctcagcaaggctgagtagcttacctaggaccacacagctgttaagtgaccattcctctgtcatctcccagtgccttcttggagaaaggaaatgtggtttcctcacataattaaaagcatgaagggatcactcacaggtaagtaatacatgctctttggtgagaatactaggtggtgtgaggcacagtcttgcagtgcaggtatggagacagggcacgtcagtgaactagtggtagaaaggagcaaatgccaagtgggaggcacagaatcacctccctttgcttccagcttgtggcgctttccttctgtctgtctacaatgctggcgttggtgtcttgccttgactggccatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaaggtaaaacccatggtgcctgtcagtgcacccagccaggggtcccccacgggagggccaggctgatggggggacatgtcgagtacatgaagcgtatccctgaaggtcagaggacaggcaaagctgcagagcaaaccaggatcagcacctagagagagcctcattccaccccaacaaacttgagtagagtatgaggttgatgtttaactctgacccagtctattttctccagactcatggattgtccagatgaaaccagaccattataagtaagccagagagtttagaaagtcacttccagctggtcctgtggatacatacgctgggcctaagggtaggcaagaaagctggcaggtttgtcttggaggtctcagctctggctcagtaccaactcagagctactcaagacctgcccagcttgagtttcagcccccagggaggaaagctgcagacagagagtggggtgcgaggccacctgctctaccagaatgagtgtggccttgagtcctaggcaaaaatctgaactatagttagatggtcaccttgaatatgtcacctaatttttatgagtatctgtttcatcagttataaaatgggattaattttaccatctccttaggattgctagaataattgaatgagaggctatattcaagtgtccagcacttgccaggtatttaataaatagcagcaaaatgtgtctatggctgttttcaaaagtgcctatatttaagtatgccataagggcagtcaatggagagaagtccatctgaattatatgctacctccctctgcagtttctgagcttgaatatgaagatataaagtttgcacagttttgttgctatatttttctggtatttttcctttttctgaattgtcctttctttccctctctagttttcatgtattacttcgataacccgggtggccaaattccgtcctggctcattaactgggccgccaaggtgagatcccaggaggtggggcggggggagggatgggggagtgtgtttgacaaatgttgacttagcccgcggggctgtcaggctgaagagacacattgtctcaggcgtaatgaggctcttttatgaagagtttggttgagtgactctggttagggctggggctgccaacatccaagacggaggctgggacaagagacaaagaattgtcagcttggaatgccagcctctccctgcttgtgccccaggaccccgccagaatcactctctggaacttctggacaatagtctgctcttagtaggaacaatagtgcctttggagcctatattcctctgcttactggggaataagacagactgacctggcttggagacaaccagatgtgtccaagcctgaggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctgctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatccagcccaagcccatttcttgtgttttcttttttccagaaacactgtttcagaaacatcttcgctttttcctagaaaaagctaacatataaggcctttttgcaacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatcaagagtgaccactgtgaagacatagaaatgacagtctcatttcctttgcagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttttacttgtcctgtgtaccacttccttcctaccttcttccttttgtgagtgtgcatcagttagatctcctttatttgcaagtgatattcagcctaatttgtagacttaaacataaaacataattttgggcttacttatatgcatgatcaggtgtaggtatcttcatgtagggatcaatacaggtgctcaaactgagattagaattcagatcgtttagtattggtctgcatttcctggtagcattgtcgctaacagcaataggtaggtttgcatcttcctaggctcatgccaagcaaaacaaaaaagacaatgtttctttctagtaggacctgcactttccataacttagagcacctctaaaacatatgcttatctatgccctgctcattatggtcatctggatagaattatacaagtaagtgaatgcctcataaaattatcattaaaatatcattatcaataatgtagctgaaatctattctagataaactaaatctgaatacttcctgttaatagaagtcaagttgaaatcttatgaatagattatttgaaataaaagcactgagattatagtcactgaaagagaattggcatgaaatggtgtcatgtaaaccatttctttaaataacattaaataatttgctaagaactctgaaaatactaagaatgctgagtttctaggtaaggtacttattttaaaaggttacagtgtttgctgtaatgaatggagttaagactttttagcatttttacttgctaatttagagtagtggacagtcctcacgagctgaggttatgtaggaaactgaaaactcttgagctatagtaagtgccaaagtcaaaaaaaaaaaaaaaaaaaatagaactggtggtttaggcctttacttagagggacttgcacctgagttctcagggtatgtttttctgcagcagctggatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagattgaccaaatggcatgaacctggaagactaaatccattcagctatagaggctcaatccccatggattcaagccaaattattccccaagtcagcgttttgtggggtgcggggtgggcgggggcggtttctagatttcccaggttcccattggtccttccttgaagtaccaaggtcctctctctgttaaggggtggctttgctggtgtggctatgggttatagtataatgttagagaaatggcacagtttgaattgagtccggctgagattagtcaggattccagttgaaatttaatggcaaaagtagcactactgttggtggtaaattttttccacaggcaaattattcacactgcataacaattcaaagttaatgaccaccttggaaccgaggagttccagcagagggtcacttcccttgaaaatgttcctatttcacagcaagagtcctggcctgactccctggctgagattcctcacccagaatccccatctataatgcctgcccttccaacctcccacttcctagctggacttgcaagagatgaggcaggaagagccccattcagttctcacatttctagtggcaccacccagtcacctcagagaattatctttaaatgcatcgagacatttagttctttaacagatatttctcaagaggctggagtccatcagcattgggataggcatggcatttgtgggatgaatgagaaagatatggtgcctgcccttaaggtgcttatggtctaatgaaaactcagtgaataagctgctgaaggatgataagtgctcagaaaaggaaaataaa

SEQ ID NO: 12876 - DNA, 38575 bp, Human
ttgatgaagtttttgtttttgtatttatcttggtgtgaatagcacagtgcaatggttctcacactttttggttgtacaaattatagtatactcttaaaaatcattgaggacctgaaagagcttttgattgtaagaaccccaaagagattacatctcttatttatcctactagaaattaaaactgagaaaatttcaaacatgttaatttacttaaaaacaataataaacctattaccagttaatagaaatgtttatgaaaataactactttaaaacagaacaaaattgagaacagtggcaatgttttacattttaggaaatccctttaatatctggcttaatatcatagaaaaccagtaagttcacatatcttgttctgccttcaatctgttttgctattacatgttattaatatatagcctctggaaaactccattatattatcatcagagaatgtgcatgaaaaaataacatattaactatgaaaatagtttgatcttgcaacccccctgaaaggttttcagggatttctagggatctcgggaccccagggcaggagagcttgacaatactgtgaacctcataaataagatctttttgtcataatgaaaagtaagctagatagacttgactgaagtttcaagggctatctgatgagaagtggaggttgtttcattgacattattctctaaggttaggaatggactctacaacattcattcaattaattcattcagcatacatttatttagcacatattatgtgccatgaagtactctagatactgaagacataccagtagacaaaacaaaatatccttgccttcatgagacttctaataaagtagtaaaatatatagtgtatcagagagtggttaaatcctatgcagaaaaacaatgtaaagaggtctagagaatgctggagggatttgcatatttcagtagaatggacagggaaggcctctttaagaatgcaacatttgagcgaagacctgaaggaggagaagccattgggatatcttttgaaagggcttttccagctatttaacaaattaatttcttaacatttgaaattttatttatatgtagtctttaatcaaatatccattgtatatgacattagctgcaggtataaggaaataagacaagagaactgaggtttattgagtgcctgccatgtaccaggcactgtgctaagtattatgaatgaggtttggtaccttcactaagatttacaacttaatgcaggaggcaaggtgtagacatacacttcctgcagtatgggtgtagcagttcttatgaggaaggagagttgacttgaagttgcaccgccagaagtaatgcacctgacctacctgaagtctacgcctccctttcaagatgaattagggtgcagagggtgctctccactataacagaggggaagccagcaagataatacctgatcacaccttttatagagcactttggttaacaacatgtcttcacaaattaactcacttaaccttcataacaataagaagcagatgttctaagaagtgttactgtgtctctcagagatggagaaaggctaagaaagctgggtagtatgacaaggcagttataaggtagagctggacctaaatttaagataatctgcttcaagcacagtgcttttcccaccgcagtgcagctgttatgagcagctgccgaaataaaacagcttgatattctcctgactgagtcctcccactgactcaaaaggagggttaggttgaggttggggcggagctagacctcaagaagaagccaacaaagtcacacacagcgctccccacctgcgcttgcgcaggggaggaacacgcagtccggaaaaacgccggggattctgggtcgcgcagccgtggagctacctcaaggcggaactggggagtccagggcttcggcagcctgaacacccggtgtgaaaggaaggtggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccaggtgaggcggaggtgcgggtcgtgacgagggtggctgggctctttctgccccggtggctgctgtctcctgggccgcgacgggaactgtaaactgcagcggcgggctcgggccggctccgctcgcgccctcctcggcctctgggccgcgctctcccgcgacgtttgctttcctctccccacccgcgcctgcctggttcccggcctttgccaggcccaagttctctgggtcgctctccctcctgtagcgccgagaaaacaccattccgagggccgccgctcggccggcaggtttgctgcgcggagctcagggcgtggcgggctggtttgggcccgaatccggccgggggcgccttgcctcgaacctctcggggttcaggctgcctgccaccccgagacccgggagacatagctttcccacttgagggtttctgtggggccttctctaaatacataatgtcctcgggaagtttcgtgacgccttaggtcccattcctggcctgtttgggcgcagcttaatgtcgattcttttacttttttattagtcggctgtgaaagaactggatcttgtgactgctggaaaatttcgctttagtgtaaggtccgagtgcttcagccgtgggccacctttgaaaataaaatgtaattgttatttctcattttgccacatcctgtggagacagaagattagtgttgtgctttcattttttactttttccttggggaaaataatattgacagtggagttgagtataaggtaagacatggatctaggtggatgttgctagagggctgtgatttcatccaggtcttggaagagagttctccagctgatgtcattcttgccatctgattatgagtaggttatgttcaaggccgtcctgatccttaaaccacatttgcactccaggggctgtaatcagtttcatattttagctataccttctgatacacgtatctttcaaataattttttgtatttcataaattgaaatagccttaattctacaaactagaatgaaagctctcctcaaataacttgtaaaagtcacttcataaagtcttactttttaaaagcttcttcagaatttgaaagcttatgtaatatattctgatattatttacttatttatttatttattttttgagacggagtctcgctctgttgccaggctggagtgcagtggcgcgatctcgggtcactgcaacctccgcctcccgggttcaagcgattctcctgcttcagcctcccgagtagctgggactacaggcgcgcactatcatgcccagctaacttttgtactgttagtagagatggggtttcaccatgttggccaggatggtctccatcttttgacctcgtgacccgcccacctcggcctcccaaagtgctaggattacaggcgtgagccaccagtttgacaacacattttcatagtgttcctcatgtaatgtcctctgtgtctactggaatgaaggatttgcacataccaaggaatagaataatgaaatactatgagttagcaaaccagcatgatttgtctgtgtgtgtgtaaaaggcatgagtaaaattatttacatgatcatctattattgcacatacatatttgagtgttaaaaagttaaacgttgtcttaataggaatttcacagccttgtgatctttctttttcttttctccttttttccttgagatatcgttctcatttaagttcaggcatatgaaattagtgtttttgaagtcaagaatggttggttgtcatttcatgtagttcaacccaatacatggttggttagcactttttctaaatgtattgcatggatgacaagttagggtatgttaaaattttctggaaggttaactggagtatataaacaaaattcctctgctctacccgctgtttttttgagacagggtcttattctgtcacccagactggagtgcagtggcatgatcatagctcactgcagtctcaatctcctgggctcaagtgatcctcccacctcagccttttgagtagctggactataggcacgagtcaccatgtctgactagtgtttttttattttttatagagaggaggactcactgtgttgcccaggctgtctcgaactcctgagctcaacagatcctcctgccttgacctcccaaagtgctaggaacataagcatgagccaccacaaccggccctacttctaaaatttttttcatagatgggattttcctatgttgcccaggtggtctccaacacacaggctcaagccaaactcctgcctcatactcctaaagtgctgggattacagacacaaggcatgacacccaaccgaggttctccttgtagagtaaggcctgttaagtggatttatcagtctccctagttcatgccaccgaaacaaagaaacaaatttaccgtgggcctaatctgttttaaactttttcctcaatacgtagcaatggattatcaactgctcgatgcaggattttgtcactttatttcttttgtgaaaggattacatatagtgagaaagttgtcttatttgtctagctagatatacattattggcctgtgtgatatgctgtggaaaacaatcttaaacactctggataagatgagaataaatgactccactgaaatagaagtctatgccttttaaagtgaattagtacaaaaacatttgctgtggatatgatcttaaaggattgttttaaccaagtttgtttctatttcattacagagctggagctagtggaagtgagatagcacttgtgctgttggggaaaacaaaggatatgtttaatccgaattagtggattactttctagtgtatttcatagtgttagagtctaaagggtatgtgatagtagtcaggagatcaggattatgaaactggggctgccacttgtgtgaccttgtgtgtgatacttgaatgctgtaggccttcatttcaaaagcgagggggttggaatagaaacctctcagaccctaaatgtgtaagactccaattctgtggctaggcctggtaaggtaaagagtagcagaatatatcaagaactggaagggattagagagacctattatctaaattgctgtccctcctttgccccttgccttcccttttttttttttttttggtgaatttcatatgtaaatttaaaaaatgcagattagttataatcacactctgtttattataaatttggtcacatctaagtgccatggtggtagttactccttccatctctacttctgcatgggaaacattttgctcctttaactttgaaaatatgagggtgtaaatatacaatactataagaatggtgcttctgccaggtgcagtggctcatcctgtaatcctagctactcgggaggctgagacaggaggatctcttgaggccaggagtccgagaccagcttgggcaacataacgagaccatgcctctaaaaaaataaaaataaaaaaattagccggccatggtgatgcacacctgtcatgccagttacttggggggctaaggtgggaggattagtgagctgtgattctgccactgcattccagcctgggtgacagagtgagaccctctctcttaaaaaaaaaaaaaaaaaagtgtgcttcttaattattttgagattgtcagttcttttcaaaatctaatagagaaatggactctctgtccctttcaaagtctaatagagaaatggactctctgcctagaaaaatgcacacatagaatttagaatactttttgggctaccagggtacccctgtctaagatctgatgtatacccagagcctgtattaaaatttgttgcttcacaccatgccaccaattccctgcctctccttacaaagtactgttaataacaaaggccatttaaggattagcaattatgagagaaaaacctctggctttgtgtctgcacattgccatatgttcaataaataatacccaatatcatcattattgtattattattatgatattattacaactagtctacaaggtaatcttaacttatgtttttgtagtaatattttctgtggtgaccacgtgtagatattatgtatcttttcttaaattatgggtaactgagtatgttgggagagaagaaaaattttataggtagtctttaagagtcttactagtattgttacctatgttccaagtaagtaaatatagtcaagatgttaagtagataaatctagaatttgactcttcttttttactttgattttatgatgctggttttatggtaaacacaagaaaacaaaaccaagtaagggagagttaatcgttcaaatatatttaatgacactgggtttggaaactaccaggaggccattatgttttgcagaaactctatggacaaaacatacctctaccagcaataatcacaacctatagaaagagtcataagatttttctataatttagatatctgatggctgtttctttgattttattcatgcaaacaggtcaattaggagagtcttatacttcagaagttaacatgagggaagattgaatgactttaaaatcaagggctttaacaaaagcttagattttatttttgaagagtttctaataactgacacttctgcttcatagtaagtaaaataattctggaagatgtaaaatcttagagtacccttctaatctggtgtcttttgcttttatcctttctttctagtttcttaccatttcctaggtttagtcctttgttctctcttgccataaccatggcggttgtcttccattgattttcttccattttttgttagtattaacttttcaaaacaaagagcagtacttgtcttaactttctttaaaagcctccagtagcctccagttgcctacttggttttacacactctacctagtgtttgcccgagtctacctactctgtcctgtgatctttcttttaacctctctttttactgtatcttctcttaggtagtagccgtactgcgtgttacagaatgctcggctttgatatatttctggttttgcttgaattcagagtggattacacaatcagattttttaaagctagtttgttgcattctaagagactttattttttcccttttcatctatgtcagttaaagcatgacatgctgctaatatcattttctcagaaggacataccagaacagttaaaaaacaactacaacaaaaacccccaccttttgtacttgggggattgtgtaggagagcacggggaatatatttcatagtaaactactttgctcttgggatttttaaattgcctttctggtaatttaatttttctgtgtatacctgctctgaggcagtattcctaggaacaggcctacatcagttatttttatctgcatctaataatttgtgaccaaataatcatgaacacatttatcatatgattagaaaattcaagttcccaacctgtctttttaatatctctttcagcctgctcttgaggttcacagatgatacgtttgatccagaacttgcagcaacaataggtaagcctgtgtttaaaaattctatagaaatggccagtattttcttgcctttggcctttttaatctaaatccttctaccttcctctcaccaccccactgcctccatgtctgttgaaatcttatttgtccttcaagacttaattttggtatcattaaatctttgaagcctttctagatcttaccaagagaaaataacttccttatctgttgtctcatgatactttattaaaactgctaatgtgattatctgtacacacatttctctcctatactatggattgtcttttattttgtaatatacaacagttatttgaatacttattgtatgccagggactgctactaagaggaggggttataatagtgaataacaaacttggtctctgtcatcgtggacctaacagagtgtgttaattttgtatgttcagcatttgctacagtgtttgacgtgtattcttatcttcacatatgtattgatactagttattaaggattgttaggagcaatgatacttaaatgccttttaaggataagatttagatcgcctgaaagtggttagtcacactaacttatgagaatatatgagaagatagaggtaagtattttggtatcatgtgtttagactgcagacaacgtaaagggatgaagagaccacttggaatagttgaaaggtagctgagctgagtcagagctagataatagtcttggttgactttgccttgaattacatgtaatcttgatgaagtcacttaacttactaacttcatctgtaaattgggaggttttgttaaaatttcatgatctgatgaggagaatatagtaaagatgatcctagcattattgttagggaaaataaagagtttctgttaactggctttatttgttttcattgattgtatgtctatttttaaaattttattgtgaaacaatttcagactcaaagatttgtaaaaatagcacaaataattcttatgtatcctattaaattactccagatgttaatgtttgtcacatttgctttatcattctctctctacacacagtattcttttttaaaaaaatgagagtagattgtagacatgatgtcttcaacgtctgcatactttaatgtgtatttcttaaatgaacatagatacattttattgtctatacacagattttatcagttgtcccattaatgtcccatatagcaaaagacaaataattgtttcgggtccaggatcatacactgattttagttatttctctttagcctcttttatttcatttaattaatgaattaatttattttcgagacagagtctagctctgtcgctcaggctgagtgcagtggcaccatctcagctcagtgcaacctccacttttcaggttcaagtgatcctcctgcctcagccacccaagtagctgggactacaggcacatgccactgcgcctggctaatttttttttgtatttttgatagagacggggtttaccatgttggccaggctggtcttgagctcctgacctcaagtgatctacccacctcggcctcccaaagtactgggattgcaggtgtgagccaccgcgtcgagcctcttcagcctcttttaatcagcaattcttcagtctttatttgccttttcagggccttgacatttttgaagagtaaataattattttgtagaatgtctctcaatttgtgtatgtccagtatgtccttaacggttagattcaggttatgcagttttggcagcaattccacagaagtgtttttcagaacatagtgtcagtgaagttattatttttcccttcataactaatatatttcttgtagagagatacattgagactgtataggtatcctccttcttacactttttgccctcctgttgtagcatccattgataattcttgcctgtgacaagtgataaggacagtatatgatcttttcattccaactgtgatggttatcaaatggggatttttttaaaatgccatcactctgtctatgtatcttgtttggaattctgtaagtaagagctctttttttttctttttttgtgaggcagtgtctcactgtgttgcccaggctggcctgagactcctgggctcaagtgatcctcctgcctcagcctcccaagtagctggaactacagccatgtaccaccatgcccagctcaggaggagctcatgtttgtttgtttctttttcttcatatgaactcatggtgcctctaaattttcaataaattaggcattacttagcttttgcatgatattaagatttacagatttactcttatttgtgtcataggaaagggaatcatttaaaacacgaattcaaaatccattgtaatttggctttgttgtattataataataattattattatttaattttatttatttatttttagacacagtcttgctctgttgcccaggctggagtgaagtggcacaaccttggctcactgcagcctccacctccccattcaagtgattctggtgcctcagcctcctgtgtagctgggactacaggcatgcaccaccacacctggctaatttttgtatttttagtagagatgggttttgctatgttggccagtctggtcttgaactcctggcctcaagtgatccacccaccttgggcctcccaaagtgttgagattataggtgtgagccactgtgcccatactggtgtattatttactcctataaaaaattacttagtagtaaaaccttattttggtcagaacctgcctgagtacgtattggtattggctagccaggaggagagcagtagcaactggcaggaaaataaacttgcctaaagttaaaattttactgaaggaatgaacatacatataatattaactgtcttcattacaaacccaaatggaatttggggacttgtggcatgacaaatcgtgggttgtctttattactaaaaaggctttgtcttctgcaaagacaaatactaagattatagtatgctggtgaaaatatatgtaatttgttccccaaataggccctagatcttgaatatgttgaacaaaatatcttttacattgaagcatcagattactttcagccttaggtaataacatatatatatatatatattttttttttttttttggagacaagagtctcgctgtgttgcccaggccggagtgcagtggtgcatgatctcagctcactgcaatctccgcctcccaggttcaagtgattcttctgcctcagcctcccaagaagctgggattgcaggtgtgtgccaccatgccttgctaatttttatgtttttagtagagatggggttttactatattggccaggctggtcttgaactcctgacctcaagtgatccacccgcctcagcctcccaaagtgctaggattacaggtgtgagccaccacgcccagcccacacatgagttttaaacataaaaacaattacttaatggccttgtgaaaattagtgttttatgaaaattggtattttaccccacagtaaaatagtagtaaggaaagtgtattgttaccttttagtaacttagtgagacacttaagtttctgtcttgcataaaatactcttttaagataattgttggatttgggatttgcagatggtactataaagttagcattcttctttcttggcaattagctaaaaacaacaaagagagggaaaaactgacacacaaacccagcattccactaaactagaagacagttaaaaaccccaagccacaaaataggtggaaatgttgccaggagcagtggccatcaggctggctgcatgtgggaagaagtaggtaggatgccgtggctgtggagctcagagacaacaagaaacacccatgaaactgcaaggcccccctgaggtataaaacctaaaccccttgtttacaaaagtgaagtgggtttcttcagctcaaggcaggagctttcctgcacctggtttaattctaagaagtcggggaaatgaagccaaacaaggagtcacataaacaagccatttttgcaggaagtaatatgtgtctatctctatagcagttggggaggagatgactgcattgtgaaaaacctccagactgcctgtctgcattggctgttgagaagtaaaatgctaaactgtctcttaggtaaatctctgaatcacgaaaaagttgtcagtccagaactggaggcactctggccttctgcataaacctcctacaaatatcaggttctggacaaccagcacttcttcagagatgaataatcaaaaggaattcattaagcttgactgccacaaatgtttggaaataaaaaaggaagaaagaaacagaaaaacaaaggacagatgaagaacagtaacctaaaatattgccataaagaagatgaatattgtgatcaaacattttgccatgagtttagaaaacttaatgaagtatttactgctgagagcacaacgcacttgacataagaggccggggaagaaatagaatgattgcatgagaaaatgcaaggtaagctgattgagtggaaagaaaaataaatgaaattagaaaataaaactattactgaaatgaagatgaaattgaaaggatcacatagataatagagaactgtggaaaatacaataagagacagagtctagaaatggaaaaaggtagaatttaccaaaattaatgaaaatgttaaaacgaattagaaaatgatagatatggaaatcagaaaaggaaatccaacatatgcatatttgagactaagaaggaaacataatgaaacacaaatatttaaaaatgtagtacaagataacatttctgacataaaaataaacattcatacacacaaaattgcaagtttttttgtttttttgtttttttttttctttgaggcagggtcttgttctgtcgccaggttggaatgcagtggcacaaacatagctcactccagcctcacccacctgggctccagtgatctgcttgagcctcctgaactggaactacaggcacgtgccaccatgcccgggtgatctttgtatttttttggagatggggtctcaccaaactgttgcccaggctggttttgaactcctgggttcaagcagtcctcctaccttggcctcccaaagtgctgggattgcaggtgtgagccactgctctcagcctgcaaaaatatctcgaccagtttttttgtttgtttgtttgcttattacataggagtgtttgataaaagatagtattaggtttctttttctgctgtgacaggatcacatggtggtccttaggtacttatctaagtaattggtagcatagatggaattggtaagcatggaaattagatcctgtagaaattagttatactaattttatataatctgattaaataggcacaattcgctttaagttttttatttttttatttaccctgttttatgtaccttttgactataaaaagggtgctttaaaaactattttcaaataaaaacctagaaaatgaatgtaaaaccatttttctacttcagactgggtcacaacatatttcttaatctattttaagacttataattgttaaaatatgtgaaaatgtcttttgagggttggtatatttcaactacagttagacaaattgtggttgttatgggttgatgttatttccttagtgagctttcaaaaatacctatgacttctgctgggcacagtggctcatgcctataatcccagcactttgtgaggccaaggcaggaggatcacttgagcttgggaggtcaaggctgcagtaagctgtgatcgtaccactgtattctagcctgggtgacagagcaagacctgtctcaaaaaaaaaaaattttttttcatgacaaacttaaataatattggaattatctgttctttaaaggttacattttacctgttgaatcaatctgatcctccttccttctttatcattccaacctcttcaagttttctattcttagaatagtcttgggagtgtaacttggaaagtattcattttctcttaagatagttgcacatagtattattttaaacttttcattatctgtgatcgtggctcttcatttctaaaattgtctatttttgttgtcttttcctaaggaatgtatctattttattgttttgaggattgctttaatttttttccctcgttcttcctgcttttcttttggtgttatttttttggtttgttaagataaatattaagtccccttatttttaatgcttattctttgttaaagatgttctctaagaaccaattctgtgttccataggttttggtatggagtgtttctttgtcattgctctggatactttgaattttcagtttagttttcccctttgaacatttgaaatctttgggccaggcgcagtggctcacgcctgtagtctcagcactttgggaggccgaggcaggtggatcactgaaggtcaggagttcgagaccagcctggtcaacatggtgaaacctcccatctcccctaaaaatacaaaaattagccaggcgtggtggcaggtgtgtgtaatcccaggtacctgggaggctgaggcaggagaatcgcttaaattcaggagatggaggttgcagtgagccaagatcgcaccactgcactccagcctgggtgacagagagagactccatctcaaaaagaaaaaaaaaaaaagagagaaatctttgatttctataccttagtctatattccttaggctataccttagtcagaaggctggggctaaatccagcctcccaacttctaatttggaattcttttaattatttcacagtatatcaaccacagatttgacctgaatgtcaaagaatgctaaatataattaagagggaagcagtaaaaaaatatgttaattaattaaatgtgcctgggtccacttctcttaataattcaaattatcagctagagttgaaaaagaagtaagaaaaggttgaaaatagatgaaccaggcaaatgcaaaaatgcaaaagtggtatggtaaaatgtagcctaagttaggtagaatttaaggttaatgcactggacagaataaagtggatagtatgtaatgctggcccagtaaattaactaagcagctataacagtcataaacaagtaggcaccaaacatagaagctctctataaaagcttcaaaacacaagaaaagaattcaatgagggccaggtgcagtgactcacacctgtaatcccagcactttgggatgctgaggagggcggatcacctgatttcaggagttcaagaacagcctgtccaacatggtgaaaccctgtctctactaaaaatacaaaaattagccaggcatggtggctcacacctgtagtcccagccactcgggaggctgaggcaggagaatcacttgaatccgggaggcagaggttgcagtgagccgagattgtgccactgcactgcagcctgggcgacagagcaagactctgtctcaaagaaaaaaaaaagaatttgatgaaaatacagtaatattagatttgctgcatttgttttgtagatagatagacccaaaagatacagataaaggcatagggaattggactaacaaaatcagcaaatcttttgaataaagacctcactactttaaaagcccatggaacaattatacagaatcaatctcagacttgacaacaacaaagtaaatcctcaattgaaaagaagtagaggttttacaatacacattcttgataatttattctttcagaaaatatgtttgacctattgtgtttcttacatatgagttcatagcagcattttttaaaaaattatacattaaagttgatttttttggtatacagtttgatttttaacatatgtattaaaacaaatgtttatggtcatataattgccaccaccacagtcagcataccaaatagttccatcatccccagagctacctggtgctatccctttctgttctattctagtctggtcctcctgcctctaacctcagcagccacttacctggtctctagttttatcttttttgagaatgtcatgtaagtggagtcatatggtatgttacctttttttttttaattatactttaagttttagggtacatgtgcacctctgagactgctttcacttagcttaatgcctttgagcttcatccaagttcctgtgaattgtttgttcctttttattgctgagctatattccattgtgtggatgtaccacagttttagttggtttatctattcatcaattgtgagacatttgtgttgtttccagtttttagtgattatgaatagtcctgttgtaaacattcaggtataggattttgtatgaatactaatttttatttctttagaatacatacccagtaatggaattggtgggtcatatgataaacgcatatttaactttggaaaacagtttggccatatttttataaagtggttgtatcatttttacattcccactagcttcatatgagaattcttattcttctatacccctcacctattatatatctacgagcagccttatttaaattttaaccatattttcaaatgagtaagtaggtatgtgttcagatctcattgtggtttaatttgaattttgctaatgactaatgaggttgagtatctttttaacgtctatatgcacatttatataggctgtatatatgtatttttttgcagtgtctgttcaagtctttcattaatttttaagtgggttttttgcttttttgggggctttgagagtttttaaaatatattctgcatttaagtctgttattagatgatatatgctttgcaaatgttttcctcccagtctctggcttgttttttcattcgtgtaaaagtatatttctaacagcatatgttttttattttgatgaaatctaacttcttaatttttccgtttatggatgatgatttcagtgttgtatcttttgcctgacagaaggttgcagtgattttcccctatattttcttccagaagtcttatagtttataaagtgttacattaagtataattttttgaattaatttttgaatacagtgtgaggtatgaagttcttttttttccttttgcatatggatatccagttgtgctaacacttagttgaaaagactgtcctttctacactgaattgcttttgcacttttgaaaaattatcagttgatatgaaacatatgaagaacaacacataataaaccaacaaaacgaagtggggtttatcccacataggaaaagttggtttaacattaaaaaaaaaatcaatgcatacttcactactttaaactaaaaaagaaatatcacgtaatcatctcaatagatgcagaaaatgcatttgaaaaaaatccatcatgtattcttgataacatctttcagtagactgtgaatagaaacctgataaaggatatctataaaaaacatacaactaacatcatacttaatgataaaataaagaatgttttccccttaatatgaggaacaaaataagaatataagctctcaccacttcggttgtactagaaatttttagccagggcagtaagacaagaaatgcatccagattggaaaagaagaatgtaaaaatccacaggaatacaaaatccatatttatagtatcaattgtgtttctgtttattagtaatgaataaaaggaagatgaaaaatttaaatacaattttagataaaaatctacggaatacccagggctaaatttaccgaaatttgtcaaagacctgtaatactgaaaattacaaaatactttcagattaatttttaaagacctaaatgaatggaaagatataactttttcagtagccataagatttaatattgctaagaggtcagttctccccaaagtgatctatagattcaacataatccctatcaaaatcccagcaggcttttatttttaaatcaacaagctgattctaaaattcactaggaaatgcaaaggaagtagactagccaaaacaacttggaaaaaaaccaaagctttatcaccattgagtatgacattagccatgggtttttcatatatggtgtatatcatgttgaggaaattcccttctattcctagtttgttgagtgttttatcatgaaagggaattgaattttgtcaaatgcattttctgcatcaagatgatgatcatgtgtttaaaaaccttcattcttttaatgcgatgtattactttgattcatttttcttaaagttcaactgttcttgcattctgggaataaacttgattgattactgattcaatcttcttactagttatgggtctattcaagttttctattcatgagtaaattttggcagattgtgtatttgttagaatttgcccatttaattatgttatccatttcgttgacataacggttgttcatagtattctcttatgatccttttttttctgtaaaattggtagtaatgaccctgttttcatatctgagttttgtaatgtgaaccttttctctcactctcttttttttttgaagttaatctagtttaaaagtttgtctattttgttgatctttaagaaaaaacaactttggttatcagttttccttattgtgttttattctctaattatctttgctcgtattatttattacttctgccctgctagctttgcacagagtttactcctctcttttagttccttaaggtataaagttaggttattgatttgaagttttatttcctttataatatattcatttacagctataaatttctgtgccgggcatggtggctcatgcctgtaatcccagaactttgggcgtccaaggcaggcagattacctgaggtcaggaggtcgagatctgtctggccaacatggtgaaaccccgtctctactaaaaatacaaaaattagccaggcatagtggcgggcacctgtaatcccagctactagggaggctgggatgagtaaaccacttgaacccaggaggcagaagttgcagtgagccggtatcgcaccactgcactccagcctgggtgacagagcaagactccatctcaaaaaaaaaaaaaaaaaaaaaaaaagaaaatttttttttctcttaacatttctttcacggcattccctaaattttaatatattgtatttttatttgtctcaaggcattctctaattttttttctgtgattttattggttgtttaaaagggtattgtttcattttcacgtatttgtgaatttgccagtattccttctgttattaatttctaggtttattccattgtaatcagaaaaatggtttgcatgatttcggttttttaatatgtattaagacttgttttgtagccaacatatggcctatcctggagaatgtttcatgtatacttgaaaaaaatttgttgttatacggagtattctgttggctctaattggccttcaaaccctttgttttctgttgataatatatctcagtacactattcataattggaagtggtgtattaaaatctccgactgtttatcctatgaaaaagacactttcacatgcatgtttatagcagcacaattcacaattgcaaaaatatggaaccagcccaaatgcccatcaatcaatgagtagataaaatgtggcatatgcataccatggaataccactcagccataaaaaggaacaaaataatgacatttgcagcaaactggctggaactggagatcattattctaagtgaagtaactcaggaatggaaaaccaaacattgtatgttctcatttataagtgatagctaagctatgaagacacaaaggcataagaatgatacagtggaacttggggactcggggaagggtgggagagggatgagggatttaaaaaactacacattgggtacagtgcacactgcccggttgatgggtgcaccaaaatctcggaaattaccctaaagaacttatccatgtaaccacataccacctcttcctaaaaacctattgaaataaaaaaaaaataggataaagtatatgggaggatttaaaaaaaaaacaagagggtgatgtgctctggttctgcagggagaggaaggggagacgcatggaagctccgtgtttgggaccctcccagacctcatccttatgtgtttctctttttggttggtcctgatattgtatcctttgtaatgaaactgtaattgtaaaaatctaaataaaatgtaatttgtggggaaaaaaaagacgttttggaattcagtcaggcaataaaaataatcagtattttcagtggagggcttgtgtttaggaaaataaataaataaataaatagaatctctgatggttgtaacactatttttccatttaattctatcaagtgtttgctttgtatatattggacttctgttctgtggtgtatatgtttataattgttgtatcttcttgagaattggcctttttatcaaaatattttgttttagtctcctaacagtttttgacttaaagtctattttgtctgattttagaataattacctttgctatcttttggttactatttgtatggaatatcttttcctgtcctttcactctcaacctatatttgtttctagaccaaaagtgaatctctgatagaaagcatgtagttgaatttttaaaaagtattctgccaatcttttgataggagagtttattctatttgcatttaatataccaataaggaaggacttctgccattttgctatttatttccttaaagagtttttgttcctgaattcttaccattactgccttcttatctgtttagggatttttcataataatatgctttgactctcttcacatttccttttttatctatattctatatatattttctttgtgatctatttcagtaaattctggtagcttttaatctttcaaggaaattgtccatttttatctgaattgtcaaatttattggcataaacttgttcataacattctgtcattcctttaacttctgtacaatctataaatggtgtgatttttttcatcctttgtaatgattttttttgtcttctttttcctgatcaatttgactagaagtttatcagttttattggttttcttatagaagcaacttttggattcattgatttttgttgttgtttttctgtttttaatttctggtttgaactttattttctttcttctacttcttcggatttaatttgctgctttttctattgtcttagtttagaagcctaggtcattgattttagatcacttgtcttttctaatatgggtgtttagtgctataaatgttcctattaagtattgcttaagtggcatcatacaaattttgatgttgtttttctttttgtttaaaatatttaatttaaaatacttagaacaatttcattatgatgtctccgagtttttcttcttctttttttttttttttttttttttgctaggggcttattgagcttttttgatctgtggatttatatttttcatcaaatttgaaatttttcagccattatttctcagatatattttccccccttctctcttctttttcctcaactccattgtttgcataataggctgcttgaagttgtcccacagatgattgatggtctctcattttctttgaaccttttctttctgcttccttttgggtagtttctgttgctgtgtcatcacattcactgatgttttcttctgcagcgcctaatttgctgttaatcccatccagtgtatttttcatctcagacattgccatttttacctttttttttttttttttttgagacagggtcttgctctgttatccaggctgggctgcagtagcacaaccacggcacatttcagcctcgacctttcaggctcgatccatccttgtacctcagcctcctgagaagctgggactacaggcgcaagccaccatgcctggctaattttaaaagtttatttttggctgggtgcggtggctcacgcctataatcgcagcactttgggaggccgaggcgggcggatcacgaggtcaggagattgagaccatactggctaacacggtgaaacctcgtctttactaaaaatacaaaaaattagccgggcgtggtggcaggcgcctgtagtcccagcagcttgggaggctgaggcagcagaatggcatgaacctgggaagcagagcttgcagtgagccaagatcactgccactgcactccagcctggccaacagagcaagactccgtctcaaaaaaaaaataaaaataaaaatttatttttgtcaagacgaagtctcgctgttttgctggggctggtcttaaactcctggcctcaagcgatcctcccaccttagcctctcaaagtgttggaattacaggcgtgagccactgtgcccagcccattttcatctttagaaagttctgtttgatccttttttatgtcactcatgtctactttttgaacatgtggtgtacagttgtaacatctgtgtcagttctgagtcagtttctattgattgatttttctcctcttcaacaagatgtgtgcttctgcttccattaatatcttctggtctcccattcacatatatctactgttgagttcatattttctttggcctttttcatgaaggttattttagttaaaactagataatatagttaatggagcctttgaaataagcagtaagtgcaacatgaaaatttaccagtgtgcctaaaaaaagattcttgcaaagaaactgaattaaagatcatattaaaaatgcaaacacaaatgaacaaggaaaagctgagatgacagttcttctgtttctgttgtgagctccatgttatccacatgaagagattgaagacacagtttaatcaaattgggtaagaaactggcaaaatcaaatctctcaaaaagactcccactgctgctaccaattaagataaattatcagccacttaacaaaagagaagcatgatgaagaagcagttttagcatgtgagatctgaagagctcaattgctgcatgtgagattcaccagaggaacctagggaagatgactggggactttaggggtctggatttagattaggtgccccttcaggctacctgtgtctgttggctttgatggcaggacgacagtggtcagtgtctcctgtggatgggtattggtaagtttcagatataatatgtcaaaagcataacttagagacattgttagttatccacatgcaaattattcttatgtcagagacagtcattagactgttcacaacaaacttgcagaaccaggaaataataatagagaaagaggagttggggtatgggaagaaaacacatacattctggaagcggtgggtttcttttcttgggtaaacaaattagctcataggaaagatgcttgtctgctcttgaacatgtatctgggattattaaggaaaaaaattagttctttatatactccctgaaaaaccttgagaatttaactgtagagtgtgcatgacagaggctatctctgtgtagtgtctgccagtggctgtcatttagtacctgcaccaagtcagaaccattttcctcctctgaattttctcagggtttgtgctttgcttttttttttttaaagcaataggaagaaaatgtagataatttcatgttgtttatgtagatggttccacttttaaaatggcatagtaacttctttatttagacctggttaatacaagattatttagcatgtgggattttttgtttgtttggctgtgaagaaattttatatttaggtttttgttgggctatgtaatcaacactgtccttttactaatggttgcccatcattctaggctttatcaactcctttatcaccccagctcaaaacaccaaacttaaaaatatatatatttggtatgcagaaagacctggcataatgcacattttgaatgtgcatttttattactgaatttgtatatgtaatggatcaccacaagtcttccaagaattacaaatatatttccatattggtgacaggtgttctattaagcatttagtatgtgagggtgctgttcatcttagttggggctgttctgaattaattgtgacaagctaataagatattttgaaagtttctttccaagcttcttgagctaatgttttccctctggccagtggggtagactgaactcttgaaagacatgtgggcagttgctgttcatttaagccagatggcatgtgtcaactccttttcctggaaagggagaggtttcttttttggctgctgtaataaagccttgtggacttcttatgaaactcttttctttacataaattagtacttatagaagcttttcatagaactttgggcactcctctttcacttatgaagattcttagatggttgtatataaatgttttcatgtataaattgttttattgaaattgtgctgtagcaagttattgattaggttattacataaaaatagtatttttttaggataaaaataaagagattatatgacaaggagtgagtggccctttaatatttttaccggttccccaagctgcttacagtcaagatctgagttagtggttggctggcagtggacagcactcttaacagtagcatgtggatgcttagggagcccctggaagctgccatgacccacagtcagccatggatagtcttctttatgtgagcattgtaattgcagctcttgacttttaacacgcatagtgagttatcaccttaaattgaatttcgtttttcctttttggaagaatagaaggtaggtgagtgagtgaattctacaagcatttgattttcatttatcctgattaaatcctaagatcctggattttaatgacactttttatctccacatccagaattctaagaagttggggtgtgaattgggcatttgataatagtgacttttctgttttctggttttcttggtaatggattttaaaagtctgttttactgggagacttatcaaaattttcatttctttaaggtgttgactttaaggtgaaaacaatttcagtggatggaaataaggctaaacttgcaatatgggtaagagtttttaaaatgtatttttaaaatattaaactttactttttaaggatgcagaaattgatttgtgtagtgttctagaggtggtgaatgaacaatttgtattaaataacttttgggagatttgatactgattaaaggataaacagtaatgtcttataattgggtaattaggcagctatgttttgtttaaattttcacaatgcataattctttatgaatatttcaaaacagaacagaatattaaaaaatcatctcatctgccaaagagaatcataattggatatgtttctttgaagttttaaaaagaccatctagactgaactaacactaaagacaatttttaaggggaggaggaatgacgtgatatttaggaaaaaattttatttttcttgtttgttagtatagatatttataaaatttgaggtttcaaactttgggcttatttttaatgcctcgtttttccttactggcttcttttcgttttcctgtcaatccaaccattctgatccccgttactgtactagctagaccgctcatgctagtgtcaaataaggtagcattaactgtcaaaaatatccaagatgcttagtgtctatgtttgtctctctctgtgtctccctttcatcagtctatttacccacccacataccgatctatctatatctgtctatctaaatatgatcggttatatatatatatatgtatattctaaatatatactgttttatatatctatttttcacatagactgtgataattatacatatatgtttgtaatataagaaatcatattagaactgatcagtcatcaaatcgagacttatttccacatggtggttaaatggtaaatgctgtttgtacatcagtcacagattgaaaacagcaagtgttcatgcattgtatgatgtcatatttcttggcattctctgaatggcacactgtttctaatacacatttatccccaaataacaaataattgtgtaagtgtgtttaatgtttttatgtcagtttttcctaacatacaatactttaaatttgttaacctgtttgcccctttcccccaaatatgtttaatatcaatcagaacggtaatgtctaacagaaaacaatttggaaaatgttggactagagtatggtaaaatgtgttgaacgatataagaatgttggctttttccatactaaagtgggggcctgatttccatatgcttttcatggttaatttattatccctttccggccttgctgctgctttgtgaaatccgtagattagagtagtatctgagacttgctggttgcagtgagatttttctctcatagtttcgttttgttttaaatttattttctagttcctgcctaataaaaaggctggcaggtattattgaagagacatttttaccataggcctataaacattttttaaagaagagaggttttccccctggctgtaagaataatacagggtcattctaaaagggataattgagacaataagaagagcagagaagaacatctataaaagtataccactgaatacattttagtgagcattctttaaaatatcaagggatatgtatacataccactatacataccagtatgtgagttttccaaaacaaagggattatattatatcttacatttttaaacctgtttgtcctcctttcctaccacctcacccccactcatagtatgtgctgtatccgtttagatggccagctagtattccgtttcatagctgtactttagtcagccttcagtgagagatacttacatttttgccagcttttcacaaagattacagctctttgagcatcctgatttatacgtctgtgtgtacttgtccagttactttagaatgtgtagctggaagtagaaatgaatatgaagtcttcacattaatgtacaccaaaaagccttttttttcagtttatactcccaccaattgtattcatattcattctgccacatccttatctctactgttatcattctttctgtttttgcctctgagtgttgctgttttacttatatttgcatttcttttgataagagatttttgcctgtttattgatcattttaaaaaataagttttctttttacatattttacccattttatacgttagcattcatctttttcttcattaaagtctttatataataaaattattagctctttgtcatgtggtacaattttctaagctatcatttgcctttaaaatcatgtatcagttgaatatatgtttgtgttcttgtgtgtgtgtgtaatactgccatatgctacagatttttttttccagtttgtcatttaccttccaatattgttaaggatgaatatggggatggggaggtgaagaggaggtaaagggtgttcttgtcatttcaaggttttaatatttatatggttggatcagctattttcatcatggcatttgggtgtaacgtatttaggaaggcgtttcctctgtattagaaatatatgaatccatagttgcctaattcttctatagttttatttataaaatgagtttctctcctacttggaagcttcttctaggatgaaatagaataattaagcatagccctgcccctcctacctcctgaaagtgcatactcatcatgaccttgttttcttctactgccttttcctatgtccttgcttcactttcactccctacatctattattaagcctttctagatctttcctagccctgagtttatctatatatctttcagtaatttcttctctccttcccccatcagaaaataaaactacaggatagagacaaaaagctgtgcttcatttatcttacaaagatgttattatacctaccacatattcctgttttgaaaacaaacacaagcaacaatctaacttctatttaagcatatacactttatagttactataaatcctgatgcgatgctattgcacatggttccctccaccccctaaattataacacctatttaaacacttttgtaagtgaatccaaaaatggcaagcctctaaacatctggcctaattattaataaatattcacaagcaaagtttcaaagtcaagtgtaatatttcaacattaaaactttcttgctatggtttttacttttaaaacatcaggatttatggatattttaactggaattgcagttctgatttttatgttgtgtttcattaaggcagtttttgaagttgatctcaatgaagaccagagagaacaaagttcatgttcacttgtttttctgccagctctggaagttatggatacagtttccttatgcaaatagaataaactttcttcctgttatcaaaaagtcttggggctaaaatatttcatacttggtccttgcctcaaactatttgttatgaatatagaacagtgttccatgtatggaaaaatagctgcttcttaaatttccaaattcactaattcactgtatagaaaaatagctgcttcttaaatttccaaattcagtaattcactgttccaaatccaaggcttgtcttttcagtaatggcttttccttcttttttttttttctttctctctaaaacagatagtctgtactactaaaagttaaatgcttaacatggtgcagttctcaaagttataatgtatctggatactgaataatttgaatattactaatttgtcattttttgcatgtaagcagatagctaggatacgttctcataatgatttgtcatttaaaaatatacattttttattgagtatgaatcagattgtctgaaataggtactagtacaaggctatgaagagcatttctagtttcttattatatatattaccaattgcttcctaaaagtggtgacacttttactgatacacatagtaatcattttactatgatatgcatagtagttacatcttttggcttctagttgattactttttttttccctgcaaatttgggttttgattacttgagcatagtgatcaaaaaagatcactgggcatccatataccgtttcattaatgattaatggactacaatattgacttgtctcatgttatcaaagttataatctgctttatatagcaagttcactttgctttaaacagcttttaatttatattattgttcttgaaaaggtgagtaaatatgcaaattgaataattttaaaatccaaggcaggttttgtaagaaacttagaggcagagagaatttttgtaaagagaaaaattatttattttataaatttatctgttcagaacatttactttaaatctgttaattcttcacttaagcatggcagggtggggattagtttctgtggtggtaaggatctggaaggaaaggctttcaaatttatgtaagtgtatctgtggaagagtggtgaatgttcaaagtggtttacattgaaacgttactttcctcttaagtttctcttctggggttataaatgactgcagatcctccctactgtcttgctgaagcccctcacgcccctggtttgaattcttctccaatcttataaacctcttacaggttattctaacatttttatatctgggggagcttctgcttgtcccataacaaaccctcatttacagcagtgggactggtagctaagttgaggtttgatacatgtttttacttttacttttctttaggttactttgcatcagcagactgcaaactttttcttaaagagccagataggaaatagtccaatcctgaagtgggccatgtggcaatacgtaagcaaataggcctgctgtgtttcaataaaactttatttaataaaacaggtggtgggctgagctgctttgtataatcttaggtaccttgaatccatagtccaaggatggtagaaagacaagagagagaaggaattgggcccggaagtaaaggcttgttaaataggttcattcttttttttttttctcaacaaattctgagcaactgccttttttcaagaattggtctcagcacaatggttaaactggtgattaaacagatgagtccctgctttatgaaatttacattttctacctagtgtacattgttcactaaccctaacatgagtcagaaataacatgtaataaagaatggcttggttatatgcattttctcaaaaggagatacatagaaaacacttaaaagagcccaacctaaaaatctgttacctaaagtaagacatcccataattttcttcaaatcagtggttctcagccttgattctacattaaaagcacctggtaagatttaaaaaaaaaaaaattcctgtcattaccttagaccaattaagcagaaattttttggaagctagactcaagattcccagaaaatttcattgtgcagctggagtttagaaccatgggtttcatttcatgtatgataaaagtcttaaattcaaaacagcagaaaacctttacatagtttcatttttctagagatcagtatttataaataattttgtgacacttgtcagtaagcgaacacatcttatttaagttccagttttttaatgagctcatgcattaatactatttttagtaatgctgtttgactttctactcttaaactagtatattgaaggtctatttatactttgtttaatttaataataatgatcatttttaggatactgctggtcaagagaggtttagaacattaactcccagctattatagaggtgcacagggtgttatattaggtaagtgtttactttaatgtactatttaaaaatatttattggagtttctgattgtcctagtctgtgaaagttaatatgtctttgttttacttctcgttagagctacttttatgtaacttgtagttgtattaacttcatgtaatattaatgaatattaaaacttttgattttagtcttgtctagcacttaaaaaatagacaaggctaatttatttggtttgaaaacacatgtcaatgagaacgtaattgaggattaatcagcatatgttggactgtcttggagtattacagaaactgggcttctgttatcagcatattaatatttgctgtagtttataaaggacgaaaagtatttgttgattagtagaatctgctttattagtcctaaaaatatcacaaagcacttaacactattgatttataatcaaacaaaatttagaaaccagatgtggattctcagtgtaatttgttgaaaagtgcttgttcttgatattcctgggaaactgtttaaaatgaatattgatcaattgtattaataggtagaattctctttttttaaatattatggcttggtagtgacagccttttggttcagcatctcttgagtttataaaacactttaataaggtttttgttataatgcagaatgacataagatgaaagtgataacaggaagaccaccaggaacccatctactaactgtactacaattttttcaaagctgtaaattttggttcttgtaataaacaaattaatggggtcatagatgtttacattcatgtattttttttttaatattttgccacagatttgaatctaaacactctggtttttggatagacctcattcatcattatgaatgggaatagctgttgttttgctttaatgggtattaaatgtgttttcacttattacacaggatataatttcatttctgtgacagtatatgttaataggattgaaatgtgtatgctttaaaaaaaaaacacttgtttcttccatttggatcagtagacactcaatattaatcgttgaagacaataaaaaaaagacttgtctatattgcttagtaatgctaactcctagctacatatcagaaatacgccattgcttctttctttaatgcttatttaacaaatgactccttttatttcagtttatgatgtcacaagaagagatacatttgttaaactggataattggttaaatgaattggaaacatactgtacaagaaatgacatagtaaacatgctagttggaaataaaatcgataaggtaagaaggcagacacttggcattttggttctatattttggtagcctttcttaatcattgcatttatattttaggaaaatcgtgaagtcgatagaaatgaaggcctgaaatttgcacgaaagcattccatgttatttataggtaggtgtgtgaatgaatatctgtcctttcattattaatgaggaatttttgaatggagtttttgccaagtttatttctttatgaaccataaaatgtgtttagagtattgttcctagttgccttgtgttacaaaatctaactatataacaaggttctttattcttcttcctgtaaaatgtatgatcatattatgtgaaatcatattaaaaaacagtcaaatcattcctcacaggatatagtggcattcagtaaagtttggcacccagtgctaaagttatgccttgctggtccatatgctgataccatcagcaccacctgggagcttgttagcagtgcttcagctcaggccctaccccagattttctgaattagaatctgcattttaacaagctcttcatatggtttgtatgcacattaatttttgagaaacatggtccagcaagagttgccaaactacagcctggtccaaatctggccccaccatttgtattggtacacagccatgtccatgtgtttacatgttgtctgtagctgcttttgtgccatatggcagagtttagtagttacaacagaggccatacggcccacgaagcctaaatattttctatctggccctttacagaaagagtttgccaacccctcatctagaaaattggatgagctatgtcagaatcacctgggccctgtgccttattacaggtttgaaaggcagtttattgaaagcactctagttgattctgatgtgaagccagctttaggaattacggatttaaccattccatggcgttagaagctaccaggaatctgcaaatgaagttgagaggacttcatatatagataaaaacagaatggaattagtggaaagtattgagattttcagaaaggaatcgagtacttttacttgctgtatgtccctcatttccatacattagtttacccaatatttattgaacactcaagatgtaacagtggacaaaactgacaaactttctgcccacatggagcttacattctagtaagggagacagacttaaataagtaagtagtgctatgaaggaaataaaacattataaggggagagagaatgactggagtggggactgcttagggaaagttcttagaggctgtcccatttgagcagaaatccctcaggtgaggatctagagcaagcttgtccaactcatgggctgcatgtggcccaggatggctttgaatgtggcccaacacaaatttgtaaacttccttaaaacattatgagattttgtgcttttttttaagttccagctatcattagtgttattgtatgttatttgtggcccaagactattcttcttcttctaatgtggcccagggaaaccaaaacactggacacccctagtctagagggagatcatctcaggctgagagaggagcaaatatttcctgaggtgggaatcaggctactgtgttaaaggaacaggaagaaagcgtgtgtactggagcatagagtgtgttaaggagaaggcagatggtgagagatgccattcaaatggtaaagagatggattgtattccaattgtggtggaaagtagggaagcagcggtgtgacctgatactctaaaaagatcctgttgtgtagaaaatggactaggggaaacagaagcaagagactagttcttctcttgcagtggcccagatgaaggaagaagcggtttgactgtgtagccgtagagggtggtagaaaattggcagttctaggagatacagtgaaggtatagctgacaggatttgtgggtggattgggtatggaggataattaaaaagagcaatcaggcgggtgcagtggctcacgcctgtaatctcagcactttgggaggccgaggcaggcggattacgaggtcaggagatcgagaccatggctaacacggtgaaaccccgtctctactaaaaatacaaaaaattcaccgggcgtggtggcgggtgcctgtagtcccagctacttgggaggctgaggcaggagaattgcttgaacctgggaggcggagcttgcagtgagcgagatcacgccactgcactccagcctgggcgacagagcgagactctgtctcaaaaaaaaaaaaagagagcaatcagagataactccatgttttaggcatgagcagtgaggtagattgtgctgccaataattaggatgtgaaagattgagataagagcaggtttagggtagggaagtgaggaatcaagaatttcactttgacataagaatgagacatttttccgataaccggtggacatggtggtcattggcatttaggtggcattcaaggtcatgtgattagagtggtgacttcaggaaagaacgtggatagaaaagggctgaagaagcctgggcaacatagtgagacctcatctccaaataaaatcagctgtgtatagtggcatgtgcctgtgattccagctgttctggaggctgaggtgggaggatcacttgagcctgggaggccagggctgcagtggagctcccactgcactccagcctaggtgacagagtgagaccctgtctcaaaaacaaaacaaaacaaagaaaatggcagaagattgaaccctgggggattccagcaattagaggtcagcagaaagaggaagtgccagcaaacaaggctgcacatgacatgtcagtgggctcagaggattttcaggcatgttcagtgtcctggaagtcaagggaacaacttgtttaaaagaagaggaagtgattagcagtatcagataccaaagatgtcaaataaaattaggatattggatttgacaagataaagggtgttggtggtcttggaaaagaatgatttcagtggagtggtgggaatgaaagcctaattagagtagtttgaagaaagaacgtgagataagaaggtagaaacagcttatgtggataactctttagaagaggtttcaaagagagtggagaaatgggtggctacaagaagggcatgtggcctagagagcaagtttgttttttaataggatggaaaataattcggcagacttttaggctgattggtatgatccagtagagagagcgtttggtccttcggtgaatgagaagggatgggactccaggaacaaaagaaggcgatggcttggatagcagcagggacagtttatccattctcacaggagggaaagcagagcatgaggatacatatgcaggtagcttggtaaatttattagtgggatgatcaggcagttcttgccagattgcttctgattttctcagcataatgcagctagattattagctgcgatagagttttgagaggaaggaataaagtactcatctcagacggtgagaaagatcatcactaaggaaacgcagggttggaagcagtgctgagtgtccagttgagtttcatgagcaaacatttgctgtgggaccagttttcatggtggtttgtcattttgtccagctgcctggagctgcttggttgaaggcacagaataatcagattaattgtttaacttgtatgaatttctttattttaaaataggaataatatctgccttgggagcaagttgtaagagttaactgaaagcttaaggaaaaaactttcgcttgctatttaagtagggctttacaagttacaattctatcacagttttaagattataaaccagtgtttttttggtataaaattatatactagtattcttatggatagaatttaattagctcaattttgagatttggaaattcactagttattgacctttggggaaaaattgctgatttggatcttaatatattgtaggctgatatttatgccctgatagtttcccagaaaaacatgagaatatggccagaaaggaatatactatgaatgacctttttccttgaatttcagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagagattagtactcctattatgcccattttaaaggtgaggacaacacaatgtaggtatgttaggtaacccccaaagatcacatagctactcagtcactgagctggattccagtcatggcatttttacttctgagcccatactcttcaccatcgctcattttacaatgggtagttagttaccagctttttgtaacacaaccaagttaaggcagttccactatttctttatcactcttttgttatatgtaatagaagtatttcacacttttgggttatagagtaaatcccatgatgtaaacctacctcataagtcatgtgacataaaagttaaggtagtggagtaggtggtcttatttctttcacctgctcagagtggactgaaaatcctgacttagaaaaggtacaaagttaggggacttatggtaccttcactttttatgtgagaatagaaattatggaaacagtaatttgctcaaaactgaaatctggggtgatgttttcatttcatgtatttgattgccatccataaactcatacttggtgttgacattctagctgagtgttgtggaaatagacttgattttgattcatcgtagcttgcatggtcaagagacatgattctctactaagggtggggcta

SEQ ID NO: 12877 - DNA, 27380 bp, Human
  misc_feature (1)...(27380): n = A,T,C or G
tggcctcccaaagtgcgggattacaggcatgagccaccacgccccacctatttttttcttaaactgttagaaatgaagtctgggtgttcccacattccttagcaatccaggtgtcttccttcccgttaattcctacataaccacaggccctcgaaactacaggatgcccttttcctccatcaagttccttcttccagtgcttctgagaggccccaaggaacactttcgtgttccacagacctgttggggctgcgtcttgtcctctcggccagccacttgggaccaaagcctgctcttctccctaagcgtcccttgtaacctgtttttctcgctgtagcttccccacactgccttgtcatcaaagtcatcaaaaaccctctatccatcatggttcattcagtagcacagaaacctctccagtctttcagaccaagggactttaatgtaaaggagctcgtcacccagaggatgaaggagctgggacactaatcaggacagacagttcagagatttccccaaagcaggaagctgtgccatcccaccaactgaaaggaaagatgaggggagaaggtgttgccagagccaggagctggcctccaaacaggaacaagaaagacataaggggttgcctggctgatggactgtccagagggagccagaactgcagaggcatatggccattgctggggaagccactcaaacagaaaacgaggggagaaatgctctgatctctgcctccccagtcttcccccaggggctaaacctatcagaaagcagttgataaaggagtctagaaaatgtagtttcctgcagtttcaggaaatgactggcatgggccctaccttaattcctccaaagcacagcttagatttggctgttttgtcaaacaaactttagcaatcagggctgataacaattacaattcaggaaagaaaaacttaaacaccgatctcagcatatcacagcccattacacccaacccgttggcaggatccctgctaaaatttcgcttgcctttgtgtgcttggggccaggcaaactctccccaggggcaggaccctcccaatcgtgtccaccctgaccagagtccaggccccagggcccttctaccttctccaggccctgcaggaaggagaaaaccatttcctaaacacctgtcccttcattcacacgaagctcatgtgcagatcctgccctacgtggcaaaatgatgggagagcagcctgaatcttcatcgtcccgaaccaaagccccattcatgaagttcagccccatctctagcacagcagaaagaatcactgaagtttgagttccattttttttctaaacttttgcagatcctagacccaaaggctcaaggtaagagcggctgggcttcctcacccccaacggcctctctaggggagagctgttcccaagcccaccccaagcgtggggacctgccttgatatggaggatcaaggaggagcatcgggtgccctcaatctcctcctgccagaaaagcaaaggagtcacagcttttcctttgctgcaagaaacattctgggaccttttttttccccctctgttgtccagttattttcatcagggtaaatcccctaggaatagaattattaaagcaaaagatatgtatgtggtgtaggcttttgatccacagtgccaaattgctttttgataaggctgcatatcgtggattattcttgccttttctgcccctcagctccttgataaaccacttgggatgaatcagccaccggaccagataaacaagccagcctgttgctattgctgttttctgcaagtcggaagggaactcccttagatcccgcccagaacctggaattccagagcacacagggccaggacacctttgtacccctgctccccaccggcacaggtcccacccacccccttctccccgccccatgcccgggtggagccagctgccagggcgccaagactcccagccctctctctgtgcacggcagagtagaggccaagggagggctctgtgccagccccgatgaggacgctgctgaccatcttgactgtgggatccctggctggtgagtgcccatctaccctgtggtcagacctcccttatcccaggggccaacgatcagggtcatctccccagcaccctccccagcccgagcatagccagtttcagtttctcccctgctagggctgagcagggtgccgggtgttcacggagaagcaaatgcccagcttagtttgctgggggcatgagagggtgcctcagaccctgggttcttccagggacccaaaggaccctcgggtcttgagggatatagccagctgtctgaactgggggtgctggatcgctgcacctcagtgaatggagaattggcctggaggaggcagacatccttcggtccctcaaacggtgtcggcacagtttgtaccatccttcctctgcctctcacttggcactggcctgacaggggaggaggaggaaggaccgggggaaacgaagcttgagttcactattgcctccctccatgcccctgcagggcctctttggccccttttgttatcatagatctgaaagagcattttctcctagagtggccaggtctgctacattaataggtcttaagacacaggactcatttggaaacaggtcttaagggcatagtgttcaaagccaataaagtgagcggagtggggggctcatcattatggagaacgttacatgagaccctagactctctctctgctctcctggtgcattgcatgaaattcagggaacttccttaggaagtcaaagcatagtcctgattgaggatggcgagcaggtatggcctcggccaggccctccttgctcaagtgcaggacgaggcccacgaaaaggcagagcttcccaccttctctgccactgtcccgccagggctgcctgcgtccccagagcttccagctctgtgggaccccctccagtctgcttcccagcatcaagctgggcgttccaggaagatgtgaggcacccccttgaggcaccaagacacgtccctttagaccctcagccatactggttagaaatcctagaggctcccagccctttgagatgggggaccccaagaaatagcccttaggagattgtcaagggtcagctgtctcgcgctgcacacaccgggccctcacccccccaatcttaggctgactccagagcatgtggaattgtttcttgtttgtgtatttttccttagcttcccagctggttgacagaacattgtttttccacatgaatgtgaaaaaacaagttgccttttataaatccgccaggctgccaggctccacacaacacatgtctccccagatttcacaatatagactttcacccgggaagtgccgaagcaacacaggctgaggaatggatgatagatttgaggaggaaaaggagcgaggagggtgggagaagagggggagatcttgttagaccctgacatccctaaaagacaggagtgggcctaggttcacttaccccacttcaggaagctaactgcagttccctcctgaaaagtggtgccaacctccacgtagcccagggtcctttgccttggcaacatgcccccacctcagccaccagcctccttgcaacccagatgggccctctatttcccacccagaacactgacctcaaccagcaaccgttcccgctgcagactctaccccaagccttgatggagcctggcttctcaaagcccaccctcacccttctgccctgacccaccacccaaccagaagccactgttcaggtctgaccttgactggactcctttcctcaactttagactcagccctgaatccaggacccctccctccagaactgaccccaattccacccagcctcacatccaaacaagatgtcagctacatcctaaggctccacggcacagccgtcaccttgcgtagaggcagtagacccctccccgcgccatccctaaggccccattctggggactccaggaagcctgaagacattttgcagctgctgggccagaacccaaattcagagaggagggcagccttcgaggttggccagaggatgtgcagcggggtcggaccattcttccgtccccatcggtcctcgccaagcctgaggacccctcttgtgtgtagagttggagtaggggaatcaataactgtctgctccctcacaccttgggcccactggcagtcgtagtcgtgtctggggaaggagaggcacagacatattcaagacacacacccaggccgcaaggccttgacccagctggggttgcttaacattttcccacctgtttatttcccacgccagccggccagggcctctgagctctgagccagctgccagcttgggccgccattttcccgcaggctcttgctctccacagcccaagcctgggggcctgagggaagggttttataagttaaggactctttgtttacagtgcagattgctttagaggctgcagcccctccccagccccttccttgaggctcaggccctcactgcccttcccttaacagaagcagaagtgggctggacaaagacctagcctggaagagagggctgtggactcttcaatggccagcttctcttctcctctctcttctcctcctccctaaattcatccctttatcaggtgctcaggtccctgaagccccccaccctcatataaaagggtgaacaagatagccccctccctacagagcgaatgtcttcccttcccaggtctcctcccttcagactcaacacatgtacataggggcctgttagacactaaacacattcacagacgccaacccgctctatccgccccacaaccagtctagcactgggatgaatattgtaggttcttcacatgctaactgtgatgctgggcggcagctctctctgagcctcagctcattcatcaaatggggatagtgatagtgggcacgttgtcgtgaggatttaatgaagggagggacttgcctgaaagaggctgtgcacttcacaaatgccagtggctgctgttgtcattgttgtttgtctttcggtaaatcaaactatatccattttagagatgaggcaattgaagttctcgttgcttaaacaactttcccaaggccaccctgcccacgtgtgggctcagtcaagagcgcctcctccaccattgcttcatctgatcaacttggggcaagtcacttcttacacactttagttacatatctctaaaataagggtgaggacaccaacttcaggttgtgttaaaaagtgaatgagagacaataccaagcatcaatggcgatgtggagaaactgaacccctcaaacaatgctggtgggaatttgagatggtgcagccataacatcctggacaatatatgagaccccatcactacaaaaaatttaaaaataaattagacggatgtggtggtacatgtctgtagtcccagctacacaggaggctgaggtgcgaggattgcttaagcccaggaagtcgaggctgcagtgagccatgatcacgccactgcactccagcctgggggacagagcaagaccctgtctcaaagaccaaaaaaatggtgtggccactttagaaaatagttcgacagttcttcaaaaggttaaagatagagctactatataacctaccaaattccactcttagatatatacccaagacaactgaaaacatatgtccacttataaaattgaacacggtgttcacagcagcattattcatggtagccaaaaagtagaaacaacccaaatgtcctgatgagtggataaacaaaatgtggtatatcacacaatggaatattattcagccctaaaaaggaagtactaatccatgctaccacacgtgtgaaccttgaaaacattatgctaagtgaaagaagccagccaagctctatttacataaaaagtctagagtagggacattcacagacacaggaagtagattcgtggttgtcagggtttaggggaggagaagaatgggtggagtgactgctaatgggcatgcagtttctttttggggtgctaaaaatgttctggaattagataatagcgatgattgcacaacgttgtgaaaatgctaagaaaccattgaactgaacactgtaaggtggtgacatttatggaatgtgaatcacaacccattgcaaagcaaaatggctgagaatggatggttggttagaacagcgtggggagcatcccctcttgctggtccatttgtagaaggctgggggccagggtctccctgcccacccaccaggctggcatcttgaaagcaaagacactttgcatgaaatttatatggggcaggactctgactgagcccatacatgggcagggtgaccctgggaaagcccctgctcaccctcctcccaccctcctgcagctcacgcccctgaggacccctcggatctgctccagcacgtgaaattccagtccagcaactttgaaaacatcctgacgtgggacagcgggccagagggcaccccagacacggtctacagcatcgagtataagacgtaggcttctctcttgaccccacctcctttgactgatctgaagccagcccctctccaaggaattcccctcctctccatatgttcccatgtccccaccaggactggtgtcacatagcccctcccagataaagctttgctcctttatgtttcttttgcagagggagaataatataagggtaaaaagtacaggtgatagggtcaggctgtctgggcttaaatgccgctctcgcctgtataaccttgggcaggtaacctcacgaagcctcagtttctccacccacaaagtgaggacaatgatagcactttcatcacagggttgttgggtgggttaaacaagataaagtcattagcacttgtgcctggaaatttataagctaccaataattgttttattattattagtgagactaggtcaaccgaagatgcacccagcccctctagcccacgctcctgttcctgctcctctccctcccatgcaggtgaggaggggtggcctgggctcaggagtcctcaaacctggcttccactcctggtcatgccacgttgtcctgtagcaagtcacttccccctctctgagcctcatttctctcatctgtaaaatggggataacagggcccacatcaaaggactatggtgatgacgagcccagaatgtggactcagactggctgggttcaaatcctggctctccacatgcacacttcaaacacgtgggcaatttacttctttgagcctcatcttctttgtttgaaaaataaacagaataggctgggcacagtggctcacacctataatctcagcactttcagaggctgaggcaggtggatcacttgaggttaggagttcgagaccagcctgaccaacagggtggccatactgtctctactaaaatacaaaaattagccaggcatggtggtgcactcctgtaatcccagctactcgggaggctgaggcaggagaatcactcgaaccccagaggtagaagttgcagtgagccaagactgcaccactgcactccagcctgagtgacagagcgaggctgtgtctcaagaaaaaaaaaaaaaaagaaaggaaggaataaagaaagaaaaagagaagaatgcatatgcctcagagaatcattgtgagaacaaaatgagatcattcgcataaagggcctgggccactgaacgtgctaagtaaatatcagatctccttggcattattaataagccacaggcctagcgctggccttttcatcaccacggtgacttggccccttcctgacctgcaggtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacagtgagttggagcccctgtgggtttcaggggagggaagaggaaagcgcaggtgtttgcggggtgggatggcctcttcccctctggagtgggtggagggtccagaaggggctctctgcaaggggaggggcagctggggatgtggcttttagggaagccccccacccccaccaattacagtgtgttcctagcaggtttgttcacttttctccacctccaccccaacctccctagttcagaccacccttatcttgacccccgactgcagtcaaggccacctaacttgtttccccaactctcctctttaccacctcctccagcccattctccacagagcatttagagagatctcctcaacacataaatcccaccttctcttctcagcttaaaaccctcgggcagcttctcatgactctacaaataagatccaactccttgccacggcccacgaggccctgcctatcctggtcctcatcttgaacatgtcttcccaatgcatcgagcagccaagcttctgacagtccctgcctcgggttccttgctgctcccactctctgggggcacttctgagctcttcacatgactggttcttttatagtcctcacggctcagcttcaacatcctaagtcagtgtccccacctccagccctgatgacctgatttctgtaggccaccatctgtgattctctagtgcaatacagggcttattgtcttcatcgctcagatcacacgctgcaattactgtgtttgctcacacatgttatcatctgcctccccctctaaaatgtgagctctagaactgtatgtgtgggcggcagaatccactgcattcccagccctcagcatagtgcctggcacatagaagattctcaatagccaggcgtggtggctcacacttgtaatcccagcactttaggaggctgaggcaagagcatcacttgagcctaggagttcaagaccagcctggggaacacagtgagaccccatctctacaaaaaatttaaaaattagctgggtgtggtggcacacacttgtagtcccagctactcaggaggttgaagtgggagggtagcttgaacccaggaggtcaagactgcagtgagctgggattgccccactgcactccaacttaggtgacacagtgagatcctatctcaaaaaaataaaaaagatattcagtaaatgaatggttgagtggacagcagttgctgatatggtttggccatgtccccacccaaatctcatcttgaattgtagttcccataatcctgtcttgtgggaaggacccagtaggaggtaactgaatgatggggacggttccccccatgctattctcatgatagtgggtacgttcttgtgagatctgatggttttataaggggcttccccctttgcttggttctcattttccttcctgccaccatgtgaggaagaacatgtttgcctcccattttgtaagtttcctgattgtaagtttcctgaggcctccccagccatgtggaactgtgagtcagttaaacctctttcctttataaattacccagtctgaggtgtgtctttattagcagtgtgagaatggactaatatagttgccaaactccccacacaagctaagcgtgtgacgatgttcaccaactgactttatagtcacacatagctttttaagaaaataaaaaataaaattaagtaaaatattgtttttttaacctggcttgttcagtgaattcacattcattgtagaaaatgtgtgaaatatagaaatatacaaagaaaaataaaagtcacccaaaatgatcttaacattgtaacataactgcagatactagcagccgtatctactttgcaatctggcattgcttttttgtcttaggttctttttctccatatattggtatcatgaacatttacccatatcattaaacattttgcacaacaagatatttcacagtgcaaaataatccattctagggagatactctaatttacttatgtatttccctttttgaggacatacagctcagtttttcaattttattagcagcactgaagtaaacattgttctgactcagatatcttcaatcttggaggccaaaggatcattgaggaatttttacaaattagattcagggtaaatgaggtccatgaatccctgaagttggatgcaagatttttgtatatatacattttggcaggaagaagacccacagcattcatcacattctcaaaggagtctgtaaaccagcaaaggtaatttggttatttggaaaattccatcttgagagagacagaagtcttcagcctgatctttgaggctgcatcaatagtattaggccccaaacattatttaggatgtgtagttgatgtcattgacatccccaaagctgtcatactcaatagatgagggaggaagggtgctctaggctgacttaaggtggggacgcagggggctgggatgtgtgggggcaagccaaaggcatgaccaagctaggggactggtgcccctccccctgagttcttctcatccactcttggtcatccctttgccagcctgaaacccaaacaccagggcttgtagaaacttttctcttttcactgtttgtttagccgttgctttcagaagcatagctggcactggagtggaaggagagagggagcagtcattttccactgtccaaggttgcctcagacactacccaccgattctgactttttcttttctcttttctctctccctatccccagctaccctcaagccacctgatgtgacctgtatctccaaagtgagatcgattcagatgattgttcatcctacccccacgccaatccgtgcaggcgatggccaccggctaaccctggaagacatcttccatgacctgttctaccacttagagctccaggtcaaccgcacctaccaaatggtgagtgtatgttgcaccctggtctttctctgcctaggaagcctcttccctcccaattagatctgagttgctttaagaaaaaaaggggacatgttatgtaaattagcatttcccaaaacatgtcccttgagaggctccttgaagcctggaaatcatcacaaatgacaacttttctcttgtagattcacacacacaatagcatgctaaaagctctgacaagtcctgcagagccaagactccactatcaatttgttttgttgttttgttttgttttttatttatttatttttattttattattattatactttaagttttagggtaaatgtgcaggttagctacatatgtatacatgtgccatgctggtgtgctgcacccattaactcgtcatttagcattaggtatattatcaatttgtttaatacaatttctccagaatttatttgaccagagaagctgctttttttgcataatatttacattgttttttgtttaacaccttctcacatcctggggaacaacctctattaatatcttcagatgttcacattagaaaatgctagaatcaatttctactgctgcagtagttttccaatatttgcaggaactatatacaggcaatgtggaaggatgagtaataataagaggtggaaggcaagggcatacattctcaaatagtacatgaattatttcttttcgtattcagaaaatatttggtaccccctaccctcagcatgtgccaccaatccacaattcagttaaatgaatatttatttcctactttgtggtttctgcatgcaaggagcttataatctagggggtgaaaaggaagttaaaacaagaattcaaatagctataggtagaggaaaatatgggtattgggaggtggggcaggatgtcagcacagcaagatttgaaagacttccagaaaacttttaggaagccaaaaatgacataatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacacggtgaaaccctgtccctattaaaaaatacaaaaaattagccgggcatggtagtgggcgcctgtagtctcagctactcaggaggctgaggtagaagaatggcgtgaacccgggaggtggagcttgcagtgggccaagatcgcgccactgcactccagcctgggcgacagagcaagactccatctcaaaaaaaaaaaaaaaacacacacacaaaaaccatggtcccaaacaaacagcatcagaatctcctgcagcacttgtttaaaatgcagattcttgggtccccttccagtcaacttcatcaagttattgcacttgcatccctgggatctgaattttagtgagcaacccaggcgcttcttccccaacgcaaagcttgagaacctctgacgtggagggaccccgggagataaacctcagaagactggatgggactatgctgtagaagggatagggtggtggaggggacgaatttttgtttctttcggtagttgggggagccactagagattactaagcagggagagtccttatcacaactattttttggtaaatatttagggtcttattaaatattttattgttgatttctaatttaattcaatttgtggtcagagaacacacgctgtatgatttcagtccttttaaatttatcgaggcttgtgttatagcccagcctatggcctgtcctggtgaacgttccttgtgcacctgaaaagaatgtatattttgcagttggttggtggagtgcgctataaatatcaattaggtaaaggtgattaattgtgttattcagatcttctatgtctttcctgatttaggtgagaggtcaattggtcgtttaattgttgaaaatagtaaactctccaactataattgtggatttgtctattttccctttaattctgtgcatttttgcttcgtgcattttgaaactcagttattaaatacatatatatttatgattgttgtatcttcctgatagattgaaccttctgtcataggaattgttcctttttatttgtagtcatactctttgtattgaagtctactttatcgatattaatatagacactccagccttcttatggtttgcataatatatgtttttacattcattttcaatctgcctctgttattatatttaaaatgtatctcttgcagacagctctgacagcctttacctttttttgacattaattcacatgccataaaattcattcttttaaagcatacaattcaggtgttacttgcctattcacaaagttgtgaaaccatcaccactatctaattctcccttatcaatctttcttcaagttctctattttttctgtcatttccaaaatgtttttgagataattcagtgggtttttaaatttcagataataatatctagaatttttcaactctaaagttcctagattttatagtttccatattctactgagattttctattcattcattcaatatgagcttattttgtttcacttcctggagcattgttataccgctgctttaaaatcattgttggccaggtgaggtggcccacgcctgtaatcccagcactttgggaggccaaagtgggtggatcacttgaggtcaggagttcaagaccatcctggccagtgtggtaaaaccccatctctactaaaaatacaaaaatcagctgggcatggtggcaggtgcctgtaatcccagctactcaggaggctgaggcaggagaatcatttgaacctgggaggcggaggttgcagtgagctgagattgcaccactgcactccaacctgggtgacagagtaagactgtgtctcaaataaaataaaatcattgtctgctaattcaacattttggtcatcagggtcagtcactattatcttttctcttgaatatgggtcgcatattctttctttgtatgtctaacaattttgaaatgtatcctggacattgtgttgaaattactgtagattctgttatattcctccaaagagtgttggtttggtttcatccggttttggtaggcaattaatttggctgaactccaaactctgaaatctctcttctttttttgttggttaactttacctgggctgcttggagtctaccccattcatgcctactttaggggccggtcagggatttgagcagagtttatatacagagtttgggcctccttctctacactctcccctgtctgtgctttctcccctcattttccagctgctgtgattattccaagccctgccttttgggtattcaagccactgagaataaagggtttctgtctaggtttagccattccacagggtgtagactgaggtctgccttcaggctacaagacagtaaaaatgggaaatgtacccatcgacatttctcctctctccaatatatgcctgcttttattttctctccaatgcttttaagtagttggttttcattttgcttagaatttatagttgttattttggggatgtttggtccaatagaagatataaattactaggattagaatgaagaaagatcaaatatggaaatggaagagatatcaggctggcaagtcaaaagattattgcaatggtataggctggaaatgagggcctgaaccaggatggaggtcgtgaaaaacttgggaaaggaggaatcagggccttggcaactctcctggagttatgtctcatgatatgtaatgtgtccagttccaaccacatgagttccacaaaacaataagttaaaaaatttatttatgtacttcttcactcactgtcaccaccatccccataaacacacacaaaagaaaacagtaaattaccctcaaccttggcctccatgtgcctgaaaaagagaaggcagagctgaaatacaaagagccaaagaaaattctcagtttttgaactcccgagaacacaggttctggccctttaaaggaagatttctggatcctttaagggcaatttgataccaaagatatgagaggggatttgtccaaaatggcttcaaggtttaggccctggagattagaagaagagtgatgctattatcaaaattagagaatcaaaagcagatttgggtttggggtctgggatggggccagccccagagagaggagggcagcatgttcggacatgttgacttagagatgctcacatggtactattcagcagggagctggcagggcccatcagaaactctacagctcttcctgagataagtttgggagttatccacacatcggtgctcacagcagccatgggttcagataagatcactaagtggctggagagtatgtgagagagaaggaaatggttgaagagcaaatcttgcagaacaacattgaggggctaaaaccagcgaaagaccagtcagagaggtaggaggagagccagacaggataacatgtggcagccatgggagaggagttctgggtcaaaaaggtgagagatacacagaagaacgagaatcaaaacacagttccagcagaaggattggcagatgcaaagaaacaagggctttcttatgcaaggtaggtgtttacccgagtggcaggtatccagcattgatgagcctgcagagccaggtgggctgcagagacaaatgagtctggactggaagccaggcaccaggactctattctgtaaatatgggtgaggccatcaaagccttttgaatagaagagcattataatgagattgtcttttagaaagattcctataaacactaggatgaatatggaagtgaacaggggcaaacccagagatgggcgaccatgaaagaggctactgctagagtccaggctgaagccttgaggcccaattaaggcagaagcaatgaggaaagaaagaaaggaatgggtgttcaaaaagtttatgatgtttaaccacaaaaaggtgaaggacaagaaggaattggaagaaggagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgagcaagcttccttgggctctatgtggagatcggtgtgtaacaggaatcacattccattctctgtccaattcagcaccttggagggaagcagagagaatatgagttcttcggcctgacccctgacacagagttccttggcaccatcatgatttgcgttcccacctgggccaaggagagtgccccctacatgtgccgagtgaagacactgccaggtgagttcggctgaaaccagagggaggtggggctcccgaattcaagtcttgactcttctctttcctccctgtaaccaaggtgagacttggcaacactctagaaaaccatggaagggttatcagtgtgttattgaagtcaatctttgtttatccataaaagagttggctgatgagttatcaaagcaaatgtttgattctcaccctccagcctatgtctggatttcccctctctgacaggccttatgtgtaccttggcaaagcaaactcaccttaatattaacccaggtgagatatactggagggaaaatctgcaggggggaagcagagaagataaaaagatccctcaatatcttccaaagtcaaataataataatggtatcatgataactagcatttctgcagtgctaactgggaaccaggcacaaccaagggcaagcctcatgagcagtctatgaggtaggtattattttcatcctcattttacagatgaagaacctgaggttcagagtggttaggtaacttgcccatggccgggcacagtggctcacacctgtaaaccaaacactttgggaggccaaggcaggaggatcacttgagcccagaagtttaagaccagcctgggaaacagggcaaaaccccatctccacaaaaaaatcaaaaacttagctaggtatggtggcgtgcatctgtggtcccagctacacagaaggctgaggcaagaggatcacttgagcccaggaggttgaagctgcaaagagctatgtttgcaccactgcactccagcctggatgacagagtgagaccttgtctcggaaaaaaaaaaaaaagtgacttgcccaaggtcacacaggtgctgagggatggaatgaggcctaattctagaggccatgctcttaccacagagctactatagatacagttgggttttttgtgggtttttattgttttttgtttttgagacagagtcttactctgtcactcaggctggagtgcagtggcacaatctcggctcactacaacttctgcttcccagtttcaagaaattctcccacctcagcctcccaagtagctgggattacaggtgtgtgccaccatgcctggctaatttttttttttttttttttgtatttttagtagagacggagtttcatcctgttgctcaggctggtcttgatctcctggcctcaagtgatccacccacctcagcctcccaaaatgctgggattacaggcatgagccatcacgcccagcctagatatagttttgaatcatctgctcagtgagatggtcccttcctctagcacactgaaacttgattctcatcacaagcatcatgatgtttttattagtgtttcttttcatagacggagggaaacgttgtattgctcagagctgcaggtttagaggatgaaggtgacggcagtggatgtgatagatttggtaaaacagtctccactttatcctcatgttcagattcatgatgtcagtaagtgatttcagttccaaccatgccaacattcagaatagagttgagtttgcaagctggacattgtgtgtggcatagtggaaagagaagtaccgtgtgaggaatgagaaggcacggtattagtcagatgtcagccaaccacgtgcctgggggagtcactcagcctctgggagcctgatccctcatctgacaaatagggatgctgatgcctgggctgaggtgataatcagaggccaggcagctgccagagctgggccctagaaaatgacactctggtcctcaggtttgttcggaaactcatcacttttccaaacagcccacaagagactgatttctccacctgaatcccagtgcaccaattggcaggggagctatgcctcacggaacagccaacactggccacttgcatggggcatgcccttcctggggcaaaggctgctagggagctcagaatagaacttggcaagaggagaactagaaaaaggaaactgacgttctggggctaagctgggagtgtttgtatgattcatgacccccttccctggactgtcctagataaatctcagctgctcctggcccatgggacctggcccaccagctttttgacaatgtgaagaccactccacccttacccacaacacccttctgttgccttactttgtcttgcttataatgagataccattttttcctaagactatagcttttatataaatcacacttcctggtggctacttcttgctgacgtatagaaggcaccttatccttaaaaatatatttaaaacaattcctacatttattaggttctactatattgccaagcaaatagttgtgccaaatgctttacatatattatttaatctttattattacatgtaacatatattatttaatctttacaacaatcctgtaagctgggtagcatcatcctcgttttacagaggaggaactctggctcagagaggttaagcaacttccctgtgaccgcacagctgcttggggaacctgattgattcatctggttctgaaggctgggctctacccaccactttgcaactttgtttacagtgagccccctgtactgcacacttcttcctcctacttccatttcagagtgatgcatcctgcccttgactgtgtatcctgacgtctgcattaccctcagaatcccctttacctacctctccgtagataaacagggagggtcacagagcattgtcccagcatcttgatgacggaagaggctctaagggccacctcacctcatatcctactcttacagatgaggaaactgaggcttccttgcagagtggcagggaggatgagttttgagttacacatgtaactccactgagtagctgtgtgaccttggtcaggtcacttaacctctctgggactcagctttgttatccataggaagggagcgtccctacccctctgtgatgtgtttgatgatgtagtgagataacataggtagagcacccagctctacatgatcatacagatcatggcctgtagtaggagttcaaccactgctggctactgttattattaaagggtagaccagagagggtcgtgcagcaggaaggatgctcagcatatctgtggcagagccaggcctctaacaccctgtattccttactctcaggctggtggtgtttttatattccatccagcctccctatgggtgaaatggcaatgtatccaatacacacagtgtgaaatggaaatatgtcaagccagagaccattccatgtccctattctgtcctggaacaaacagcagtggttttccaggaatgttatagacattcgggtggggtctttttcctggagtagggatgggggtaacatgtgacaggagacagggtttcactgaagtgggaagctgacccagagaggcccaagctcgtgggctaggggaggatcgaggagtgggctagaagtagaggttccagcagtacccggagttcacagtgatcgccgaggtcattggagctattgataaactctccaagctgaggctgcacaggggccaggaagagagggagggtgattagctggcccctggactgcaggggtcttgactctctgagtcaccttccctctgttgcaaactgtcagttttaccaaaaactccaacaacctcttcctccataagtccttcacaagccccacttggactggtgacaggaagtgtgtcctgcctggaactggctgcacccatcccaaagatgctgagacacagggagaggctcaggcactagagccctagtcatccctctcccctccattttagacaggacagtgccttcccaggctcccttcttgaccaagatcttccctgatgcccagccccttatcttggtagggaggtggagaggacaggcctccctgttttcacttctcccnnnnnnnnnnnnnnnnnnnnnnnnnnnnnnnnnnnnnnnnnnnnnnnnnnnnngggcctttccctgcacccagcactttagaaggcccttctctggccctgtcctggccattcccctccttgcaagatgaagactccatacaacaaagggggcagatccatctggatcctgtgacctcctttctagatcacattgtgagtacctgggaccctgaaactctctgtacatatggcccagagcctgtgatccgtctaggcagtcctcttttgggggtacttcctcatgagggcagacactgctgacatgtagtgcagacccttggcccaaaggatgaccaacaggtggctatttggaggggacatggatgagctcgaccatgagggctggggcatctatacacatgtgcgtgagggccctggcagtgtgggatggaactgggctgggctgggctgggctgggggcctgcagtgcgctgcgggctttccctgtacctccccacttcagcacagtacctagagaagtccaagaactctgaattaaaatatggcatcccaggtggttgtaaaaaatctttttgttaaggtggaaacctcgaacattttatttatttaacagtgtaaaaatataatttgtaaattctgactatttagatgtacagtatatggacttccatttgtgatcttgcattctgacggtaggagaggccttgccagcccagccagagagggttttcagcatccacatgtggggccagacccaaccgggcccaggcagagcccagcctcacgcttccttctctggcccctttggtttcccagaccggacatggacctactccttctccggagccttcctgttctccatgggcttcctcgtcgcagtactctgctacctgagctacagatatgtcaccaagccgcctgcacctcccaactccctggtgagccatccccccagggtgggagggagaggtccaggggagggcctgggctccgaggtccccagttgtccccaaaatgcagggatccacagacaaagcaggagatgggcctgctctctccattcacggagctcacagtcccagctaaagtcaacggacgtgtagcccagcaggtctcaggacacatttgaagtggggtgggtgatcaggaatagtagacatggaataaaaaacccacatggcttggaagtgtccagcaccaggagggtagtgtgggacttgagtgagcagcaaggcaacgagggaggaatggtgggcgccaggagagccgtggcactcatgccctgtctaaatgggcagccgggcaccaccatgtgggaatgcaggcccagcactgcctgatcttcatgtttttcaagagaagccagagtttcagattatattgtggaatctcccaattttcaaatattcagaactaattttttaaacagatttttttttttttgagatggagtctccctctgtcacccaggctggagtgcagtggcatgatctcgtctcagcacaacctccacctcccgagttcaagcgattctcctgcctcatcctcccaagtagctgggattacaggcatgcaccaccaccacacctggctaatttttgtatttttagtagagacgggttttaccatgttggccaggctggtctcaaactcctgacttcaggtgatctacccacctcggcctcccaaagtgctgggattacaagcgtgagccactgcacctggccattttaaacagaaatttttaaatggcaaaactaattgttaagtggaaagccctttgttacagttcttttagaattgctgtagcaagtgaagaccagaaccaccccccacccaaaaaataaaaccaccccccacccaaaaaataaaaataaaatggaaagccctacatcagccacacaaatcacatcagcagcccccacctgacgccagtgccgcctctgctagagcagcaaggccactgcagaagccatgagctgagccacctgaggcacccggagcctgctcttgcccatcggagggacagaggagctctgagggagttttgctcaatgtgcaagtccagatgaagcattttctgtaaagctctcccggtctctcctggctccttcttttcccaccctgaccctgtattaggccctcagggacccgtgggccaagcaacaatgcgggccaccacctcgagatcatgccccaaggcaaccccaaatcctggtcatctactccctggattatccgcctcctggagaaaccagagcccagatctctctccctgagataacccaggctttagaaccaaagagctgagagaccctgtcccttcagagaggcacttgcacctagaggagtctctggggagcagatggggatatgggacagacgcatcttgaaaaagcccccagatgcctccctatggaggacctcacccacccacatcaccagtagggagcttgggacttaccctaaccacaggggggtgactgttgtcgtccctgcacagaacgtccagcgagtcctgactttccagccgctgcgcttcatccaggagcacgtcctgatccctgtctttgacctcagcggccccagcagtctggcccagcctgtccagtactcccagatcagggtgtctggacccagggagcccgcaggagctccacagcggcatagcctgtccgagatcacctacttagggcagccagacatctccatcctccagccctccaacgtgccacctccccagatcctctccccactgtcctatgccccaaacgctgcccctgaggtcgggcccccatcctatgcacctcaggtgacccccgaagctcaattcccattctacgccccacaggccatctctaaggtccagccttcctcctatgcccctcaagccactccggacagctggcctccctcctatggggtatgcatggaaggttctggcaaagactcccccactgggacactttctagtcctaaacaccttaggcctaaaggtcagcttcagaaagagccaccagctggaagctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttccggtccatgttccccctcggaccaaggtccaagtccctggggcctgctggagtcccttgtgtgtcccaaggatgaagccaagagcccagcccctgagacctcagacctggagcagcccacagaactggattctcttttcagaggcctggccctgactgtgcagtgggagtcctgaggggaatgggaaaggcttggtgcttcctccctgtccctacccagtgtcacatccttggctgtcaatcccatgcctgcccatgccacacactctgcgatctggcctcagacgggtgcccttgagagaagcagagggagtggcatgcagggcccctgccatgggtgcgctcctcaccggaacaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctatttcctgttgtgattttttttttaaactacgttacacaaggagtgaccccctcccccaattcggattggcttcagacacacctggcattttctcatgggcttaaatgacctggatttcctcaggacaggcaaagctagaggggtctggggtgggaaagaggagggactgcagggccttctagagacaagagttcagagacaaatgatgtggaaccttctccctgagatcgtaggcagaagccattgtgggtggcagtggtaatctcagacggcctctgtccatccagcctccctgatcccccacagaggcagtgttgcacactctgtgctctcagactgctgccataccctccgtatcactgcatctcagacgacccctaccatgaggaagccaaagtccagagggagaggggacctacccgagatcccactattgaggctgtgacagagttggagtgcaaacctagggctttttgtcctcatcgagagaggaagctttccacacctgcttggattcttggaggatgagactagtggaggctaaggaggggaggcctcctaatggggtccccaagagaaaagtgctcctggtcaccttgctccaaagtctttttgtttgtttgttttgtttttccttttggagaaagggtctcaccctgtggcctaggctggagtgcagtggcatgaacacagtttactgcagccttgacctcctggactcaagtgatcctcctacttcagcctcccgagtagctgggactacaggtgcatgccaccatgcccagataatttttggtatttttggtagagatggggtttcgccatgttgcccaggctggtcttgaactcatgggctcaagtgattgtcttgcctcagcctcccaagtagttggaattacaggcgtgagccaccacacctgccctccaaagccttttctgaacatttctgagaaagaggatggaacaccagtcacctcagagggacccttcccagagtggacagtgtccttctcttcccaggtacatctcctcttctcttccccacccctcccctttcctgggacacagtgacaggtggtggtgttcttatctgatggtaattaatgtttaacatctcctcggtgtcactggtttagacccaacacctccgtgcagagggatgggtctacctggacagccccccccagcccattcacccctccacggcagccaagtcagccggatgacggctcccctctccccacccactgcaaacaagtctacttcctgttgcttgggtcacacttggccaaaggttaactgtcttcaccttgtttattggtgaaaaacaacctaacaggtggactattctcaccaagtgagacccaggagctacagaagttttttattaagaccaggcgcagtggctcacgcctgtaatcccagcacttttggaggccaaggtgggtggatcacctgaggttgggagttccagaccagtctggccaacatgagaccccctctctactaaaagtacaaaattagctgggcatggtggcaggcgcctgtaatcccagctgcttgggaggctgaggcaggaggatcacttgaacccgggtggcggggtttgcagtgagccaaaatccagccattgcactccagcctgggcaacagagcgagactccatctcaaaaaagaagttttattaaaagccataaatatctcttccaactcacagtaacacgaagctctttgccctcctccgggtgacaaacatttcagaaatgattctgggagggtggagtctgagtgtctgaagagagggatggatggcttcgagtctgtgactcacccctcctcaggttggccctgtctgcactgaggggcggggaccagactgcatgacccctgaggtcccatgcctcccaggcagcccaggcctgcagatagagctggaaccagccagaaggcagagcgtccgcataccctggagctggctggggacctcatcgttcctgagagtc

SEQ ID NO: 12878 - DNA, 7571 bp, Human
  misc_feature (1)...(7571): n = A,T,C or G
catgcaacaactgggaaggagagacagtgggctcttgggactgggatcttaccagagtaaggtagtctttgtcctcactccaggccctacagacaaaggatctgggccacttcctagtccccacctgccccccacccccactcccgagtctggggcaggtgccagggactgagggccagcctgaaggcctccccaccagcagctggagctggagaaaggacttcaacttgggtggggggcatggctgtaggtgtggtaagccctagttacctgaggtaaagactgaggccccacatggagctcacagaggaagtccgggtggcccaggacacccccagtgcatcaggcgctgactggcaatggtggatggggctaggaggtaggccctgtgattcctgagaaggaggagggcagatgctcctcccccaacctcctggggacacttctcccctcttgcctggaggaactgttttctctccaaacagacctaagggctcccagggtgcaggaccctcggagtgcaggaccccctcactgagttctcacagtctctctggagccaaaggtcagcatctcctcaggacaggtaaggaaacaggcccagaaagggtcagtggtttcaccagtagtggcaggaccaaagagaggagttcagcgtagggtagctttggggttgttcactccacggcttgggcttatactcttctaaggatggaaagaaagatctagagaaggtactgccaacttcctccaccatgttggagcttttgaggctccgcaatggagccaggtcccaccagagtttggtctttacactctcagagcacccactggccccctggccccaactccgcccagtaacagtttcttgatgccccaaagctgggaaaaggcaaagctgcatccttcccttctcctcgaatccttttccttttctaactagggggatgtaaccagcctacagtcttctgggggctgtcaaggaggatgtgtccatggatcacttgaatttccaattcaagcaaatctcggctggagaacatttttctctcagggcagcccggagagaaatgaggccgtacatggtaaactgaggcagaggtgggaggggtgcacaggtgccgctaccgctctgccccttgcatccctgaacgctgcctcacccttgccgggttggcggtgttgagcccgggactggaggctgcttgagaccacctccttcccagctgaggagcgcggcctttgcccctcctcctcccgacctttccggggctacctaaaagccgatcaagccgccggttttctagctgttcccatttctttaccgcccccttcctctgccccgcctgcctctgtgccctccgtcacgtcacagcccgctggctctcacgcctcttttggtctctctgcgcacatctcggtggcgtctctggtgccctcacatcactgtctggaatcttgtttggcccacgccgtctgcctctgccccttctctcacctgtgtcgtttgatccctccgactctcgtctctgggggtcttgcctcccgaactctccggctctctccttccagggcgtgcgctccgctcagtctccctcggtctcggtcggccggcctctttcacgtggccccctcctttttggcctcccttccgcctccctcccttctgggtccctccctccggctcagcctaggggttgggggcggcggcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtctccgcagccgccgacaaaccgcgggcgcagcagtgggcgccgcgatgcagcggccgggggagccgggcgccgcgcgcttcggcccgcccgagggctgcgcggaccaccggccgcaccgctatcgcagcttcatgattgaggagatcctcacggagccaccccgggcccaagggcgccgcgcccgcagccgccgctgccgcggcgggcgagctgctgaagttcggcgtgcaggcgctgctggcggcgcggcccttccacagccacctgggtacgtgtggcggccgcggggtcgcgggccgggcttggcgggagacagcgagctgaaccgcgggggcgccccgagcctcctccggcatcgaagcagccccgggaagctgctctgggagcgcaggttctgggaccgtctctcggagccctccaggcgggaggcggagggtgcaagctccaggcctcacagaaaccaggcctcgtgcccgcgggccgcccggggagggtgttcgctctttccttcactgcttcccttcggcctccagcccggggaccccgagtgagcatccccagtgcaggcgcactgccaggctacggactctcgtgggtggaagcgacctcaggccacgggcgcctgggcttcgccgcagagggatggccgggagtggccgcggctgcccaacccagggaagtcggacctctggggaggaggcctgcgctcccgagggctgggtgctgacgcgggcccaagccggcccggagtccccgggagctccagcgggcgaggaacgcggccttggccgcagtgcggacctgcttcggccttgccttggggccagaggcctgactgtgagcagctgcctggctgtcccttctggtttcaggtcggctgggcctctgcagggcttgaacggcctgcgcagaccttttcagcttctgccctttcttctaatttggcggggcctgctctgccctgatggtgctgtctccatcgcactccaccctcgtcttgtctttccctatctcgctttccaaccgtctgccggtcggcctccctcgcttctctcattggggtcggcctgcctcccatctcccaccttttccctacgggtcctctgccccacatttacctgcgccttgccctgccctttccgactccagccaggctaggactcgcacctcagtgacaggcctgtcggggaagggaggctcctacgctgtagccgggaccccagcccttcaagtcgccttccctgcacccccccacctcctagtcggtgctccctagcctggagacggcagggccagcgcgctccttctaagtccagctgggactcggccattcggctacctttcgtctccatctgctctgttgctactaattcgtttgaagcgggcacacaatcattttaggactgaagaaaatggaaacatctgcatggggaagcgtctgaaaatagaaaacgtgaacaataatttccaggttctcagggtactttggaatttccgggaagcacccaactccggcccagatgactcctggccaccgcatggctgttgtgccacgcacggaagagcaaatgtgcacgctccgtgcatgttctttttctaacgcagcaaggctgatttggttggagcaaacgccatcttcttaggaccagctgccgttttctttttggtttctactttccccgaaagacaagacacactccgagtttctcgcagctgcaaacatgttcatcaggaaccccgagatctcagaggcagctgaggcctggggaactccaggacagaacacggacagggtcgaggagatactccctcccaaatctggggaacggcaacgttgaggagggtctccatctgcgccaccggcgccgaccggcagggcgtggaggttttgcgctgggaggcactggccaagcgcgagcacccccgcggcacgtggtgcggcagtccctggggcagaggagcgcggccgtagctcacccgggtcctcattctctttcttcgcagccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacaggtagggcggtacaaggctggggccagcgggctgtgggagtgtggtcacttgccttgctgagggtgcgccctgctctttccagaatagatcttgctgagtccctgggcctgagccagttgcaggtgaagacgtggtaccagaatcggaggatgaagtggaagaaaatagtgagtgtgcctggtggcttcccaccccttagcttcctgggccatgccccggtgcatgcagagctgctctcctctttctccccactgagactctgcccaaccccccgattccctcggtgcctggtacgcaccggaatcctctcagttttttctgccccttgggtaagccaacatttcgtcctttcccgcggcaccttcaggcctcctggcagtcttatgctccccaggccgggccgctccccaggcggcatttggacaaatggccgccatttcccgggacatttccccaccatttcctcatatggaccctgcactccttagtcctacctgggttcaagtctcctcgggggtccccagtccacgtgctggctcacccaggtgctggcggtcccccgtgcaggtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaatcgggctcggtggagcagcttctgaatccgcagggggtgagggtgggggtgggggtgggctcggcaagataagcggaacgcgggcagttgcttcttaaacttcctttcctccggctctgtcgaaggcagctgtgctcttcaccatcaagcccgggctaggcacggcgggcggctcggtggctgcaggatcctaggaatcgcttccactctgggcgtgaggggccagtctgaactccacctcctctcccttgccagccagagagtcgctggcaggagcggtctggccgcaccgcgggtgcccaaaggagcgggagccagaggtccgccgcagagctcgctccggaagtggcccggacagagagccgcctcggttgttgtttcggtttcctgggacttgaaggaccagttcgtgcggtccttgagatggtcttcaccaaccctttatgaggcggatgggaagtcgaggacgcaaggtttggacagagcccccccaccagcgcggtagcccgcccgcgggtccttgcagcagcaatggctccccagagttctcacattttccgcaggatactcagggcggcggcgcctgggctgctgagttccacctctgggcagtgagggcacctggccgacggagagagaggactcagctgacaccggcctagggagggtggtcccttgcagggacacagcttggttgcatgtgctctcaggtgcccccttctcatggaggtctcagttgccttcccgcagtctaggctgggctcagggctgcctgtgggttcctgtccttgtgcttcctgaagctgggggtggggaggatgaccagaggtggggatggagcgatgaccactttactggttaaagctcaggaagactatgaaacttggccattcagagttcctgaagccaggtccttccagactcaaacaggaaaagagatttaggtacaacaataacaacaacaacaacaacaaaagagattcaggaacaaacaaacaaacaactcagctgcaggctttgtgtttcagaatgtgaaagtgacttcttctggcccccacctattgtggcaacacctttcctttcagatcttggcttgataggctcttcccagaacctgagcttgcacttcccctgccggtacctcaaggcggaaggaatgaggggtgggcgggggggtggcggggggagggcggcgtggggagaggaagagggagacagcaagcactttccgaaggctgcagccactttcctcaccccagtcctgccaggtgtggtaaaccagctcttgctcactctgagttcttaattcagccttgcaaacagctcccagactactcgcctgcttttcctgaggagccagaaaacctacccaaccttgaccgcctggaatgaatgaatcatcagtctgtgactgcggcccttaatcccttccagccttggggttactcctacgtctttcaacctagtgaccctacagtaactttcctgcgctggtcccagcagccaagtgacttacgtgactgcatttaatcctctccatttgaaaggacaggaagtgaaggtctgacttctgtggaaagggaggcctgagggacctggtttccagctatgtctctaccatacagagttgtgaaagaaggtagaatgcacctacaccagtcaagaggggaaaggagggggatctgaccagcatcagtcacagttagttcagggctctccggttttactaaatccgaggaaggcaaccttcagcagattagctgccttgcgaatctttggcattttcccaaggtgccttgctgttctggacctagtggtctttgtaggaccagggctctgaggggttggggagggggtctggccaatccggagtcagagcacaagggccccaatatttcagcgagaacagccacctcccggcacagaggggaacttgatgcgggaactccggtccgggggtcacctgtgggtcagtggggaagttgggcctcaaatgaggg

SEQ ID NO: 12879 - DNA, 139577 bp, Human
gagatcactccactgcactccagcctgggcaacagtgtgagactccgtctcaaaaaaaaaaaaaaataggccactgaggatgagagcactgctcagtatggcactactgggattccagcccctttagtggccagggcatcatttgcatctcagtttcctcacatgcaaaatgggctatttgcagcctgatgggaaggggatgagaaggtccgctgggtccaagggaccaggatggcaggaggttagcaaggcctgcagagggcagcagtgagctgcgcaccgcccacccagcctagaaactggggcccatgggttttccagggcaggaatgttctccaggggcactaatattaacaggcaatcacgaaatcgacccctacacaccatttatcaggttgtgttttatgtttgccccatctgggcattttatgcaggatgctctcaacattttgtaccgtggcccacaggactgggtggaagacaggacagctcagagcagggagtgaaacaaaatctttgatggttctctagggaagcctggaaatctgagacagggcaaagagcagggagtctgatgagcacaaaattaaaatacccaaaccagcctgccgggtcaggggaaaaggaagcaggattgggcacatgaagaacagatgacaaaactgaggctcagagaggctgagagagacactgctgaggtcacacagccaggagtcggcaggaagccctgaacccaagcagggctggcctggctactagcctgggctcagtcctttagattggacttcaaagtatctgctccagatgacgctggcattgggaggagggcatgataatccctaacatccacacagggacaacagcacttggaggcagatgtgcttctcacttcaaggaaactgaggcagagagggagaggtggtcaggactcaagcccagtaattcatttgccaaatcctgtttccttttcccccaacccagcgggctggtttgggtattttcagtttgtgcccatcagagtccctgcagagtgctctccactgtgtctcagatctctgtgtccccagagaaccatcaaaggttttgtttcactccctgctctgggctgtcttccacccagccctgtgaacctcagtgcaggttggccgcccccttagagggaggctaatcagggaagttctgagtcaggtcgtcctggaaaaactacattgacctctggagctcaagagaggccaggggacaaacacatggctcagcacacaggaaggcaggtgtgggtattgagtgacctgagggagaaatccctatttatcatccatcatgtggtcctgctgtgacaaacccgtgtggcagccacccacagcagatccacaacgtgagaggcccgctgaaacaagggtgctggcattggttactcagcctggccctccctgccttgcggggtgacctgcctggtcctggcctctctgtgagttgggccctgctgggtggtccctagtgtgcccagccctgaggctggtgagaggccaggctgtgaggtgtgaggaacttacctgcgtctccatggaaggtgccctccgcatcgttgggccagatctgcctggtcttgcagatgcccacgatggtggcctctgacacgacgactgggcagtgccggtgacgcttatggcactgcggcgtggtaggggcagaggggggaggttgcttctgtcggaggactgctgcgagttctgccagagagagcagctcttgtcccggaacatgaggtaggtggtggggcttggggacacgcggctggactggccggagaagtcctcctggccggaggggagccaagtgttcctgttccaggactgcagaactggcccagacctctgtattggaaaggtctttatggaccagggagtccggtgtcttttttacgggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcaggtgagttcctcacgccacgtgcgtgggcacacctgcacgggggaggaaaaccatagacgagtaggggatacaaaacagaagttgggagggaggagtggatagttttgagtgtatcaggtgcacttgtggttcacgcggatcctgcacccgaacaaactccatcccctcctccttcctgaatgcatactgttagtgtttggaatggaattgggttgaggatggtcttgtgagggatgggaggtggtttgttcctttggttctagagcaatgtgtttgtgaagtacagcttgtgagttgaaggaagatgcttcaggcagtaacctccttgctatgtgctctctccatgccgggcagtgaggatggcataaaagccggagtcatctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagattttatctgggggtgaagcagagccacacccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgagatccagacacagtttgccattggggtaaggaaagggtgggctggggtgtgtgtgtgaggctgtcgggaatcttttggagtcctggtccctgttaagctcatctggttttctgcttcattgatttttctttttctgctgatggaggagttgaatgtgcttggtttgtcaaaatcctcttcaaacgagtgaggctatttttggctcttagagctgctgcctttttgtggtgggcactctgtcctgtttgtgttaggtacttccagttactgatcttccatttgcagctggggtttcctgtggtgcacggctccgacctgccgtctggccgggctgcattccctaagtccctatgtgggggcggggtggaaggctgtactattcagaagcctgctttgcaggcacatcagctcgttcggggtctggaggattgccttgtggttactgggcaccagccttgtctggccagctgttggtcaggcgagccagcttgaactggccctcagtgccatggtgcaggagagttattaataaagaagaaaatgagaggtttttagggagatgtgcaaattgaaattgatagtctttgctggtggagaattctgggtttccagaaccttgggcccagcctttcctacagctcctgtagacttggccatgttggccacatcactagacgccgaatgcaagtcagtaaatgaatataggaattattatagagggatggaaagcccagtgccttgagtcagacagggcaggtcctcaggaaatggctgaggaggtaattttaccacttggacccacttttaggacttgctggattcttctccgaatgtcctcaaggtcccacagtctctttcccattaggttttattttttcccccttaaatgttttgtttgttttttgtttttaagagacagcgtctggctctgccatccaggttggaatgcagtagtatgatcatagctcactgcaacctcaaaactcttgggctcaggtgatccaccacagccttttcagcagctgggactgcaggctcaaaccactatactgggctaatttttaattttttttttttgtaaatacagggtcttgctgtgttgcccaggctggtatcaaactcctgggctcaagcattcctctagcttcagcctcctgagtagctggggttacagggatgagacacctcaccaggcctcttagacgtttttagtaactaaggtcacttaaacatttttaaaagggattattttccctcagacagtttttcttttttaagacttaatttttttagagctattaggttcacagcaaaattgatcgggaaatatagcaatttcccacatactccctacccctacacccccacagcctccccagttaacatctcccaccagaggggcatgtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactctgcctagcagtttcccctgacgtgggtccatgtatggcaggcatggaaagaggaatcctcactggctcagccatctgtctctgcctgtttactgatgttctttagagggctgtggagcctgctggtctgaaaaggaacaatgaggaaaatcactcatgggggtgggtggggggaggaagtcaccctaatgctccgcagtggcagatgtggtgacccagatctaataacctcggaatcagtctgtttggatgaatggaccgtcccatttccaagttgagggcccctcaagggagggggctgaagccatccctgggcacggtgacaaagtgcttcccatagggcccctcatgggctcatctgtcgccctggggtggggctgcccatttacaggtaaagacacaactgggaagcggcaaggctgggattctgggtctctgtgtgaatgcagagctgttccgtttggcacgtggtggccctgcggtgttcttcccactaccccacactgctacctgcaaagcacaactggggaggttcagggcgtccttccagtctttgcaccctgggcccgcctgtgggggtaatgatagacggctgtgagccctgctgtaaaactatgcagaacccggccgggcgcggtggctcaagcctgtaatcccagcacttagggagtccaaggcgggtggatcacaagggcaggagatggagaccatcctggctaacacggtgaaaccccgtctctactaaaaatacaaaaaattagccgggtgtggtggccggcgcctgtagtcccagctactcgggaggctgaggcaggagaatggcgtgaactaggggaggcggagcttgcagtgagccgagatcgctgggctgcactccagcctgggcgacagagcgagacacagtctcaaaaaacaaacaaaaaactatgcggaactcacagaaggagagtgtggttctctctgttttttttgttgttgttgtttttttgaggcggagcctcgctctgtcgcccaggctggagtgcagcccagcgatctcggctcactgcaagctccgcctctcggcttcacaccattctcctgcctcagcctcctgggtagctgggaccacaggcgcccaccaccacacccagctaatttttttgtatttttagtagagacggggtttcactgtgttagccagtatggcctcgatcttctgacctcgggttccgcccgcctcagcctccgaaagtgctgggattacaggcgtgagccaccgcgcaaggcggatagtgtggttcttgcgatctgggaacttacaagttaccggaagagagggagaggcacacatgtatgtgctcaagggaagtgagatcagagaagcttccggaaatggcaggactgaagaggacttgatcagtcaccagaagttggagggcagagagtagccgtttgccctaaggaaaaatggcagcaaaggcctggggccacccacgtctgccttgtgattctaggctgtgtgcttttctttaaatggtaaaatatgcttaacttaaaatttaccatttttgtaacttttaaaaagtttggtaaaatgcacataacaaaagttactgtcttaacccttttaaattgtttctttgggtaaggccagtcaagtgaagcaggggaacattttaaccatttttatccatacagttctgtggtgttgactacattcacattgttgtacgaccatcactactgtccatcttgaactttttcatcttcccgactgaagctctgtacccagtgaataataactccccattccctgcccccagcccctggcactgccattctccatctgtgtctctgaattcagctattatagatacctcatgtaagtccagtcctgtggcattcgtctttttgtgattggcttatttcactgagtgtaatgttaccaatgttcatccatgtgatggcagaaattgtgtggattttttttttaatggagtttcactctaggctggagtgcagtggcgtgatctctgcttactgcagcctctgcctccccagttcaagcttcaagagtctcctgcttcaggagttcaggattctcctgcttcagcctcccgagtagctgggattacaggtgtgcaccaccacacccagctaatttttgtattttcagtagagacggggtttcgccatgttggccaggctggtctggaactcctgacctcaagtgatccacccgtcttggcctcccagagtgctgggattataggcatgagccactgctctgggccaactgtgctttttgaaggcaggaataactggttcatttctgggtgtcccagggagcctggttctgagctttacacatagcacatactggaagagcccttcctccttttcatagcccatggggtcaggactggggacttttactgatcattggaaagtgacttatcaattactcggtctttttctcatttcatccctgtagtttactttctgaggatcttttttttttaagtggcttaaaatactttttttttttttttttttcacagttctctggttggctaggcagttttcctgttgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcttttttttttttttaatagagattggatctccctatgttgcccaggctggcctcgaactcctgggcttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaattcttgattcaaacacccagcccaatgtgcctgtcaactttcttccaggtgtcagttgtgagacgggacagatcttgtgtttcttcatggacttcatgtgagtggctgccctgtgttttcacatttttattaagcagcttaatttgccctttgaattccggtgatgagttggcgccagagtgaccactgcattgtttttcccttgggtgatgggctggactggcaaccagtttgagtgagtaactgtggggcagagaaaggtcacctgggcctggagttggctccatcgtcatctcttaaggccagagcctcgtggccacctctcagttgagtacaggctcctttccatggatggagacagagtgggcagatctgggtggagtctgaggccgctaaaggcatcagcagcacagaagcagagtctagatcaaattttacaagcgttctctggttcaggaaggctgacttgttttgggaacagaatggagcattctgaaacatttcactgaagaaggagctgggagtgctgttgatttgactgggttcaggggagcatgccttatccatgactcccttttgcttagtttgttgcttctagctttatagcctccttccttccttggttggaagtcctgtggctgggagggcttgtgtttgtgactgctaacctcaccaggacaaagagcccaggtgagctatgtgcttgagcacacttgggagaggacacagcagtgcatgaggcccaggctgcagctcacccctgtggtttgagagggtcccctgtttagagtgaatgaatgggcatcttggaagctttctcaggttaccaaagagtaggtctgagttttggctgaggctgctgctttttgggtcaagactcggggtggtggtggattaaattaactatgaaccccagggaatatcttgaccctgactggaatacaactgttgtggctcaagtaggtttttttttttccccttttgaaaagtgtagttattttaattaaaatacaatatccatgtaacatgttagaagtttgttatttttattattgtaaaattcatgttatattttttattttttcaagacggggtctcactctgtcacctaggctggagtgcagtggcacgatctaggctcactacaacccccgccacccaggttcaagcgattcttctgccacagcctcccgagtagctgggattacagctaattagcctagctaatttttgtatttttagtagagacagggtttcaccatgttggccaggctggtcttgaactcctgacctcaggtgatctgcccccctcagcctcccaaaatgttgggattacaggcctgagccactgcgcccggctaaaatttatattataagatgcaccattttctccatttttaagtgtacagttcagtggcattaagtacatcaccttgttttgcaaccatcaccacttgtcaatttctagaactttttcatcttcccaaactgaaacttcatatccatcagactttaactccccattccccctcatccccagctcccggaagccaccgttctactctgtctccatgattttgcctctcctagatgcctcgtgtaagtggagtcttataatatttgtcctgtgtctggctgatttcactcaagcagggctttgaagttccccagggcgacactctcagtcttttcttttttttctttctttcttttcttgagacggagtttcgctcttattttgcccaggctggagtgcaatggcacgatctcggctcactgcaacctctccctcccaggttcaagtaattctcctgcctcagccacccaagtagctgggattacaggcgcctgccatcacacccggctaattttttgtatttttagtagagatggggtttcaccatgttggccaggctggtctcaatcgtttgaccccgtgatccacccgcctcggcctcccaaagtgctgggattataggcatgagccaccgctcctagcctagccctctcagtcttaagactgagttaactcccagctctgatccgtcacaagggtgttctcttccggaaaacacccgttagcaatggcgatcttccctgggccttcacgcccttagctttgaagtggcccagagtattagtttgccaaggctgtcccataacaagataccaagactgggtggcttaaataacagaaatatattttctcacacttctggatgccaaaagtccaagatcaaggtgccagcagggttggttccctggagggctctcattggcttgcaggtgccatggtcttgctgcctctgcacatggtctttttctctgtgcatgaactcccctggcatctctctgtgtccaaatttcccttctttttttgtttttgagacggagtttcactcttgtcacccagactggagtgcaatggcacagtctcagctcactgcaacctccacctcccaggttcaggcaattctcccgcctcagccttccgagtagctgggattacaggtgcctgccaacacacctgggtaatttttgtatttttagtagagacggggtttcaccatgttagccagcctggtctcgaacttctgaccttaggtgatccgccctcctcggcctccaaaagtgctgggattataggcatgagccactgcacccggcccaaatttcccttcttaaaaggacaccagtaagactggattaaggtgggcagtaaagacccctgctttaacttaatcagttcttgaaaggccttatttccaaatacagtcacattctgaggtactgggagttagaacgtcaacatatggggagtgaggcatggtttagttcgtaacacttggtgagtccgttactgggcagcagaggaaagggctgccaggcagagggagatggtgtttgtgccggctccctcagacgtgttaggaggagtgtgagccaagcgtcatgtggttttaggcagcctagaggggcctagaggacactgagccaggcatcaggagggctgcgtgctaaaacttcgtgtgctgccatctctctccacatccaaaaagtaggggtgggaacaggtcattgctaaggttctttcgttagcttctttaatttttttctttaaatttaaaatttattacctttttttttaatagataaagggtctcgctctgttgcccaggctggagtatagtggcatgatcatagctcactgtagccacaaactctcgggctcaagcgatcctctctcctcagcctcctgaatacctggtactacaggcgcgtgccaccatgcctggctaatttttaatttttgttgagacagggtcttgctttgttgcccaggctggtctcaaactcctggcctcaaacgatccttcccgcctcggcctcccgaagtgctgggaataattatagatgtgagttactgcacacagcctgaatgtattattaacacaactttttccatctcttttctgtttatcttggtttatgtctcccttattaaaaacgaaggcaaccacctctccctatccaatcgctcaaaggtatttattgagcatctactttgtgcctggcactatcttcatggaaatcctttcttccttattcattgatttatggaaaggctgatctccaagggccttgtctttaaaacaacaacaaacaaacaaaacctttctaatgtcaaagcattttcccctgcgtatctttctttaacggtatatttgcagctgtttcctgttaatcctttgtctatctggcttcctttttagggtgatgggatccttaagcacagagtatgccctgctgtagtgtcctgcaggatgggccacactctggccctttaacagtgtttgatgtgacgatgcacctgagcccatggaggtctgtgtctcgggccccgtgggtgtttgcagattgaagatggaatgatacacaccatctctgagatttttatttgctcagaccttcccctgttctggcccaaccccgcttaatcatgtctaataagtggtggtgggtttttgggggcctagtgatacaggtggcccggcgatgaaacgttggctttggagattatcccgctggttctgtttccttctttgctggtgattggtactccctggctcacccttagagaacttcccgaatcctcagactggggcctgctaattagctgtcttgggttctagctctcactgccacgactttgcaaaatgactatagatgtggatggtggctggtgcccatgggcagagcaatcagcacattcatagacccaccttcctggggctggggtgtgaagaccggacaccccactgaagtagtaaatatgactttcatggaggctgcttcatgggccctcgaaagtttcttgtaaagtggctggagcaggattataattatactccctccactgattgagtctgagggggtatgagacactctggcctggagtaacctgcccaaggtcaagtggttggtggaggggctggcgctgcctctctcctcagactgagtggttgtgttaatcacatgagagcagacacagaatgactttgcggaggtggaggagacctggatcatttgctcagcaaaccggttttgggcacctgctgtgttgggcacagatggtgctcagtacagtcaggcaggccttccagcaggtcggctttggtctggtgggaagacagcctcattaacctaagtgccatgatagaaatcaactgaccccagcctttagtctgggtcttgaaggtgtcagctgtctaggaacatgtttcccctctcattttgcaaatctccaagatagggatttcctgactcttgatagctccttctgggacactttggtaaggcttctccagcaagttgtgtggcaaggggcccaagaagacagaactgttggaagggcgctgcccatccatctgcttttcccaccaacagtcaagggctgtgaatgctgacctgctgctgacagtggtctgttgtgcaggttctgggaggggcagagggacgaggtctggctgggaagatgtagcggagatacacagaggtagccggctgtgtgtgcacagggccaggtgcagggcccagagagccaggtgagtgaccagggagcactgggaaggaaccatctccaggcaaagccaggacacagccaaggggaccccagaagaagagaggggagccttgtgcagcagccacagagagagagagccaggcagagcaaggaattgagcagcccggggagatcctctactcaagtgccactgttggctcaagaagagtttttgaagattcacttcactttaaaggcctgacatgcttccgtgtttaaagtgctgctggggtcagtttgtatgcccgtagagtagggagagattttctgcacatgacgaggtattgatgagcattcgaagcaacctacaggcaacatatgttgacagtgcagactttgaagggaaaagatctggacttgcccagagacctggcacttgccactgtgtggtcttgcacagggacttaattctcccttgacttctgtcagctggagagggtgacccttccccttgggggcttcgtgggagtagcgggtgcagaccatctggcctcctgtctggtctcatagagtctcctgttcatgtatctgatgtcagttgattgaacatcacttagcaaaaaatcttaagaagaaatgcataatttagtatggacatttcactcacttggctcagccattgtataaccagtatgagctccggggggaccctggggtgtgtcagggccctcattctcctcctataatcctcctgggctgagtggagttcttacattttgaaggttatgcaatggactgcatgtttggatccatctgcaaattccccttttggggagaggctgagttgccctgtgcttgagggagctgggcagatggtactttgtgtagcctgctgcattttgcagaatgtcttctctcacaggggtccctgtggaggagtgacaggaaccctcttagctgagtgttgggaggttttaggtggagggctcaggtcacccgcaggggtcatttgactcctaccttatctgggtagataggatcatctttgtcccacagtccttcccagtattgtgaagtgatgcattggcgtgagcccaggggtgccaagggtgggctggcaatgcccacatccagttctctgtccctgaggcacggaggtggttgtgctgggctcagagccgccgtctgactggttggaagccctgctctgattttgtgaatcaccctagttaagtggaagctcagcgtagcctgttccctctgtgggggtgtgcagaagcactgtttatttttgcccacatcttagagtgataaatggaactcatttatgaattttgacttccaaaagctttccactttctcccttaggaacatggataaaaattgtccacatttgtttttggagacatggattgttacctgaaacctacttttcagatgttcttgatgtgaaaactgttgccaggctgggcgtggtggctcatgcttgtaattccagcatcttgggaggctgaggtgggtgggtctccattttttttttctttttttttttctttcttttttctttgagatggggtctcgctctgtcgcccaggctggagtgcagtggagcaatctcggctcactgcaaactccgcctcccaggttcacgccattctcctgcctcagcctcccgagtagctggaactgcaggcgcctgccacaacgcccagctaattttttttgtatttttagtagagacggggtttcaccgtgttagccaggatggtctcgatctcctgacctcgtgatccacccacctcggcctcccaaagtgctgggattacaggcatgagccactgtgcccggccgggtggatctcttattcccaggaatttgagatcagcctgggcaacatagcaagaccccatctctacaaaaaatttaaaagtgagctgggcatggtggcatgtgcccgtaatctcagctcttctgggggctgaggcgataggatggcttgagcccaggaattcagggctggagcaaactatgattgcaccactgcactccatccagcctgggcgacagagcaagcaagaccctatctctaaaaaggaaataaataaatacacataaaaaccattgcttttttttggccgggagtggtggctcatgcctgtaatcccaacactttgggaggccgaggcaggcagaacatctgaggtcaggagttcaagaccagcctggccaacatggtgaaatgtcgtctctaccaaaaatacaaaaatgagctgagcaggctgagagcagtggttcacgcctgtaatcctagcactttgggaggccgaggcaggcggatcacctgaggtcgggagtttgagaccagcctgaccaacatggagaaaccccgtctctactaaaaatacaaaattagctgggcatggtggcacatgcctgtaatcccagctacttgggaggctgaggcgggaaaatcgcttgaactcaggaggcagaggttgcaatcatccaagatcgcgccattgcacttgagcctgggctacaagagcgaaactccgtctcaaaaaaaaaaaaaaaaaaaatatcagctgggcatgttggtgcacgcctgtaatcccagctactcaaggaggctgtggcaggagaattgtttgaacccgagaggcaggggttgcagtgagccaagatcttgccactgcactccagcctgggtgacagagcgagactgtctcaaaaaataaaaaccggccgggcgcggtggctcgcgcctgtaatcccagcactttgggaggccgaggtgggtggatcacctaaggtcaggagttcaagaccagcctggccaacatggtgacactccatctctactaaaaatacaaaaaattaattgggcattgtggcaggcgcctgtaatcccagctactcgggaggctgaggtaggagaatggcttgaacccgggaggcggaggttgcagtgaaccgagatcgtgccattgcactctggcctgggcaacaagagtgaaactctcaaaattaaaaacaaataaaataaataaataaataccactgcttttttaataacaggtacaaattttaaagagaaataaaaaaacattgccatcttcaaatctccacaaaaatggaaagacaggacagtgccagtcagccactttctgcagtcaccatgatcccttctctctccttcatttttaatgtgtgtttttttaaattgtagtaaaatacacatactctaaaatgtaccatctcaaccacttctcagtgtgcagtttagtagtgttaagcctctagtgttttataagtggcagagttgatgggaaaacactgatcttcaggaggggttttttcagtgccagcgtccctctggatgtgtaggcagataagaaggtggctcggacacagtccttaaataagtgccaggagccagcaggccagggtgggagccgggacaagcaggcacctaaagtaacggtaacataaggcaggtggcgagactctgtggatggatcagtgccaggggctgtgcgggaagggaaaccttacatctgtcctgtttcttaggggacgaggttgtggaggggagggtattccaggcagggaatgtgggcaagaactcggaggcttgaagcattcagtacagtcgtctctcgatatccgcaggaaattggttccaggattcccttgggcagcagtccccagcctcctttttgacaccagtgaccagtttcatggaagaaatttttccacagactgggggttaggggatggtttcaggatgggactgttaacagctcagatcatcaggtattagattctcatgaggagcctgcacagcctagatccctcgcatacataagccacaatagggcttctgctcctatgagaatctaatactgctgccggcctgacaggaggtagagcttaggcagtaatggagcaatgaggagcagctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacggtaacatgctgcacaggtttgtagcctaggagcaataggctgtgccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgcagatgtggaacttgaggctgtggagggccaactgtatgctcagaaagtagcaggctctggttggagagttggtataaaatgtggacaacagggaaggtgagggataggagagttggggtcatcctatgtgggtctccgaagccaggctgagggtgttgtgctttctttgaggatgatagggagccactgaaggttgttaagctggagaggggatgcctttggagctttgccttgggaaggtgagtttggcaaaagtgtgtgtgatggtccagtgggagtcaggtacctggagctgttgtcttgaggggcggtggggaggaatggggagggatggagaggacaaggaatatgagctgattctggggagggggtgacagaaagggaggctgtatgagcctggggatggtgagcgctgtgctggcaggtttcagggcctttcggagagaggaccaggccaggaatgaagaggaaggacagaagcgtgggttgcggagggtgtgtggagtggagggccggagcaggcccttgggccttgcgtcctgggggaggtcacgtgagagaaagaagtgggggagtttatgttgcggaaaggctaaaaggaagtgactgttaggaggttatgggataaaggacagaagccaggctccaagtgagtataggagagaccagagcactaaattggaccacagtgtccagcattctggcagcagggaggaggtgggtggggattcaggattagggtccgagtgctccccgagtgtccaccgtcggcctgctctgttccggggcagggccacatctttgtccgtgtgccgaggaggggactggtgggctggagtcccagggggagattattccaagtaggggctccagaaaggtgagtgatgtgtttgggtctatgggaaggttggtgacccccaaagagaggtggctgggttactgctgaacagctatcagggtgatatggctttgcaggggtccagtccatgggcctgacatgttgtagctatgctttgaaggcattttcctggtgggaggccaccgcaggtaaggggagtgaaagggtggctgtggcggctgttccctgtggctggtggccatggataagtgaagaggaacgtgatgctgggcaccatgctggtggtgcctggggcagagcctggccttgtggggctgtggagcagggtgaggatctgggatctaggactgctatgcaccgggccgaatcgtgatacccaagggaggcatcttgtcgtggagcagttgcatgggcccgcccttgttccctggagcagctggtgaggtactgttagaatttggccctaacaggactgggcacagtaggtcacacctgtaatcccagcactttgggaggccgaggctggtgtatcacctgaggtcaggagttcaagaccaggctggccaacatggcgaaacccggtctctattacaaatacacaaaaattagctggacgtgggggtgcacacctgtgatcccagctactcaggaggctgaggctaaagaatcacttgaacctgggaggcagaggttgcagtaagccaagatcacaccattgcacgccagccaaggcgacaagaacgaaactccgtctcaaaaaaaaaaaaaagaatttggccctaacaaatgcaggttgtgattattaacataagtctggtttcctctctcatggcatttctttagtggccagatggtgtgagtggctccagaagactcttctcttctctgtgcaagagccaggaaggctctagaaaggaatgtctgaggaagcatcggagactgggtcccgccatgcctgtgtcatctcctggcttccccggcccttgtgagccccgcggttgcttatttatcctgctaaggccacagtctcaggttccagaaactctggcaaggaagtctgggaaggttgatggggatgggctggcgggctgggagaggtgctttgttttcactcctcaggaagcttgaggcttcttgtggaagcgtctgctgctttgggctgggcagctgcgcccccagaaagccagctaggggtctgccgcctaataccatgggtggaaactattgcagtcagctgttgggatgcaggggaaggtattggtaggactggggtgccctgtctcctttgtccccatgagtgcaggggatagatctgaaaggagaggggaaaatggatgttttcttctttgtctctcctttctccctgctttcaagtctgtgaattaattggagtcattcccaagggaggagggtcactttattgaattttaagacaaggcggggccaggcgcgatggctcacgcctgtaatcccagcactttgggaggccaaggcgggcagatcatgaggtcaagagaccatcctggctaacacagtgaaaccccgtctctactaaaaatacaaaaaaaaaattagccgggcgtggtggcgggcgcctgtagtcccagccactcaggaggctgaggcatgagaatggcatgaactcgggaggcagagcttgcagtgagccaagatccaccactgcactccagcctgggtgacagagcaagactgcgtctcaaaaaaaaaaaaaaagcaagacaaggcatatgacagggcatgatactgacgagaccttggacatcaaaggctggagcaggacttcctcctagggaacatcctcagatatgtagatgtcaccgtgtgggctcagacatccagggtggaccagagccggtggcttaggtctggtggtctgtccctgactgcacttttttcagagctgttttggtttgaagctcaaagcgggctttttatttatttatttagagacagggtcttgctctgctgcccaggctggtgcagtggcacactcacaactcactgcagcctcaacctcctgggctcaaacagtcccctcatctcagcatctcaagtagctgggactacaggcatgcaccaccatccccccaggtaatttttaaattttttgtagagacaaggtttcactatgttgcccaggctacaagaggactttaacttttttttaattaaaaaaaaattttttttgaaacaaggtctcactctgtcgcccaggctggagtgcagtggtgcgatcatggctcaccgcagccttgacctctccaggctcaggcgattctcccacctcagccttctgagtagctgggacggcaggcacatgccaccatgcccagctaatttttgtatttttttgtagagatgaggtgtcttcatgttgcccgtgccagtctcaaactcctgggctcaagcgatccacccgccttggcctcccaaagtgctgggactccaggcatgagccaccatgcctggccaagggggcttttcaaaggctgggctgggctgttcatttggaaaaaaggttggggatgttttcacttcaccaggacttctgccagtcagcaggctggtacattaggagcccaagttttgcctggtgctggtggacgggtctaggcctgagaagccgtagtctcctagtgcttggtgctgctaagcccaaagaacagagtggttacaggaaatggaacatttagtctggcagaggccaagggcagcaggtccctactctggctgcccatgtagttaaaaagtcacacacgtgcgcagctggtctgattaatgagtttgttttttgatgtcacagtttctgggcacagcagagctggctcctctgcttggggtctcctcaggctgcagttgaggtgttggccggggctgcattccctgctggggcttggggttctcttctaagctcacctgggttgctggcagtgcttacctcctggcagttgtaggactgagtccccatttccttgctggcattggctggaggccccttctagagcccaccctgttcataggcagttcacacacagctgtttgcttttctcttctcagtgaatctggtttttttgttttttcgtttttgagacggagtcttgctctgttccccaggctggagtgcagtggggcgatcttggctcactgcaagctccgcctcctgggttcatgccattctcctgcctccgcctcctgagtagctgggactacaggcacccaccaccatgcccggctaattttttgtatttttagtagaggtggtttcaccatgttagccaggatggtctcgatctcctgaccttgtgatccgccctcctcggcctcccaaagtgctgggattacaggtgtgagccaccgcgcccggccaagtctgggttttttgaaaagctccctgggtgacttgactctagccctcagggttcagacccttcggtttctgggagtccgtggacattggctgcaggttttgaaaggctggcatctcaagaggggagcagatgaagagtcatggggaaggttcctgtgcagtatgaggaaggtttaattttcttgccaacttttgagataattatgtgtaaatcttttttatatagttaagatgttgctgtgtagttgggtgtccggccttagttaatgtgaacgtttccatgtattagtaaatcttgtgtaaatattatttttaagggccatattattactttgtagtggagttatggtttaatttatctaattttaatgaatttttgttggacatttcgagtggttctttatgcagctggttagtataatgtttcagtgaacttctctctctttttttaaatagcttcactgaggtaattcatgtaccatacaattcaaccctttaaagcagccaatttaatgggttttggtatattacattattactttttaaaaattgtggtgaaatatatatacaaatttgacattttaaccactaaaaattaaaattatggtaaaataacataaaatttaccatttttagccgcacagctaaatggtgttaagtatattcctgtcatgcacccatcactatcatccatctccagaactctttccaccttgcaaaactgaaaatctgtactcatttccacccattaaagaacagtgcttcttcccccacgcccagtccctgtaaccaccattctactttctatctctaggaatctgacgactctagaaactttatttaagtggaatcatgcagtatttgtctttttgtgacttatttcacatcatgtcctcaaagttcatctgtgttttactgtgtttcagaaccccttcctttttaagcttgagtaataattcaattgtttgtgtgtgtgtgtgtgtgtgtgtgtgtatatatatatatatttaatctatcattcattgatgggcacttgggtcattttaaccatttttaaatgtacagttcagtggcattaattacattcagtgaatttttttgtggggttttttttttgtttgtttttgaaacaggatctcgctctgccatctcactctgcatctgcactggtgcagtaagagctcactgcagccttgacctcctgtgatcctcccacctcagcctcctgagtagctgggactacagatgcacatcactacactcatctgtcgttttttttctttttgtagagacagggtcttgctgtgttgcccaggctggtcttaaactcctgggctcaaatgatctgcccgccttggcttctcctgaagtgctgggattacaggtgtgagccaccatacttggccaagtgaatacctttttatatgagtttctgcccatgatggggtgggcctctgtcactggatttaccaggtcagagaggtggatggtcttaagacccttgatggctgctgccaggtcaccttccagaaatcctgccccagtttacccttggctttatggttaactgcctgctcttttttgacttttttcttgcctccttctgttcacaggattgtactgaagcagttccatcaggtgctaaaacgtctgagctgtgtggggccttaccctccaaaaatccaaaattgtgatgtgggattttcattccagagaagcagaatctgagattaaggtttgctttgggtcagaggagtctgtgctagactgggctccacggtaattcccgattccttgatgaccctcgaaacagtccagctttgatagggaggagccctgagctggggtcacactggtccactctctcattcaggaagtttcctgaggccactggctgtgtgacactcagttctttgtcagcgctgtggttcttggtagggaaagaacttactgtccccttgtctgttgtgaagtttgctagtttattgctgttgtgggctacttgtaactgaatctgaaaagcattttggcttctcttctgtgcatcgtgagttaggtctgccagatagcattgtccagttaattctggctcatggagttcctgcttggctttcattgaagctccaaggaagcagaaggccatggcagaaaaggatttctacaaagggaaagggacttgcatggctgcacttggctggcagaagctgggctgggacgggaggacaaacacctccctgtgcaggcagtgggttcagatggtcttggctggaaggagggcagataatggtgagaccacgtttggagggagggcagcatggtgtcatgggcttggggaggaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctgcgttgcccatcttagctgtgcccttggccgccactctgactccagtgaatcacgtagactccttgggcctctgaattcctgtccgtaaatgatgaagctgaatggcagcatttttaagatccgttagttttgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggatcctggttgtgtctggcttcctgcagtaatgtggattggggtggattggcctctgtgtgcacccttaatgggaaccaggacactgctttgctggctgatttgttgtcctcccttactgcccactggccagtctacaggtcaccaccaggactggaacagatttcagaggccgtgcaggtttcatctggggcaacgtgccaaagtgcagagcgtgggcagcgggaggccctgccgtccgcgtggatgggggagacggcagcatgggggtgtctgccagggcggaggtgatgatgtgcaagcaggtggttggcagcaggaggcctggtagtgccagctggtgtcttgccagccagagcacagccccgcttggtcaggaatgcatgtgctgaggccagcactgagatgagcaggcatgcgtgtgtggccacccctatttctgtgctatagtgggaggagcacattaggtactttgaggccataatttacctttgttacagatgaccaattccccaacagcctcccagccttttgcaggccccacctgggatcagaaggcaaggtatccttcctgcagggaaagcctgttagtctttcctgagcattcttagtgccagttggagtaggggctgtcttggtactgagctggccggtgctggagatgggctggtcagtctggagggcataaggacaggaaggataccggcactgaacgttgtcactcctgtgggggtacagatgcctcagtggaagccacgctttccttcagaatattgcatttggtgggcctgtctcaaggtgcactttgactcctgaagaccctccttctcctcctctcacggatctgccggtgttccctctctggaaggcttgcaggagagacaggatccctccctttactggaactttgcacttgggtttggctttgtgctttgtaaggggatcccattcagcgtccaggatccgagccttgctctatttctgcaaggagctggtggttgctgctcgccaaggggatactcagacagccaaagcctaggcaggatcagaagctcaggcagcagagccaagatttgaaccaataatttttttttttttttttttactttactctacagtattgggattggctgaactttccttaaatgaccagatagtaactaattttatgtttgtggctgagaggcaaaatcgatgctactttgtggatacttacataaccatttggaatgtgagcatgtgaaactataaagagcattcttaaggcctaggtcacatgaaaacaggtggcagtgggctggatttggcctgtgggctgcagtttgccaacctgtgtttcacagcgagctgcctccaaatgcctggtggtgatgcaatcgatgacagagccaggtgtgggcgtctcacatctgtgctcaggagctcacaggagcttctctcctatagaacctgtgaggcaggtagggtagtcttccaaaccccatgaggattctttcctcagagaagttgccggaggaggaaaagctggatgagagatggtcacttggtttctaacttccctttctcttccctgtttcctgctgcttcccagggctgaatgaatattccctgaaacaaggctggccatgagctaataatcgttgaagccaaatgatggggtaatgggcattcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggcttacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccgagattgtgccactgcactccagcctgggcaacatagcgagactccgtctcaaaaaaaaaaaaaaaagttaagaaaatagtcattcattgattaaagttaccaaaaaacccttccacattgagagaacagggtgttaaaactcagaaaccttttcaagccccaagatgagcaaacttgctcctcttatttcctagcagcagatgttcctgagaaaggggtagctgtgcttgagccattccatcattcatccaagccatccatctatccatctattcatcatcaatccaagatccaaacatttatctatttatctatccacccatccatccaaccagtcatacaaccatccatttaactattctttattcatcatccatccaactaaatctattcatccctctgtcatccattcattcctccctccctccctccctccctccctccctccatccatccatccatcatctgtctaacatccagccaaccatccatccattcaacattgaactatccattattcactcatccatccaaacatgcatccattcagtcatcacctattcatccatccattcatcctccaaccattcatctgttcatttgaagttgatgtgacacctactggggtccaagcacaatgcttaggccttgactttgtccttgacctcaaggaacccatagacatatattaaaaacagctgataaaggggtgctgggatggaagtgagtaccaaccaggcactgagaagtgactgactctgctgggttagcagaaggaagacattaaggagaggatggcccattagttggatcttgaatggactcaaaaggagtatattgtaatcccagtactttgggaggctgagttgggagggtcgcttgagcccaggagttcaaaaccagcctaagcaacatagcaagacgctgtctttacaaaaaattaaaaattagccaggtgttttggtgcacacctgtagttccagctactctggaggctgagttgggaggatcgcttgagcccaggagtttgaggctacattgagctgtgattgcaccactgcactctagcctgggcgacagagacagaccctgtctctgaaaaacaaaacaaacaaaaggagtatgttaggccattgtaggggaggaggagaggccttctaagcagggactgtcacaaaggaatgaaagagcctaacagcctggcctgccacaggtttctcagacacttgggatagctggcatatggtgttggggtgagagaccagctagtgatgatgtggggtggtctggtgttgacccccagaggccagagaagacttctgcatggaggatggagtgagcatggagtgtgcgactgccataggccctgctcagtgccctacaccccgtgtgtgcctgtgacacctgatggcctatgcaccccatacacacagctggacagcagaccccggctgccctggctgaggcaggtgtgcccatctgtacccacctttgctttggctcattggctcctggtctcctgttgccgagcacctgtctagacagaatgatgttttgtgtctgtgcaaaacagacacgctggagcttcgtgtttgcagagcttcatgcttcagttggtaccccgtgaggcttgtgtgggcagctgttcagaaacctcaattgggccctctggcatttgtgagaaccttgggctggaacccacccggctggcagtgcaggagagcagcccttccccctcgagggccttgtccctttcacctgtgccgtgtctgtgtgacactgaagctctgtctggtgcgggttgaagtttgtgacccccacttaccaggcccagagcatgcatggtggactgtgggagatagtcattgggatttttcatttgattttatgtttttttttttaatcaaggtaaaatacatgtaacatttaccatcttaaccatttaaaaataacacagttcagtggtgttgagtatgttcatgttgttcagccatcaccatctgtcactgaatgtttttgtcttgtacaacaaaaactctggactcagccaggcactgtggctcatgcctataatcccagcactttgggagttcgaggcgggcagaccacctgaagtcaggagttcaagaccagtctggccaacgtggtgaaaccccgtctctactaaaaatacaaaataattagccaggcatggtagcgggcgcctgtaatcccagctcctcaggaggctgaggcaggagaatcgcttgaacccgggaggcggaggttgcagcgaactgagatcggtccactgcactccagcctgggcaacagagcgagactccgtctaaaaacaaaccaaaaaaagcttctggactcattaaatataggctttccatttcccctccccgcggcaaccactgttctactttctgtatggatttggctaatcgaggtacttcatatgagtggattcatatagccttcgtcttttgttcctggcttatttcacgtaacgtcatgtcctcaaggttcatcggtgttgtagcatgcattagaatctcctttcttttagccgggcgcggtggctcacgcctgtaatcccagcactttggtaggccgaagtgtggatcacctgagctcaggagttcaagaccacccaggacaacatcatgagaccccatctctactaaaaatacaaaaaaatgaaccgggtgtggtggcacacgcctctagtctcagctacttgggaggctgaggcaggagaatcgcttgagccccagaggtgaaggttgcagtgagccgagatcacgccactgcactccagcttgggctacagagtgagactctgtctcaaaaaaaaagaatctcttttctttttaaagctgaataatattccattggtagacacacattttgtttatccatctctctgccagtagacacttgggttgcctccaccttttggctgttgtgaataatgttggcaggaacatgggtgtacaaatttcgtggcttgtttgctaatttatttattcatttttattttatttttttgagatggagtctcgctctgttgcccaggctggagtgcagtggcgcgatctcggctcactgcaacctcccctgcctcccgggttcacaccattctgcctcagcctcccaagtagctgggactacaggcacccgccaccacacctggctaattttttgtattttcagtagaaacggggtttcaccgtgttagccaggatggtcttgatctcctgaccttgtgatccgcgcccagcctattttttaatttttttagagatggggtcttgctgtgttgcccaggctggtctcaacctcctggcctcaggccatcctcctgccttagcctcctgagtaactgtgattacagacatgcaccactgcgcccctactcaatggtatttttcacatatcagatttttacattatttgcccctcacccacttaacagctatttgtttttcaactaacttcctttactgtttcaacaaatttccaattatagtaatttttaccctagaaaaaagaaattatgggttgaaggtaaaacaaaaatacatatcttgtgaattatctgttctttttcaaacatcttaaagacttaggctgggcacagcagctcacacctgtattaccgggaggctgaggcaggaggattgcttgagcccaggaatttgagagcagcctgggcaacaaagtgagaccccatctctacaaaaaaatttgaaaattagctgggcatggtggcatggacctatagtcctggccgcttgagaaactgaggtgggaagatagcttgagcccgggaggtcgaggttgcggtgagccacaattgtgccactgtactccagcctgggtgacagagtaagaccctgtctcaaaaagaaaaaaaaaaaaaaaattaaaggcttgaaagatgtcatgatgtcatttgatggttgtatatgtgcacgtatgtgcattcaggtgtaatttacagacaatgaaagtcactcttggtatactgttctgtgaggtgtgacagcgttctgtagccattaccttcatcaagatacacagcaggcctatcaccccagaaacttgcattaccccttgttccttgtaggcatttctcctacttgcagcccacgacaccactgatgtgctttctccccttacagtttagcacttttccgaatgtcatataaatagaattgtacagtgtgtaaccttttggctctggcttttttcactttgataatgcatttgaaattcatgcaagttgtgtgtaccaatagggcattcctttttattaccgaggattatttcatcccacagatgggtcagtactgttcttcccctttctatcccactaacatctttattcagatgtaacatacataccatagagttcacccgtttaaaatggaccattcagtggtggttagtattatctcagagttgtgcagtcatcatcactgtctgattgcagatcattttcatcacccccaaaagaaaccctatacctattagcactctctccccatccccttcttctgttagtcctggcaaccaccagtctgctttctgcctctgtggatttgtcttttctgggcttttcataaatgggatcacatggtacatagcttttggtgacagagttcttagagcttctttttttatttgtttgttttttgttgagacggagtcttgctctgtcgcccaggctggagtgcagtggcgcgatctcggctcactgcaagctccgcctcccgggttcacaccattctcctgcctcagcctcccaagtagctgggactacaggcgcccgccactacacccagctaatttttttgtatttttagtaaagacagggtttcactgtgttagccaggatggtctcgatttcctgacctcgtgatccgcctgccttggcctcctaaagtgctgggattacagacgtgaccactgcgcccggcccttttttttgagacagtctcactctgttgcccaggctggagtgcagtggtacaatcttggctcactgcagcctccgcctgccgggttcaaggattctcctgcctcagcctcccgagcagctgggattacaggcgcccaccaccacgcctggctagttttttttgttttgttttgttttgttttttgtatttttaatagagacagggtttcatcatgttgtccaggctggttgtaaactcctaacctcaggtgatccacccgccttggcctcccagagtgctgggattatcttagagcttctcaatagaagtcctatcttccaggccacatctcaccctccaggggtaggggctggtggagctgttctcactcagtttgtcctcagttccttcttgagcctggacccttccctctagatttggggctgctcctctcagagtgccccagaacaaaaccccctccctgttcccacttcccactgtctgcaggactcccctaccccataaccagggtcctgccagccctaccctcagcctcccataagggtctgaagtggcaggtggatgggaaactgcactctctgacctctgcaaggggactgctgctttcccatgagcttctcctctttccgttgctggtttcttctttgttatctttgctgctggagtggccagaccctgggaagcgggctggagagaggagagaagccatcgagccacatggacccctacagcccggaatctgagctgtggtaggattggctgcgattgggattggcagacacactgggtttgtacaggaggggaccctgaaggatgggctgtggtcaaagtgggatcccttcactgtccatagtccttggatctgaaactgctgacaggtgcccctgggaactgctgtggtatttggagtctatagagacacccattgctcaggaccccagggccttaacagggagtacactggcttctgggaagcttgatggagttgttgctgcataggtgcagaaaatcccagcagtggagtaaggcctgaagtaagcccccactgggctctgtggggcctggggcagcctcctctgttgcagggccgccagcatctccagcagaagtgcagtgcttgctctggggacacaggggccttttggaatgagcatgtggacttggcttatggattgtgcctaccccagagcgttgctgtgtctctcaacacacacagcttccatgggctgctcactccaattctgatggagagggcatttatgactctgtccgttggtttgttttctcactgaagaggaacatagatgcacctgctctctgggcaagagatgtggcagctgcaagctgcacaccctgttctgaatattgcccagaccagaatatgaattacttggtcataaatcagtgtcttgtctgcagaaaacttggcaatgtgagggacggcagctttaacttgattcctgggaggctgccggcctcaaaaaggacaaggactggcaatcagatgggcattctctctaatttgggaggctttcgggcttcctcacggagtgctgctcctggggacgtaccacaagaacctcccttgtctagttttgttctgacgcttgggctcattcacctgactgtctccttgcttgtctggctctcaggaaagccttcccggagaggatgtggctgacccctgcagccatctctccacagacaatcatggccctgagcttggctgtccttggttgggtacatccaaggctctgcctgccagggtaggcactggccaggctgtgggatggcagcgttgctgacttgtgctcctgagtcctgggggccctgagtgagcctccgtgcaggagtcgggctgggctgagaggtgtggagagtcgttcccttaatggatggtcaggcacagcagctatgggctcaaattccggagggacgctgagccaggtcccagcctgtgcactgagcatgtcattcactttgagatcccctctagggtaaggcacaccgtgagtggatgtgccactaagaaggaggcagcaggctgagcgtggtggctcacgcctgtaatcccagctctttgggaggccaaggtgggaagattgcttgaagccagaagtttgagaccagcctgggcaagaaagtgagagctcgtctctccaaaaaaacgtaaaaatattaattgctggggcgtggtggtgcatgcctgtagtcctagctactcaggaggctgaggcaggagaatcgcctgaatgacccaggagttcaaggctatagtgagctatgattgcaccactgtacttcagcctgggcaacagagcaagacccctgtctcttaaaaaaaaaaaaaaagaagaagaaggaggaggaagacagtactcccagttatcattgcgagaggcagagatgcgagattccactttgaattatgttgaaatttggggaaaatgcatgcctgataatgggtaaaatacagtaagtttcctcatctgtgaaatagaaatcccactagtcgttgactcaggaacttgctgtgaagattagagatgaggtgtgcaaaaaaaagcacctagcgtggctgctggcatgccctgagtgcttaataacatttgttattctcattttattgttgttatcgtagttgctgttatgacagatagcgggagaggatgttggctgctttatcagctggctggatgtttggtttgtttttttttttttgtgagggttaaagtgggagatgggaagctgtctttttccatcagagttggaaaggcccggagtgttcatttctcagcaataattgttttcaaatggttttattttagggatagatcccttctttgccaatggtatttcagatgaccccccagtatatgaaaaagatgaaagaggagccacaggtcctgaaggctgcccagctcagcctccccacccaacctgggctctgaggacctggcttgggaggtgctgctcttggcagccccagccttccacctctgtggcctgtgccatggccaggaggacctgcatttccttcggactgtctctctgctcaggcggattatttcgtgcttcgtgtgccctcccagggtagggacggggaagctgtgaggatgctctgtggggatcggctccctgtgttgtccatgtcttcttttaggtggagttggctaggcagggaacctggcaccatttccttctcagagcagagaaacagagtcggcgtttgtgagcgtgcattgtccaaacctgcatttggaaggggtcaaagtaggctgggctttgtttttactttttctttttaaattatgatgaactatacataatgtaaaatttaccacttcagccatttttaagcatacgatcgatgcatgacattaactacattgatggtgttgggcaaccatcaccactatccatctccagaactttttcatcttccccagactgaaggtctgtacccatttatagccagtaaacaactctctactccctcctccctcagcccctggccaccaccatcctactctatgtctatgaatttgactactctagagacctcatatgagtggagtcctacagcgtttgtccatttgcatctggtttatttcacttaacataatgtcctcaagtttcatccttgccttggcatgtattagaattttcttcctttttaaggctgaataatattccattatatgtctgcaccgcattttgcttatgcatccattggtggatggacacctggcttgtttctgccttttgtaaagcatgctgctgtgaacacgggtatacatgcttttactcttgaccccttgcaaacaggtctgtcttgcacatgtgccccaggtaccactcagccatctgctcattaatgggagaggggagaaccttcccggttctcttgagtaactaccatgatcacagctttctggaatgtagcaggttacttgataaagagggcgggaattcttagaaaggagggtttctggctgcaagccccatacctgttttctgccaccttctctgccaagggagcttgagccagccatttctgggaagtggtgagcctcagatatggttcagggaagatgggaagtgttacagtgtaattccatctgctgatggggacaggcacaaacctggtggcttgttgtccttggaacagtcagtgatgaaggcagagtggcggtaggacagggaccccgcttagttatgacactgcctcctaagtggaactaagtggaaggtctagtggggccttcttcgtgggttgggacagtggttctgcacccccactcagcagctcaggaactgaagttagagcctgccttcaggggatgggcatgtgtacaagggataggggaccagttaatccaggagttagatggtgactgagactccaggaatttcccctttcctgtaaacatgggtcattttctagaattaccacgttccctttaattttgccatgtttaggaaatctggctgagctggtaattaccaagtctaactgagaaatgtcttatatgtaaccttctgtttcccttgagtgtttcggaggaagctgtgggcacgttttatggataggtgctccgagttctttccgctttggtccagtctgagtggctctgataagcgttggcaacaccaccgatttttgtggggcctggcttcagaacatgaatgtctgtgtttctgcaaaaccaagtgtactcactgcctccttttaaaatcatgctacaaggatgtctttcactttgaattctgcgcttacattgttcaagaggcatcaccatgtttataacctcagacgcagtaattccaccctagggcattttcctaaggaaaattgcttcccccttttcttttttggtagtattatgtgaaattattcattgtattcataacagtggaaagctggaaacaaactgagcatcctgtaatacaaaaggggttccattagcttggtagacgattctgtcatcatccgatggtaaggatgaaaatgaattagcaacgtggaacattgtcataagtggaaaaagtgagatgcccaaagtgtgatgatttgtatcagtcatctcttgttcggtaacaaaccatcccaaagtttagaggcttaaaacaatgcgatttaatcgcagtgccatctggcttggtatgaggtggttctgctgtcacacaggcttggtcatgtgactgtattcagtttgtggtttgactgccgctggcatccgaggtggcctaaccgttgtagctaaggacttggtagggacaccggaaggctgagacctctctctccttgtggtccgtcattgttctgcagtgaagcctgagttgcttctcatggaggctaggttccaagagcaaaggtggatgctgcagggcttcctgaggcctgggctatggaacttctcagctgaacttccaccggattctgttggtacagtgtgtcgcaagtcttgcccagatctaagcgggggtagaaagctggactctacctcttgatgggaggagcagcagtgtcatgtggacacacggcgtggacacaaggcatgattctcaggggctctggtgattgctcccaccacaggattttagttacacagtcacaggacaaggactggaagtgattgtgggaaaatgatcctagaccattggtagaggaggtgaggttgtggatgacttttttagatttttgctgttgccatgttatatagtaggttcaaagtaaaaaatccttagcatgttatccactggactcctagttcaagattgctggggtgtcagatccactgttaggtcccataaacttgcaggctcggccagtgcagaacctctgcagcctggccttcgggaagaagacatccagagatagtgaccacaccatggggtaccttcaagctctggtgctctctcttcgccttgctgaccttgatggagtggataggccttgggttcaacatgaattgacccaggccatgggggcattggttggcctcctctgtaaggtaggcgtggggctcagcctgcaagagctgaccatacttatgtaggattagggggcatcggtgggaaccctggtgtccaaggacagtattgtctggttgactgaagttagggaagtgggtggggaacatggaattgtcaatccttcaggctccttttgaaggtcattgttttcctaaacagatggttatttggactcttacaagttctctgtaagtttgtaaatgtttgaaaataaatagtggaataaataaatacatgggaaaccgcactttgcctacgtgtgggatgctcgtgagacctggagggagggcactcccatgaaggcggggatcccgggtaggcggtgatctgcagctgtggccgcctgctcggacaggaaaggccttgacgtccagatcctgctggtgggagagccgtggcccaggctcctacattgccttggggaggagagtcaggccctgcagggaagggttgtgaacctgctctgggcaaatgggcctggctcctgggaaacttcgggcctgcagtaaccctactctgaccagaggaatccttcccctgtcgcattggcatccctcccctcactgttctcttcattctggacccccttgtcatcacgatgccagtgctgtccctttggtgtggggtttgtgctctgacctgaccctcaggccctgccagtgccctggcttccaggcagatctgggcaggcaggtctgagcccccggagctgggtaagcatctggggcatgtgaggattgcaggaggtgacccgggacagtgcctcacgcccagggtgaccagaaactgtgttcccttccctaacccaccgggtttaaactttttacttgctagccatagagctcttaatcagacaatatccaggggaacccccattatgtaaggcaggtaaagctggtggaagctctcccacccactagttgtccctgctcagccttggcacggggccactgtgggaccggagagctgggaagccaccacctcagtccctgccagtctctggtctgatggtgaggaggggtctggcctgctcagtggcagggtgcggaggtgaggctggtggctgttcttcagctgtgggactcgtgtggggacaagctgaacagtgtgctgatctctgatcaccactcaagccacaagtgactggacaggcatggacctgtgtcctcatagtgaggacccatggggcttcacccaggacagcctggttcgcctgccctccgatgctggtggaggggaggcaaggcagaggggactcctgtaaagggctgtttttttctgtcctggaatgagcacattctgagggtgagtggctgtcagcagttaggaaaaattgcctgttgacttgtttcattaagaggccccttgccgagggtgaggtcgcagcccggccctgctcagggaggaagcggtgtttacagagcggccagctggtgccgggtgaggaggtggctgatccctcgttatggagctgagagggcctgcggcttccagcccattcctgccatgccgctgccctaatggctgtgacaatggatggatggatggacggagggccaggccaaccaggcagtgaaaacaggaaacctaatcttttaaaaataatccagggggaggggagaaagtgaagcagcaaagcccttaagccgacagatggccctggtggggtgtgtcttccaactgggtaggtgcttctcaaggctgaaaattccagtgagtcggtgaaagctgagcgtgcccaccaaagacacttgaatgggcggctggcattttcaagctctgttccttatgttagacgatgttgttttagcacaaagcctccccccggatcccaagcctctccccaccatggctccagagtcatccctatgtggaacccagcggggcagtctgaccttgtccctttggctgtgaccctgtcccacccttggcctctgtccctggttcttgcccaggtccactattgcatggccagattcatcctcacagggacctgaccgctgttcccttctcacaaacctctgagttgcccatgggctgaaggtcaaggtcacgcatctcaggcaggcaggtgtgcaggaccctccacgctcgtgggcactggcggtgcgggagcacagctccctcctctctgctagctctgagagtcccccgccacccctctgtgtgcttcctgcaccccctctccttgcctagaatgtcccccacaatgtctccacttgcccagctctgtcctctgtgtccagctttgaggctactttctgcagtcaccactattatcccaccccatgtagttctctgtccccgacctgcatgtaacctgtttccctcctccggccgctctcagccgctccttcatgcctccttcctgcaccatctgggctccctttggtacttgtgtgtgcaccgccttctcgcctccaagtctgcagttcctggagcattgagtcatcctgttaccattgcttctgactcgaaggacacggccccttggggctggctggtgtcatgtgtggctgcacagaggggaggggctgttctgccacctgccctttgaggctgtgtgggcacggttccctctagagctccatgtctagcagagcatgcgggggtcctgctgtgcccccactcccatagtgcttgaaccacttcaccccttgcatggggaccaacaggatctacctccctctgtcgaatgtacttctgaaaggaggaaggttacactgaagtttcacctaccgtccatgggattttgaccctgctgtagtgacagctgcatgtttggttctaggggaggaggggtgaatgacttatcttggagaagccagagccaggtgtcagggaatggcctctgtgtctgccacctcctgctgcctctctgcctgggtcatttggttcagtggctataactgtcttggagcagcatttgcttccaggttgggttcaggtatgaagtgctgaaaacatgggaatccctgagcccagccccacccaggcttggtctgctaggggaggtggaagcagggcttctgaggccctgaggctgcctggggagtgcgtttcttctccacccacttgcaagctcagctcacttcctcttactgtatacttggtgtttcattcacactccttgcagcatgcttctgggatatgatgaaaatcagctgtgggtgttgatttcggagctgggcaacgatcctctctggacccgcattcccatctgtaagatgggggtagtaacctccaccctcactgcttcctggaattgttgatgcatcagagagagcagccagtttgcactgtgggcttccagggagatttatttcatgccatggttccccttttggataaggggctagatttgctttcttcatcagattgtccccggggacacacacaggagttgctctcacgtcgttgcctcttggtatctttgaagcctgtctgttagaacccgcctctttgatggtagggcaggatttggagaggtgatggcctctttgggttgaatttctcactctaatgggctcacagtaccttctgattacctcctggttcagcttccttgacaacaaactagaattgcttcagatgcaatacttcattcttcctagtgcatgagtaattcatatccactatttgctccctcttttacaaattggaggatggcgatgcagatggaagatgacctgctcatgcatcaggccgagacttcaggcttccgaggcacatgtttgaggttgagactccctagggagagtggagtcacctttgctttgcagaggagccatgggggaccatgtctcagcacctctgaaaggttttctgccccatccagtctgctgcttctctcccctccctccttcaccctgttccccttcatcaggggtgtaaatgatggtcttcctgtcttcccatgcacctcccttaggaccagagcaggtgggagatgtcttcacaggagggttccaggatgataggtttggagcaaagggctgggggcttctggggagccccattcctgcacctccatgctgaatgaagaggccacacgaggatgctcacactgctcagtgcttcttagagaaagctgctggctctgattaggtctggtagggggcagggtccttatttctcaggactcaagacagatcctcaatcaatggcaagagtcatttttgttttcccgccaggctcactagagtttctgtctcttcccacttttctttgtgggacagctttcgggagggtggggttgtctttgttatgagaagtgacagccagatggactcagtggctcacacctgtaatcccagcactttgcggggccgaggcaggcagaatctgaggtcaggagttcgagaccagcctggctaacatgttgaaaccctgtttttactgaaaagacaaaaaattagctgggcgtggtggcaggcgcctgtaattccagctacttgggaggctgaggcaggagaatcacttgaacccaggaggcggaggttgcagtgagctgagatcatgccactgcactccagcttgggcaacagagtgagactctgtctcaaaaaacaaaaaaaagagagagaagtgatagccctccccgtcttctcacctgtcactcctcttggtctccctgtggagcaagtttcctgcagtcactatgtgctttgttcacttctacatccacagtgcctaaaacaatgccagcacgtagtaggtgctcagttaatgcttgcagagtgaacaggtgacacacctgcctggcgcgtcttgggccccttattaggcacagtaaggcatagaaaactgtctgattccggccgagtttccaggctaagtgggaaggtggaacacagcatatgaagattaaaatgagaagtaaagtgatagttcacagtatgttggtgggaaaaggttgatacgattgtcagataaattgcacaagtgctaagtgctgagaaagttcagagcaggggaagtggttcccgaggaaggaggcagaggagtgtagattttgtagagaaggctaagagagggtgggatgtggcaaagggcgaagggtagaaggagacatgacctgggagaggggagcgtggcaggggcccatgggcttcagggctgtgaccaacagcatgctggtgaacagaccagacgtgggctatgttgtctgggcctgtgaagctgagttcaagagcccaagccttcctccctcatgcccatgctgttggaaccttgaggtggttacctgggcagaattcctgtcctggtctctgggcagcatctctcctgcttctgataaagactaacaaggtgtcttagtctgttcaggctgccataacaaaatgccaggctgggctgtttataaacaagagagatttagtgcgcacagttctggatttggggaagtttgagatcaaggcacctacagattacatgttagataagggctccctgcttcatagatggcatcttcctgctgtttttcatgtggcagaagggccaaagaagctctcttgggcttcttattgtaaaggcattaatttcattcatgagggttccacccttacgacctcatcacctcccagcagccccacctcttagtattatcacattgggggttagactttaacataagagctttggtggggggtacagtattaagtccatagcacaaggggtgacaccttggagtgggtggagggtgaccacctagcagtgtgacaagaactccactaagggaattggggtgtgagtgtgagcatgtgtgagtatttgtatgtgcacacttgtgtgtgtacatgcatatctccaagtgtccatgtatggctgtgtgagtgcatgtgcctgtgtgtggcccattgggggacaggagcaggggccttgaggctgggctttgggctttgtgtacatttcttagcatcttgtagatgcggatgctgactccctcctatggtgcctctcaagatgaaatgagagcatatccaaagccctgtgtgcacagtcgctcccttcttccctcttctcctggtatcagcccccctattctggctggctgagccctaggctgccggtgcagggggtactcagggaggagggctcaggcaggcagcagaggcctggagggcctggctctgtgggatctgtgaccttctccactccagttggcaagggtccaggtgagtctcccaccctcccagtgcacagcgagatttcaggttttgtttctagaccctgattgccatgtggttttcacaccgcctctcctcctgccattgacagtggggggctttgattgctgtcccccttgtaatgggaacactttgctgaccttttccttcctttccccgctaaatgattcctggccaaggccctgcctccccatggggagccgcctcttcctgcctttcccaaaggcacaggccctgatgcccaggaccccgtgtaggacacacagggacagacaggagtgcccttatctcacccgctggtttggagggacagtttatctctcttttccacatggtctaaaggaagctggtgctgaaatggcagagacagggactgactccacaacaggaagacaggctcgggcgcagatctctcgactgtggccgccacacagtggtcactgctgttgtcctgggccacctctctgatccccagggctctcctgtcccaagtggctgcctgaattggttttttgcactggcatttatacctttacttggttaatgattcttagagttctttatggactgtagggggaggaccgaggtccaggtggtggtgatggctgctttctaactggcagtcctgggcagtgccttgaggggaggcatttcttctaaagctcagctctcacttgtgcctccaggagagtcaaactgccgccttgctctgagccatctcaaagtgaggtgagccacattctctcagcagggtggtgggttggcagatgacttgaaggaagagcccactccctgcttacccactctcgttttaatacgccaagtctgcccagagacgctggcctcctcaaaggaggaaagacaccctccaaaacctgctgagaggccgggggctgtagctcacgcctgtaatcccaacactttgggaggccaaggtgggcggatcacttgaggtcaggagttccagaccagcctggcccacacagtgaaaccctgtctctactaagaatacaaaaatcagccaggcatggtggcacacgcctgtgatcccagctacttgggaggctgagtcaggataatcgcttgaacccagaaggtagaggttgcagtaagccgagatcacgccactgcactccatcctgggcgacagagcaagactccatcccccccaaaaaaacaaaacctggacagagtggccccctgcaggccccccgcttcttggggctggagcaagtgttcttatagatgtctctggtcgtcttggccactggctcggagacagccaccgagacccggcatttggagcagctggctgggatgctgcagggaggggtgtccaagcaggaggcagccaagcctgcctggagcaggataagatgagctcccctctgagactcagtattttctgttcaatgaaaggaacagtccagtatttgagacaggagaaccggaattgacttgactggtctgtggtgcttttttttttttttcctgtgccttgattcttccatttaaatacagaggacacctgaccctaaggcgcatggaccagagacatcatctgaacccagagtagcgtgcatggtgattattttgagatttcctctctgtccccatctgggctcattttcactggatggaccccaccatgcttcttagaccctgcctgcggcaggctggccagcccaggtggagggcatgcgctttgccaaaggcgagaccgctggctggagactggactgcggggccatcctccaggctcttgcacggggacctggaggatgtggcccaagctcagtctccttcagtctgcattggtggctaatcaggacacgggtatgggggaaatccctgtaggtctggaggtggctgggatggcccagggcttgtttctcaccctttacctctagtttatatcccactgacaccgaggtttattcgcaatgcacttcagcagatagggtgatggggtagaatcacagagctgaggagtccacggtaaagaattccaggtccctgtgcttctcctgcatcccagctcttctgtcattggaaggcagtcatccaagactcctcccttttctggcctttgctgtcagggagcctgggggccagttcactattcatttcgcacagtcagtgcatcccagggcctgaaacatgctttgagccttcatttttgttttcttcccagtggccttatttttacactgtttgatttcttaaggctgctttggatccttttaaaagtaggcgagtgaaaagctacacaaacaaactcctgggcttggcaccctcctgtgcccacatccggcgccctttctttgggacctgccggagcctgggtcccctggcagggtggggcaggatagggtggggtgttgcctgagaaatggtgcaaaccttcttgcactccgtaaatgattcatttccttcaaatgtcctatgctgttttccagcagaatctccattatgtatgaatcaagatcctggctgacattttctgccttggctgttgtgagctttcccgtcagaaatatccttcccatggggcctgaagtaattattttatatttattggcattaagtgtatgagagagagagagagagtgtgtgtgtgtgtgtgtgtgtgtgtcagaagtggtgtatcagctgccacatagtaagagagcaaaggatcttcttttgtcttatggtgttttacctgtgctgattggttcttggcagcctttaaatgcctaggcagagaggaagagagaggttcctaagcttcatggtgaatttctaagtctgtgttgactgcaggaaatgtatgaggaaaggatggtggttgaggcctctccctcacatttaggccaggggttggcaaattgcagcttagtcctgtctgctgcctgtttttgtaaataaaattttattggaacacagcttgctcattggcttatgtatagcatttggctgctttcatgctatgatgacaaggttgagtagttgagacagatgccatgtggcttgcaaagctgaagatattcattagctggctctttccaggaaaagtttgacccctgctttaggataaaacagagaaatggagagacatggaatagcagagtatcttttcaactaggttcaatatgaatgaacaggtcccctcaattgcacctgaaaggggccagaagtcctataggtttgggtttgggggagattgaagttagacttgcttggttcagagaccaggccaggatcgagcatttgccattggtgacctggaggtgtctggagcaggatccttttaaataggcaagctgcttgctgggaacacagttcaccttaagctttaaaaaaaattccttcaaagccaaaaaccatgcaaatatggagctgcctgacaagccgaatgattgatagggtagaaaatagggtctgtcataaaatatttgaggaggtggatttttacagcagggagaagcaggctgacaagtgccacttgttaatggtgactaccaccttccgtacctactgtgtgccaggcatagcaatagacactttgttattgtgttccgtctagaaacaaccctgctaagtagctcccagtattccccagttaccagtggaggctccaaagatatatcttttgtgtgaattgcacagcccacgatcagggaggaagccatcccctgtggtccagccctctgcacaggtaatgggggaattagctggaattgcagccatcctgtaggacataaggaagaacatcttgactgtaagcatggttaaacactgggatgagctgtcagggaagcgtgagagatccccatctgggaggagctttggaaaggagaaacatttgtaagtctattttcagctttcagctgcatggtgacacagggcattggccttgatggcctctaggagatcttgtgacctttctgatttcagcattctctctcctgtcacatcagaccctttgctggtttagatcacaatagtactgccagtgctgcacccttttagaacttctaaggccatgagttattggagattcagtttccagggtggttcttgaacctaagaaatcttctagaagcctgggtcatgttgtgaggtccttgtgcctgttgggtcgtggttctgtctgcctcaggttactgttggccccagggctctttttcctgcaggccttagttagcaccatgaatggttaggggtatgggggtcagggtgagtggtcaccagtgggtttcaagggattggcctatttcatctaagttgccaaacttatgtgcacagagttgttcgcagtatttccctagcatcttcttaatgtgtgtgggatcagtagtgatatcccctctttcatttctgattttggtcatttgtgcctttctttttttgtttgttagtctgctagaagtctgttacttctttttgttgggtttactttgttcatcttttaaaaaaaattttagagacctttcctcttttctgatataagcatttgatgctgtaaatttgcctccaagcactgctttagctgcatcctacaaatttttatatattgcatttttattttcagtcattccaaaccagtttctaattttcctcgagacttcctttttcatctgtggatcatttagtagtgtttaatagtaatgtttcatttctaagtatttggaggtttttccaggtgtcattctgttactgatttttagtcaaaaataaatgtattagtttcctattgcagctgcaataaattgccacaaacttagtgacttcaaacaacaaaacatactaccttatagttctggccagaagcttaaaagaggccttatagggctaagtcttagttttccttcatctgagaaggtctttattttgccttcattcctgaaggatattttcattggatataacattctgggttgacagttcctttcttttaggactttaagatgtttcatcctcttctggcctctatagtttctgatgggaaatctacagttacgtgaatccttattctcctgtatgtaatatgttgtttttctctgactgctttcaagacttttttctttaactttggttttctgtgcttttattatgatatgtctggctgtagttttctttctttatcctgtttggggttcactgcatttctcgggtctgtaaatttatgttcttcccctaatttgggaagtgttcagctattgtattttccgatactgttttctgcttccatctctcctctctttctgggacacctgggacatgaaattagacatcaacatcttttgatgttgttccatagatgcttgaggttttattccatttttctccatttttgttttctctctcttatttagattggataatttctattgatctatctttaagttcactgactccattgtcatctccattctgctgttgaacccctccaggtaattgtttattttttggttctaaaattcctatttggttcttttttatagcttctattttttttggctgagaaggcctgtctttttatttgtttcaagagtctttgtcctttcttcttagagcatggttataatagctgctttaaagtcttagtctgataattcaaacatttgggtcatcttggggttgatgttagttgattgccttttcctttcacagtttatgttgcttagttctctgtcaagtaattttgggttatatcctggacatcttgagtgtaatattatgagactccggaccctgtttaaatgttctgaaaatgttgactgatttttttttttttaaacaggcagtcaacccagttagattcagatggcatatcctggctcactttctcagctctgtggttccggtatccaccctgctgttgaccactgagggatcagtttgaaactgggcagtgatctgtgctgtgctgattctaagtgttttcacacatgtgcagtttaggggtgagcccagggcttcttatgaagatttaaaggatcccttctccagctccctcttctccatgatcttccctatactctctacttccccatgtcccccctttcaggtgttctgattagaaggcagttcccccctgagggtccactgttgctgtgctggtgaagggggcaggggcttcacctatttggtggcgcttggttagtgtagagtggaaagagtccacgggtctccaccccagggaggccgctgcttgcatctgtggggagaggaatggacacgttgtttgtgctggggaaaggtggataaagccaaaagagttcaatctacaggatttctccttcctgggcttttggttagagagagcaagcttttctgtttggttcttttttttttttcctcttgtctgtgcctgttggtagtttcaagctactctagtgcccatgctgggaggcaaaattccaaaaactggaaaaccagaaaaatcactgccaaggtgtccttaaagtcctgcaatctctgctcagtcctcctgcccttatctacctttttgagtcccatgatagaggtttcatgcagaatttgtacctgtggatagtgggaaaggctgtagtgtgctttttccatcttgcctggaattggaagttccaacttctacatttagacgtccttctctctgtgtgtggtgatgttccctgggatagaccactactgcccttagacagcattctgagggtggtggcccatactgatcacctcagcccacccagtaactttcctgcggcccctcccaagacccccgccccaacagggctaagctgatacacacactgcggatgcaggcctgcctgctgggccttcctggtgtttgttttttccaggcaaagcacctctctctgcctcctgctggtttattcagcagtgtcccagggtttgctcattgtctgctttgcttcagacccttctatcaaattccattgtctctgtcttaatggtctttgcagggtaggcatggccatctgcatgttcactgaagggcctgcctgcatttccagggagagaaagccttcaggccactggtgcataaagatctttggaaatgtccagaagatcccaaacattgcctgtcctgcatgccaggcctcacttgccaccagcctgctccccagccgcacatccagctgtcatttcctagagaacccatcccacgcagttgttttggacacatagcgttccttcagggaatgtggccccggggccacaggtggagtagagggcacagtatcccgaaccatctaacggggcccgactcaccctcaccatgcaccaggccagttatggtttctttctgtgtcttatttccccctccatcaaatgagagttattgtagaaaccttatagtgctgtgttgggattagcagtaaacagtttggcatgtggtagatgctcgggaaatggaagctgcccttttttcctaatgggaaagaagggattttgtttttgagacaattcccttcctctgctgctgcatagggacacctgggtgcctttctaaaattagaccagggcatggtggcttgctcgtaatcccagtgttttgagaggccaaggcgggaagatcacttgaggccaggagtttgagaccagcctgggcaacctagtgagactccgtctctataaaaaaataaaattagctggatgtggtagtgcacgcctgtagtcccagctattcaggaggctgagtcaggaagattgcttgagccccaggagtttgaggcaatggtgagccatgttcatgccactgcactccagcctagccaacagagcaagaccccgtctcataaaataaaataaaataaaataaaataaaataaaataaaataaaataaaataaaataaataaaataccaacagcctgtgctggctggagccatggtgttaaaaggcccatggacttgggccatgcctgagctggctgtgctctgcctgccacttaggctgcccctccctgacccagcttgtgtggagcaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcaggctttggggtcttcctgttctctttcttggccctgctccactccttggttcccctggccctgtcttgcctgcctgttaactttgggtaccctcagcctgtcccaaggcagctcatccctcaggccctgccctgtcttgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggcccagtagggatgataggacccaggaccccaagtgctctaggcaggcactgttctgggtgctgtaaagcacggtgcctagcacctcacagggactcggggtgtcctggctgaccagccgaatccactttttattgacgagaagcctgggtcccagagacattaagtaacgtgctaaggtcacccacctgggcagtggtagggctgggtttgaaccaaggtctgcactgcccagctcatgaattctgctgcttgggagccagcagcactactggcacaagggtagggggacctcaggcctgtcagagagggtgcctggctctttgggagtggggggtgcaccagagtgggttggagacaggacccagagcaccaccctttacctgaccagcatcttggtggggttccccacctggaaaggcaggaccctggggtccaacagagcctattgcagatccaggttctggcccagctgggatgctcactggcttctgtggcttatcagcgagcctacctgctgcacccgtgagcatgggcggccccatctgcctcctccttcaggtgagatggcaggatcagagagatggaatgaatgctgccgtgtcgcattcatgtaggaaggccttatttacaaaccatctgtagcagtcagaaggcctgatgtggtcaggccagaccatggagcccctgttctggatccatttggcaaagatgagagagaagctgggttaggctttgttgggtaaatgcaaatgccacatctgtgtgtgcacacacataggctgagacatttttctgcgaggtgggggatcgcattgagggaagaaaaggtgctctaatagcttcagcctggacttgggtccagagctttggatagaagcatctttccagacaattgggatcctgtagaaaatctgccctctgaggctcttctatgccttctgttgtgtcctgggaccccttggcatctccaggcagagcctatacagagcatccacatcagagtcccctgtgggccccagtgcctgtagttccatctcctgcctggatgctcggttcttggagcgagcttcctgagcagcctctgcaggctccaggctctggcagcatctccacgccactcctgccggcctttctcctggtggaagcagcctgcgttgcttctctgcccggtggtgacaggctgttctcgtttggaaacagaagagacaccactgcttccccacaccgacttcctaaaacatgaggctcccttctgtggtgtatgtgtaaaatgcctggctctgtgtatgcacgtggtgcacgcctggccctggggtcttcacattcttcagaagaggccaggcatggaggctcgtgcctgtaatcccagcactttgagaggctgaggcaaatgaatcatttgaggtcaagagttcgagaccagcctggctaacatggtgaaaccccgtctttgctaaaaatataaaaattagccaggtgtgggggcttacactcttgtagtcccagctattcaggaggctgaggcacaagaatcgcttgaacccaggagtcgggggttgttgtgagctgagatcacaccactgcacgccagcctgggtgacagagcgagaccctgtctcaaaaaaaaaaaaaagaaaaaaaagaaaaaaaaaagaagaacatggtgacttcacctgcccagggaggcgtgccagccaggggcccatggagaatcagatattcagccagggacaagggcatgtcagtgggcagagtgccagggtgtgggaggctctctgggtggtcgctgaccaaaaacatcacttctgggttttgtgactcagaaatgagctcagcctgtataccctgcagatgtgatgagccccaggccgagtcctctgggggtgtcattaatggcgtgtgcatgagcattttcttctggcatttttacagagaccatgtgcagctggactctccggagacagcaaacagaaattctattatgtgtcctatcagctagtaaaggaggggagcttgccttgagttgtgtttttctgcgaccctgtgtgtttgatccttgtctgcacccagtttggccaccctgacctctgtcactcccaagtccgaggaaccagtggttatgtgaatgtgaagttatttacttcatctgtttatttagatctgggccctggggtggccccatgcgttgaataagtgtgttctacagaacccatggtccctgggttctgggtgatcagtggcctgaggagggaccagactccagcccgtcctaaggagcttatgagaagttttgaggggactggtgcctggacatgggctgtagcgtaggtggagtgtcgaggaggaccctacacacggtgagtgggagaaagcacctgggagagcatcccgcagcccaggagggtggtcaggttaagtcacagcagggatggggctatcagaatggtgggctgtgaagaactgggagggccaagactcagggaggccatctggatggggaaggtgtgagccgaggcccagaatggagcacccaggggacccaggctgatcaggtcgcagcgagcatgaggggactgtgcgaagccatgagctccagactccccagtcgtgggccctgatgcgggggtgtgtgtgagctggagccgtgggaccagggccgaacccgtgtgctggacagtcttcggggcccagacaccaagggccacccggagcctacaggaaagttggggagtagaggggcatgtgttgtatggacagagccctaccatgcttagaggagtcaggctcctcccccgactctgtggccacacattgtccctcacactcttgatttctcagccacagtgagggtgaaaaccagggtcagctcgagactatgacccagttcccatttcacctcctgggtcttctccaggttctgtggggttttttgttttgttttgtttttttgagatggagtctctcgctctgtcacccaggctggagtgcagtggtacgatcttggctcctaggttcaagtgattctcctgcctcagcctcccaagtagctgggattacaggcatgcacccagctaatttttgtatttttagtagagacggggtttcaccatgctggccagactggtctcgaactcctgacctcaagtgatccgcctgccttggcatcccaaagtgctgagattactagtgtgagccaccatgcccggccttctccaagttccgaattccctgaaagcagctgtgctgttgccctgccctctggggcacaatgttaggagtaagcagcgtttaagtgcctccctgattaagagaaagatgtatattcccactgggtggcgaggacatagatgtccaggcccatgtgttccacggcataatgtggggactgcagagaggaagggacatgtttatgtcccaggtgagtcatggaatctcagaatatgagggtgtgcatgtcagattttttcaaggaggggtgtcttagtcacttcaggctgctataacaaaaatgccataaactgggtaccttaaacaacaaacacttactcctcacagtgctggaggcaggaagtcagtatcaaggagctggaacatttggagtctgccaagggcccacttcctggttcttagccatcttcttgctgtgttctcacctggtgtggaaaggatgggggctgtctctggggtttcaaaagggcactaatccccttcatgagggttccgtcctcctgacctaatcacccccaaaggccccacctctaaataccatcacattgggggttagatttcaacataggaattttgcagagatgtgaacatttattctgtgtgctgtaaggggcatctcagagtgccacccccacatctccaaagctgctggaccttgcatatgggagctgactctcttggggctggtgtgactcatggctggaggcctggcttgttaacccagctctgaggtcctctgggtgccacctcctgcacaccagccagccaggtggcctccacgtaccttctgtttcatggagaagagctacttgcttaagacaggttcctcaaacccctggcatctggtctcaggtgactctgagcatctcatggctacctcctccccacctgcagcctcatctccaccctgccgcactctatgactgagcagcacagggcgccaggggatgtttgtctgcactgctgctgtgttgctgacttatgagacctctttggaaggggctcaacaggtgaggagagtggtgtgaatccacttgtcctaatagaccactccaactttctgaacatcccaggctttcctggtacagtccccatcttccagccaagaggagagcatggctcaggtgggattcaggcgagaacagggcaacgcacacctactagccaagatacaaagcacttaatacagggaggagtcatgtgggcagagcccagtgggtctgggttcccctcatgaggaccgagaggggaccaacacctgttagatgtctgctgtgttcctgacgttggcctgggtgtgggatgtgactgggtgtctgttgctctccttggcaggtgcctgccctggaggtaaagaggctgggacagtaactttaggcagtcagctggggtctgtctgttaagcaaggagcaggaatcagccttgttctctactggcctgtctgggaagcgtgaacaaattctgtgtcttgaatagtacccgagtcagttgccagccctgtgctggctctggcagggggtagctgtggaggcaagagtgttgggcagggtgacctgattgagccaagctgttattcttccacctgaggattttccagaagaagtgccaggctcagaaccggcgtcagatacctctgagagcctttccggttgccacggttctcccaggatcgtggagttcttgaaggaaggccttttcctggcgtgtctgcagtggcatggtgatatagccacgccgcccctgtttgtgagttgaatctctgcagaactcacttttcccaggaggtgctttcagaatgcagcataccacagtcctcatcaggatctgctcatttggctgggctggcaggtggctgagttggctcccggagcgggtgtctagcagctgtgctcatggaggcaggctgggcgtgtgaatctcacgtcctcccacggccccctggggaagcaggataggagctgggcctggttcccgagcctggccgattgggagtaacaggtgggatctggaccaggttgtcacacccacaatgacagctgggattatcaccgtgggtggtaattcccacatgacagtttcgagtttcaggtcaagagctgggtcctctctctcctcttgcatctggacagagagatccttgccggctggttttctggctcgttcctcagctgttttctgtggcctgcagagtttgcagccccaggggagtgaggaaagctctgctctggcctgatttttgctggagaagagaaatgtggaagtcagggcggtggcctttgcagtgggtcagctttgggctgctgagacgggcggcgtgaaggccggcttccagagccctggctggcctttgtagtggatgagacggaccagattgccatgctagggtcacccgctgacctgcagtggcctgagcagatacatggctctgccagatttcctgaagtggagccctcagcctcacactgcatcccccagaagccaggcaagaggaggtcataaggtttttctggaaaggagcgaaagagtgcgctgctaaatgttgcaggtgggagtgcgtgaacaggtgaggcttccggtaattatgacaagtgatgcttgtgcttctcagtgccgtttcctccctctgatggggcctgcttgacacctcgcagggagcgtgggtggagagtgtcattatccccatttcattggtgggaacattgagagatgaaacgaggagtttcatctgcaggcccctgggccctctggtcatcccggtcatcctggttggtttattgtcttgttttttaagggggatgatcgaagaaagccttggaggtagggtgggggaagctgggaacagagggaattatatttccttttccaaatacttgtttaagaatggaagagttcctggccacataatccatgtgcacagattttccgggggaaaatccatttgagtttagacttggagaccgtgccacctcccggtctgttcctcaggcttttgacatctgcccacacctggaacatcttaaattctggtggagaatacaaaacgtcactcccctgccccagctcacccctagttcagccccccaggatacctgaagttggggatcctccttcttagctgtggagctcagggtatgttggttccacgtccaaaccttcaaccttcatctgtaaaatggggtactgatggctcccttgcagaggcctggggattcgaggcagcacttctggcccgtacctgttgccatttctgcatgttgtacccctggccctgactcaggctggcgtcctgaacacctgtgcatccacaaccccataagccttccaggagcactatagatcagggtgacccaggattaggccgggggtgggaattacagactacccccaggactgacccagggctatacccctccagggccggtgggaacacgagtggtttttgtgtgtgtatgtggcttgcagcttgcaaggggggtggggggcaggtggcggggttggttcgagtctcaaactcctctgtcgggtcgggtcaggcctcaaactctcctctgggccatttccttctttttctcaacagaaagaacccaggctatggaatcatgtgtgggcccagcagggttcataggcaccttctcagtctgtctccagcgttgggctcttctggtcctgcccagcttgtcgctttagtacctcagtttccttatctgcatggaagcccacctgtcagcttggatgaggggaggaaagcaaagcccctcaggccctgtgtgggaaggagagtctgaaagtgcaggggctgtgctcaggaaggagcgcagcttcaggaggggctggttggctggcagtgttgtgcaggacattcagaacgtgactgggtttctattctgatttgtacaagcataggatactcaggtggctctggtctgttctctagcaggagagtctggggtcaatctgtaataatttagcttctgagcaggtgcccggcactggaagaggagagcccaagagagcacggatacattgtgtggctgaagggggcaaggccctgggctgcctcctactctgaccttgtgggccttggtgtctgctcttcccctctgtctgccactctgagtctggaatgtggcagtgatatgggtgttgtgggcactcctggcatgtgggcagctcctcagtgctggtgtctgagctccacaatgacttcattcatgtaatagtatgttatggctgcgtaacaaagaaccacaaactgtgcagcccaaatcatagaaatttatcatctcacagttctgacgactggaaatatgagattgagatgttggctgggttggatccttataggtggcagttttcaagttcacatgacattctccctatatgccagtctgtatccaaattccacccacccacccccacttttttttaagagacagcgtctccctctggctccagtcccaggctgcagtgcagtggcgcagtcatagctcactgtagcctcagcctcctgggctcaagtgatcctcccacctcagcctcccaagtagctgaaaactacacttgaccaccatacctggctaatttttatatttttttgtagagacacgttcttgttatgttgtccaggctagtctcgaactcctggcctgaagtgatcctgcctcccaaagtgctgggattacaggcatgagccaccacgccaggccacctcttttttaaaggacacagtcacattggattaggacctaacctaatgacctcattttaacttggtaaagaccctattttcaaataagtttagaggttaggacttcagcatatgaatttaggagggaacacaatttagcccctaaaactgtacttctattcttttgttttaaatttcagagcctggctgatcgtgtgtgtgtgtgtgtgtgtgtgtgtgtgtgtgtgtgtgtgtctgtctatgtgtgaaaatatacataggccgggcgcggtggctcacgcctgtaatcccagcactttgggaggctgaggcgggtggatcacgaggtcaggagatcgagaccatcctgactaacacggtgaaaccccgtctctactaaaaatacaaaaaatcagccgggcgtggtggcgggcgcctgtagttccagctaatcgggaggctgaggcaggagaatggcgtgaacccaggaggcggagcttgcagtgagccgagatagtgccacttgcactccagcctgggtgacagagcgagactgtctcaaaaagaaaaaaaaaagaaaaagaaaaaaagaaaatatacataacatgtactgttttagccatttttaagtgtgcggttcagtggtattcagtacatccacattatcatacacctgtcactactgtccatctccagaactttttcatattctccacactgaaactccactaaacgctaactccctcctcccctcctgtccagcacctcacaaccccctttctactttctgtctctatgaatttgactactctaggaacctcatatacgtggaatcttacggtatttgtttgtttgtgcctggctgatttcacttagcataatgtcctcaaggcctatctcagtcagcgtgtgtcagagtttccttcctttttgaggctgaataatactcctttacatgtatgtggcacgttctggttttccactcatgcattgatggatgctagggttgctgccacctcttggccattgtggatggcgctgctgggaatgtggtgaatgtgcacctcctctcctaacctgccccaggcatccttcagaagcggggcagcccaagaccgagatgggggaagaaggtggtttgcctgccctcccaggcttgctgggtgtctgcccgtggctgggccctggccccgggctcagggtggtgaccgccagcagggggaagtccctcttcctgccattcccccccgaccaaccctctgtatttcctctttggaggggcagtgagtgggaagggaggacccacaggtgtgcagcggccatggcccgcatcctggctgagcacctttgttggtgtggagggactccctccagtcactttcagacctcactccccatgctgctcccacaccagggcactgttcccacgccatcctcctttgaagggcactacccatcttccctgtcttgccccttcccaccctcttcccagggacttttctggtcagttccctgctgccaggtctatacctcagggactagaagctcagcatcccctctgctcttcctccttttgcctttgtcctcttagccagacccaggctcactgtgcgtcagtgcccctgcctgcgtttttctaccaacaccaggcctacctggagtgaccatcgcagaagcccccagccctgccccacctccagtgccacactcagatgtgctgccagaacgtcacctgtctccctgcagcctctaggctcccctcttgttccagacccagacatctcctaaatggagcccaagtccttggcctgaagcctgaggctccccacaaaatcaccctcttcctctctctcctctcactgccagcctgtatcccctttcccagccgtaccccctttcccagagaccacttccagccccccttagctcttagtggcctctggctggatctagaaaccaaactgacaccaggtacattaacaagagaaaagcacacaaatgtcattagttttacaggtgcatgggaaacttcaccagagtcaagtccagacaagtggccgaagcaagatgctttatcctttttcgataaagaacaataagtttgagaagtggcaggacaagggggatctggctaggggcagtaaattcttgagcagtcactgggagatatatgaggggtgtaaacctggtggaagataagggttactttgttaaagcatatttattcaggcccactgcagcccccgattccatctcaggtgataagggctattttctcccctggttcaaggaagacacccctcccagaggaatctttatggcttgctgagtatagcaagaaacaggtcagctagccctttctgaagctgcagctcgaagtcagtgtagccatccggtgtattttgggatggcacgtccttcactctttcccagcctttctgcatttgtaagccccaggaaagccggcagctgagtcagcctgaatccctccatggggcgtctttgcagctccctgcccctgctggttgaaggctctgttggtcgcattcttctctctcacagactctgcccctccaaagcccttccagccctctcctgggggctgggttatctctgtcctcagactccatggcaccgagttcaggccatgtcttagtgtcctgtggcttccttaacagaatgccacaagcttagtggcttacaacaacaaacatttattctctcccagttctgaagactgaagtcccacatcaaggtgtccgcagggccaggctgtctctggaggctctaggggaggatccttcctttctgttcccagcatctgatggcccacggcattcctcgacctggtgacagcatctctccagtccctgcctccgccttcaaatggcctcctgtatgcctgtgtcttctgtctctttaaagatatttgtcattggatttagggtccatcagtgtgatattgtgatataagaaacctgtatgtggtcttccttctggtttctggcacaagctcctaaaatcattgtaatttcctgaacgatggggtgataggagcatcttttgttattcatacaagcccttttctgtgggacctgaggttatgctaatgaggtgatgcttgaggggcccctagatagctgtgggacggggctggttgccagaggaaccagccacgtgattagagggttggaactttagctccacccctgaactctggggatggggagaggggtggagattgaattgatcacccgtgtctacagccatgccagcctgatctcggctgaactgatcatcagtggccaatgatttagtcttgcctacctagtggaacctccatgaaaacactacacagtgaggttcagagagctttcacgttggtgaacacatgaaggtgctgggagggcagtgccccaagaggccatggaagctcccccacaatacacaccctgttacccagccctcttccgtttggctttcgtgagtggtatcctttacaataaactggtaaatgtgagtaaaaggttttcccgaattctgtgagctgttctagcaatttttttttttttttttttaagatggagcctcgctctgttgcccaggctggagtgcagtggcgagatctcggctcactgcaacctcccgggttcaaatgattctcttgccttagcctcccgagtagctgggactataggcgcctgccaccacgcccagctaatttttgtgtttttagtagagacgcgatttcatcatattggccagactggtcttgaactcctgaccttgtgatccgcctgcctcagcctcccaaagttgctgggattacaggcatgagccaccgtgcccggctctagcaaattattgaacctgaggagggggttgtgggaacaccccatctccactcccagctttagagtcagtaggtcagaagtacaggtggcccagacttcccccagtgccttaagtgggaacagtcttgtggtactgagcccttaacctgtgaagtctgacacttattccacatacttactggcagaatggaattaaattataggacacccggctggtgtccagagactgggaggattgcctggtgaaaggagaaaacccacacgtgtgttgtcaggagagttctgggggaatagaaacacatcatagtagtagtaattggacaatctagggtgatctcatctcaaagcctttaacttcattacatctgcaaaaagactctttccaggtaaggtcgcattcgcagattctagggttaggatatgaacgtgttcctttgggggcccactacagtgggcttctcaccttggtgtcctcaggggagccagtgtctgcctccctctcctccgttaggtcctggctccgtggtcatttcctcagggagaggccctgctgtccttcctgggtctgtcttcctccctcctgcatgtgctccggtgccacctgcctctctcccgtggccttgtcatggttgctgtgatgcccacgtcacgtgactccatggattccgctggctcccatgggcaggggctgggtgtgcggtgctcaccattccatacccagcacagtgtcctgcacgtattagatactcagtaagtacatttgtctggggctaaaccttcagggtctccaggaagtctttctgagccccagagtcctaaaaagcccaggtgctgctgaggaataataactgtatcatcctggggcggagggctgctgcctcttcccagctggggtttcagcctctgccctgcccccgcaccagccggcccccaacctgaagcctagagcatcaaattattattgcctccgggaatgactgggagccttaggcacaggtgggtccttggagacaggggatggtcctttaacagtgttctggatcctgatggagaagagagggggttctcctctgcccacactgaggcacactcggcttgtggaggaaaacggctgactagtgcccccagaaaatcgccagcaaagttgaccttctggtgattcagtctccaaccagctcaaccttcaagcaggcagagctgtcagggctggtcgtgtgggttggactttctcctccaagaaagctcagagttgtaaatacctgtttctcatctgcggtgtctagggttgcctggggagtcaaggcatcagggagcaggacaggctcaggcccttcccgactgacattttccagcctatggggggccttggctagcctggtggctttctctgtggcatacgctgattcatgaccctgacctctctctacccgggcagctgcggctttccattcttgggtgctggcctggtgatgtcattgttggggtacggcatgagggctgggaggccacaggatcctggggtgctctctgtgtacccttccaccacagaaccaaggaccctggtggcaggcctttagccagggtgcggtggctaactggatggggcacgtctcatttataaagaattttgaggcacttggcgtggatgcaagaaggggcagctgccagcctggcagaggaggagaaagtagagaaaccaccagaaccaaccacacatctccgaaagcactcactgcatgtgggtggcctgaggttatggccaggcggtactgatgtccatccggaaggatactctcagccctcgggaaacagtggaattatgttccgggttccctgcttaggagaggaaaacaggtcagccttaaaaaaaaaaaaaaattgaggtaaaattcacataacataaaatgaatcattttaaagtgaacaattccgtggcttttagtgccttcacagtgttgtgcaaccaccatctccgtttagttccgaaacattttcgtcaccccagaaggaaacccctgcccattaagcagtcaccgacctcctttctgtctttatgggtttacatattgtggggatttaatatcaatggagtcatacaacatgtggcactttgtgactggcatatttcccgtagcatcatgttttcaaggttcatccgtgttgtagcatgtgacagaatttccttccctttgaaggcagaggccgggtgtagtggctcacacctgcaatcccagcactttgggaggcctaggcgagaggaccacttgaagccaggagttcaagaccagcctaggcaacatagcgagacccctgtctctacaaaaagaaaaaaaaaattattttagctggacataatggcacacacctgtaatgccagttacttagggggctcaggcaggagatcacgtgagcccaggagttcgagactatggtgagcaatgctattccattgaatctgatggacatttggattgtttctacctcttgtgaataatgcttctgtgaacattctggtacaagtttttgtttgaacactagttttcaattgttttgattatacacctaggaggggagttgctaagtcgtaaggttatcaatgccacatcttagaaatgccttctctttggaatgaaagttgacccagcaggcaggtcacacaggtgcagctgggcacagtcaagctctgcctgagactcagtttttcctgtctgaaaaatagcaatctaaaagttcatgcccactcaggtgcgtattccaagagatgatacgtgggttttcagcaccatatgtgacctggaggaagtaccccgtaaagggtggtgggttttttttgcccactacttcaaagatttgggtcttttttgctgtcagaggaacttacctccctgaagcactacgggtattccctgaccttacctgaggttctgctacgatagccagcttcggagcccccaagatccacagcccttctcgagggtagagtctgctcttggtgggtgcatggtggtaagaaggtgccaggctatggatgagcgtggggtgcagagccagctccgactgtggactctgcacccttcatgagacccgaacctctgtcccagccatggttttccaagcctctctggaggacagtgcctgcctgacaatccctccaaaagacgtgtgctgctgtttgtagaagtcgctggcaccatgctgccatggcctgcctaggacctgggagaagatgggaggccaagaggagggcaggagccgggaaggaggacagctgcagccatgacagggtgggggtttgatgtccgcctctgtgaaaacctccaccacagctggccgagccaccggatgtttgatctccttttacctttgtaaataaatactgcctagtctttggctgccagtgtaaacaaggatggagaccactctgctgatgatctctgtgctccctggagttcctgcctcctccacccaaattcctcccagtgcccctttcttctcttgactccagtacatgttgatcggagggccctttacagccgctctcattgttctgggtagggagggcccagagcatgacctctgatcccctgagggcttgctcccatctcaccctggggcacattggcagagggtgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccgccttctgtctctatgaatctgactactgtaggtacctcatatgagtggaatcataacaatatttgtccttttgtgtctggcttattccactaagcagaacatcaaggttcatccatgagattgcatgtgtcaaaatgtccttcctttttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacgcttgtaatcccagcactttgggagactgaggctggtggattacttgaggtcaggagttccagaccagcctgggcaacatggtgaaaccccatctatacttaaaatacgaaaattagctgggtgtggtggcgcacgcttgtaatcacagctacttgggaggccaaggcaggagaatcacttgaacccaggaggtggaggttgcagtgagccaagatcgcgccattatactccagcagtgtccgggcaacagagtgagactccatctcaaaaaaaaaaaaaaatcagttattttgggtacataactaggagtagaattgctggatcatgtggtaattctgtttaattttttgaaagatttttttttttgaaccagtgtagtctaggggatgtgaccgcagcacctacctgggcctgggctgactgggacctaaccaggcattattcttttcgctatattatttttattttttggctgccctttttccttttatgaaagaatagatttgcagagttctggggttgggttgctaagcaaactgcctggagagaagagggtttcagatttcactaggccctccctcttccacaccaaccctgggctgtctgcactggacttcctctccccagccccactcctagtctggttcctggttcaggtgagcagcagccagattccatgcccccaccttctaccttctagtgtttgggttctgccttggataaagctttgcaggaaggatgtggctgatgagaccatcaacctcagtcctgccaagggtgaggcggcccagagaggtttttccactgggtattcctggtacgggggcaggagccaggcctcccaattggttctggctcttgggagatggtggctttcaaaatgccaaataatgtactttatcctcaagaggaaagggccttggctgggcatggtggctcaagcctataatcccagcactttgggaggccgaggcaggagggttgcttgaggccagagtttaagatcagcctggacaacatagcaagactttttctcaaaaaatgtttttaaaaattagctgggcaggccaggcacggtggctcacgcctgtaatcccagcactttgggaggccaaggtgggtggatcacaaggtcaggagatggagaccatcctggctaacatggtgaaactccgtctctactaaaaatacaaaaaaaaattagccaggcgtggtggcgcacgcctgtagtcccagctactccggaggctgaggcaggagaatggcgtgaacccggaaggtggagcttacagtgagccgaaatcgcgccactgcactccagcctggacgacagagcaagactctgtctcaaaaaaaaaaaaaaaaaaattagctgggcatagtggcatgcacctgtagtcccagctacttagaaggatcccttgagcccaggagttcacagctgcagtgagctatgatcactccactgcacttcagcctgggtgacagaaagatcatgtcgctgaaaataaaatcacgggtggggggtggtgctttgtgtacttaggggagctcaggtgtgaaaaactgcgttttgaaaaagcaggttcctgtgtgctggttagaatggggggatgaggaaattgaggggcagtcctccccacaccatcatttgccttggagcagactggaagagtcagcagaatgaggggcaacaagtatggattggagtgatctgggtgagctgaggcaggggctgaagccctcatatggaacgtggcagggatgagcaggccatctggaatccagacttaaaagcatcagtcacccagacattgatttgagatctctgcagagggggaaacggctggggtttcagccacttggagtgtcctaattccccagcagagtctggccgtgagacctagtctctctgtctcacctggcggggtgatgtgtccacttcaaagtctcactggacacaggcaggcaaaccctcaccgggcacttgattcttgcaccaggttttagcgtggacgttgctaagccagcatgtggcttcgcacatgtggagtcttacagttactctgaagcaagccctgggaccccgaatctgaccccgaagttcttgctgggctgactccctactcggtgttgacttgaccttacacgggagtcagtgtagtcatgggcgcggaaagcactcagataaaaggtgctccacccagtgatgaagaatgtgttgatgtcttaagatcgtcttcagataaacagcaaaaccgttggttaaaagctggtctaacccaccttattttgttgttgtttgttttgttttagacgtttcgcagcctgaagctgtggttttagtctctttctctagtgataagtggaaaagagggatgaggaaggggctttgctggcccgaccaaaaacaaaactaagaacccatgagtgtattctctcccttgggcacttggacacctctgctagaacatttagtagacgctgacaattccaagctaatgtaaaagccaagtctggagggtcatggggtgggagactagggtgaggaagttgttaaaggaggccaaggggatggcacggccttcatctaatagtgacagtagcattttagagctagagggtctttatccattgtctagttcacatgcatgattttaaaaaaggaagctgaggcaggaggattgcttgagcccaggagttggagactagcctaggcaccttagcgagtcaacgtctctgttaaaattaataaatgaagtcaagaaaggtgaggcatggacggcctcagtgacctggactaactcacagagaggtagcaatggggagggccagagcctcgcttctgagggattacaccacagctcacttcccccacccaaaggccaaaggaactgagcgttaataaccaacatagcgatcttggtacctggagccccctcgatgtcccatggattaaggagaccagattcctccatacagcttgttgagggacttggtgggtgccccttgctcttggggtcttcctactttggctgctatgctcaacccagacccagcctcttcctggaattctcctttcaacacgcacagagacagaacccggcccggactttgcagccagtagttgtgtgcaatcacctgggacagtgctgcaggtcagcagccggcaatgctagacaccgggttggggtcgctcagcaggtctaagccctggctgccagctagattcccccaggaagcccctatagcttcggattcagcaggtctgtgtggatcccggtgaaatcgttttcaaagcctcccaggtgttgccgacgtgcagccagggctgaggacacctgttagagggtgctgagtcctgtgggacgagaagtggagaacctgggagagggagaggcagaggtgtgcaaggaagccggaacttcggccacctgcacccacagctagtggcagatcactccagacacacggctctccccggccttccacgtggaaaggactgacaacagtctccacttcaggattgctgggtcagttgctctgagtgcctgagggcagccctgtgcccacccagcctgggtgtgtgtggtggcagttgtaaactcctgaatgaacaccaaggtcacctctgctggtaacctttgggcagggctgcttacaggtgactcatggtgagagtgacgtcaccccatcagggtgagctctcagaagtcccatgggcctcaaagtccccctttggaaggagtggagaagggatcctcacatgagccatggattgggccagaagatccttgtgggttgacagtggtcatgatgagtccactggcttagaaaactcaggctgagaacaggccatggaggagctccagatggctaaggccttggaaacacgtgttgagctttgtcattcagcctgggaggaagggagtgattatctccaggtgcctctgggaggaatgaattactctgtataaccagatagtcccaacaggcagggggcctcttgtaggataagccactctgtcctcctgcgggtactcacattggggtaagggtggtctgggatttcgacagacctgctggaaggtggtctatgactcagccagaagctgggccagactgggggatgggggaacctgtagccccagttccctgggctggcatcggaatagcatggtaggactcgctgctcatggtggacagaacttgcaccccagccagcatgctggcctgtgctcctcaccccatcagaccccatgggcaggtgtgcaaggtgcaaggaccgttcctgacatcaagacggtaacggtaacattttgggtttccctttctttttcttttcttttcttttttttttttttttgagacagagtcttgctctgtcacctaggctggagtgcagtggtgcaatcttggctcactgcaacctccacctcccaggttcaagcgattctcctgcctcagcctcctgagtagctgggattacaggcacctgccaccatgcccacctaattttttatagttttagtagagatggggtttcaccatattggccaggctggtctcgaactcctgacctcaagtgatccacccacctcggcctcccaaagtgctgggattacaggcatgagccactgtgcccagccagggtccccctttctatagcaacccaacccccctgtatgggggagaaccaactgttttctctgtacacaagctcaacgcagaacacttatgtgaccaaatgtaggggtttttcccacaccaagcagttctctgcagacaccagctgggtgtcctacaatttcaactcagttttgacattgtctacctggagttagcatcagatcccactgttaagggctcagctccagaagactgcccctaacgtcaggtgtcagtagcaagtccaggttatctattggccgtaaattggaggttcctacagccccctccttgagtttgatcacttgctggaacggctcagagaactcaggaaaataacttactagctgactggtttttaatacaaagatacaactcaggaacagccatatggaggaggtgcacagaggaaggtctgtgggaaggggtgcagagcttccatgccctctcggggcactgccacattttcagcaacctggaagctctcctaaccctggccttttggacagccctcattgtgtaggcatgattgattacgtcactggccattggtgatcaactcaaccttcaactgtgggtcttccccagagagttgggggtgccaactctctaatcgtgtggttggttctcccggcaaccagcccccttcctgaggctatccaggagccccagccacctgtcatttactagcacacataaagacatgtattactttggagattccaagggttttaggacctgcatgccaggaaagtagagggtgggatatgcaaagatcaaatatacatttcttaagtcacaaccccctgccaggggcagacgtatctcagaaagccccttgtattgtctagggagtgagctcatgttcatcccccctcaccttgtggtctttgaccagtcagttgtgaaggggacgtcagcatacccgaggtcgttgtgagatgcctgttggggacagagatggtgtcagctgggtgcttgctgggatgggttgagtatggatgctcccttctctgtctctaacacaggatgcttctttgcacacacagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcggtgagtccccatggtgtacgtgtggcaggagggccaggtgaggctccctgaagcgcagccccatgctcaggggtatgtagcaggtaggtggtggagcagccaatggtttggaagcgagtgggtcaccaaaaactccttcctcatctctacatgtggtacacagacagcctgccagatgtgttgatcagggagatcgggggatgctttgaactgagcgtggaggaggcaggcagcatgtggtcttgaggctgagaatgtcagcaccagaggccaccaccaagacctgcgtggtggcgccggcaacactcctgagccaggtggtgtctgggcttgggtccctttgcttcatagccttcttgctcccttttaccaaagcgtgtgctgaggatggctccatccatgtgaccagagcctttcctgtgaattttcacttgaccctcattaataattcttggcctttctgtcacttccactttacaaaggtgaaactgaagtccagtggtggcttccccaaggtctcatggctagtgagtagcggcacattcagtagatgctctgccatgccctccaagaaagcagtggacccacgccccccctcacatgagaacgtagcccgggctggttgcaggctggatggtgctggaccgcccggccctgcatgaagttctgattcctcttgctggtcccacagctcagggggctgcttcagcaatgctctggggcccagatgctcaccccttgccattggtgcatgtccccccacttgacctcttgggttccttacttcttgggctgagaaaatcactgccccagggcagttgctcctttttgtctttttggtccctgatgacagattacttccgcactctgcttagcttatttctagatggtttccaccatagcctggcatggtggctcacacctataatcccagcgactcaggaggctgaggtgggagaattgcttgagtccaggagctcgagactgcagtgagctgtgattctcaccactgcactccagcctgggcaacagagcaagaccctatctttaaaaataataataaaaaaataaataaaaagagcaagagagagatggacttttccccatttctgtaaggaagctccagaagtgtatcttctcactgagctgcttttttctggggctgacatgttagctgcacgcctgggactgctgcttacgtatatacttttgtgatttctgaaggccttggtgctgggcaggcttctcattctgaaccgagaggatgggagaggaagccagtgggtaacatgtacctgctccgtgcagcacacacaggctgctgccttaggtagcttcctatcccacgtcgagtgtcagctttttacagactaggaggccgaggttcagagaggtgaagtaacttgcttgggccacacagctccagggtttgaagccttcctgattcttcaatgggcacactttccctccctcaactgtcttgtctttcttggtgcacccctttcttgctgcattgtgagcgtggtttggtacaaagaaggaccaagttcaggtaggctaagtgctgaacttgagaaaggcaatttctttccatcattcttgagggctatctgcacccagccagtccttgatgcagttcctggccccgaaaggaagctgatctgcccactcagtgccccagtccctgtccgggggtgggggcctcccacccacacctggctctgacttggagtacagccttcacctttcagtccagggcttctcctctgtgaagccactccagatcctggtcccccgacccctgctccctgcttctgccctcacaggagctgtagatgtttctcgtggtgcacatcctgcaggaggttgcacgtctctgcctgtcaggtccagagtttccaatcccaagcacgccccttggcccagagctggtctgaagaggaggggatttgattggaggagaactgtgtgtagctcctttccagaaaccttctggtgctcttcccagtggttggggccccaggacgggtacccttcactgctctggagacaagcatagccttgacttcctggtttccctgccagccatgcaacaagccatgcaaatgtcatctttcatttctgatctttggtttgaagacatggctgtcgcttcctaggacacctgacttcccccagggagcatggtgatcttgaggccagaggcaccctgatcctgaccatccagtgggaaatgggcatcaggctgctcatccctctcctcctgcacgccacccacccctcatttggtcccagatgctgatcttgagtctttggggtgtcagtggactcctgtggcatgggtcttctctgtgaatacccactcgtagtgcagacagaggctggacagaggccaggcacccccttgcccggggtgctgtgggaaggattcacacaggctggcctgttgcgacaacctgcagccccaggaccctgtacagaggccagccccttgccctctggtatgccttgagggccaggttcttggggtgttcgccggctgggccgcaggacaatgtccagtctgttggtaatgaaaacctgcccttgcccagagcaagagggtcctttctccagcagctgtgctagctacacactcccagcccagagcagcctgcccctcgcagtaagggttttgcaccctgatcaccactgggctcccccagattagggggactaggaggagggactagaaggggcctctttgcactctgccctgtcctgaagctcagttccagctcccgccctcagttcacccgtgggcctggtagccagctgacaacagttttattcacctgttctctgttggcttttcctgcttggttgtcacaagcccagtttgttttgtgggttctttattggcttttatttagcctcaagttttgtgtttgtacccacctaggtagggtcatggtaggagggccttccttccatgtcactgacttctttttccaatttccctttacctccggcttcctacccgccccagcctccttgcctgcctccatggccctccctgcattcacgtcctttcccataactggcacaagcacagccctgagttataaatagccccaggccaggccctgccctttgctctctcgttttctctgcatggacttggctgatttctgagccatccctgtctgatgccatcagcactattcaggactctagaagattcttagtctaaggagaagtgcctcatcctgagtcttgtctccaccccaccccgtccatgccctgagccagatgttccctgagcggccccgcccttcagaacacggagggagagccagattctgccttcctgcctgtgctgtttttcctcctggctttccaaaccatgtggacagaacgagacacagtgctcccacccacgccggcacaagcatctcacactgggtggggctgtcatgggccctgctgccctagcagcctccctgggccctacaggccgcctggtactcatagtagcaagattgtccttagaacatgagcacggctggcaggctgggtggatgggtggcgctgcccaagggacccaccattcccttcacctcttctcctcttgtggagcagggagcggcatctgcacacagtaggaggcacctgcaggggcagctggggtgctttccccaaagactccaccattcatgatgggcagagagggggtgtcataggtcgccccaccctacgtgtatgtgcaccatgggcagcagacttgctgaacttgggtagcatttcagggcaccaaggcaggctcaactgacagccctgggttccttggacccaactgtctccaagtgagagtacggagaccctgaaggagccctcagagattcataaaaacgcagccaacactaggatacaaccaggtgtttaagatccactcattgatttattaaatgaatcttaattgagcacctgggtgttctgggcactgtgctagacagggaagttcctagctcaggcacagccgtggcctggaggctcccacccgtggagtcactgcctaccctgccctggggggacaggtgtgcatggaacctgcgtgtccttttccttggagctgctctcagcccagatcttgatggctgtcccccccacacacatgtacgtgtgtataaatgcatatatatacacacatatacacaggcacccgggcatgctgacacctcatgcatacattcacacaagtgtgcacacacttaggagattcccagggcaaaaaggtggcccaggaaggctttttagatggtcccagtgggcaagtgaggatgtgtggtccaagccccagggactcaaatggggcacagggtggggctccctccccgggcagtggaggctcagggccggagggcatttgcctgagaccatggggcaggccaggccctgggcacttcgtgttgaacctgctgtctataccatgacatgcctccctcctagagggccagggaaataggacagcagggttgggagtaggcaggggctgtgctgggaccctgattccaaattctacagataccatgaggcctgagctgacctcagtcagatccttcctcaaacccatcagttctcactggaggtgattctgctcccagggcatgtgtggcagcgcctggagacattgtggctgccacacctcgggggagagggtgttactcacatacgataggtagaggcaaggatgctgcacagaatcctgcaaggcacaggatgccacccagcccctgacagagactcctccgggcctagatgtcagcggggccaacgagaagcctgcccgcagccagtgattttccccgaaagtgggaaagtgagtgatcagggaccaccgccccagttccacgcctgtgagcccagcaaccagtggagaagtggacggggctgtcacagacaccggacctggcaccacccccaccccccgcacccacacactttcctctgactgcaggcagggccattgggcacaggcggaacaaagggagcacggcctcagcccggtggagcactgaggtgctgccatgggcatggccagcctccaacattgccagtggccagggagtaggcgggagtggccaggaagtcaggtggcgatttctgtggcctttggcatcatcatctttggtgtcatgcctttgctgggactgttgtaacaaagcatcacagactggggggcttaaagaacaggagtttattttctcctagtcctggaggcctgaaatccaagatcaaggggtgggcagggttggtttcttctcgggcccctctcctgggcttgtcttctctatgtgtcttcacataatgttccctccatttgagtctgtgtcctgacctcttcttttacaagcaccccagtcctggtggggtaacatggctcatgcctgtaatcccaccactctgggagtttgaggtagaaggaccgcttgagctcaggagtttgagaccagcctgggcaacatgacaagaccttgtttctattaccaaaaaaaaaattttttttttttttttgagatggagtttcgctcttgttgcccaggctggagtgccacagcatggtctcggctcactgcaacctccccctcctgtgttcaggcaattctcctgcctctgcctcccaagtagtggggattataggtgcccgccaccacacccggctaatttttgtatttttagtagagacggggtttcaccatgttggccaaggctggtgatctcgaactcctggcctcaggtgatctgcccgcctcggcctcccaaactgctgggattacaggcgtgagacattgagcctggaccccccaaaaatgtttaagttagcagagcgaggtggtgggtgcatgaggtcccagctacttgggaggctcagatgggaggatgacttgagcctgggctctcaaggctgcagtaagctgtgactgtgccacagcgctccagcctgagcgacagagtgagacatcgtctcaaaaaaaacaaaaaagaatgtgacatatggaaccttttggcttcagtttaccttaaaggccctgccttcagatacggtaacgttctaaggtactgggggttagggcttccacgtgaatttgagtggggaggggagatgttatcataactaggactagaaggtggcctcccaggggcatgggctctgtcccctacatcaacatccaacaatgtgtcagcttcatcatttggagacaaaaacagtagagcttccctgaactttcagcagggacgctaatgagaaggggggactttgtcatagcccacatgtaagagggtccctgccagtccagtgatgtcagggtctaaaaagcagggtcaggggacacaggccttgagccccagggacagggttcttctggggcagatggtagcagtccctgtggctgggagggagggcatctggagaaggcggtgctgcctgggccccgtcaatcgaagggtcatgtggcggcagcagtcagagaatccaggtgaggcgggccccaggtgagcagtggggagtggagtttggctgcagcagaagccaggtggccatgctgtgggctctgacgccccctcaggtcagagcctccttctccttccctgactgtgtcaggcagctgcccttgggttgcatgcagaagcgtggagggaggcctggcccagcctgctccgcaccaaactctgtttcgtggtctggcaagagtaagggtggccctggtgttgccagatgacccccctccccgggattctcagtgactgtgagtgtgtggcttagtatgtgcggagggtcccctgcctccctttaattccatgtggagcctttgtgggggcaggggtttgtccagaggtcaacaagctggccctcctctctcagagggccctgatggaagaatccccctaccacccttccaggctgacttctgtctatttctcctgcagagtgagctggacttggaaaagggcttggagatgagaaaatgggtcctgtcgggaatcctggctagcgaggagacttacctgagccacctggaggcactgctgctggtgaggaggatttagggagctgagcagggcgggatggggcagggtgacagggttggggagcctctttgcccttaagtcccaggtcagctgtcagagcctgggtgcagctcgccatccctggagtggataccagtggaagactgagttgccaaaccaagctggttttaaaattgtatttgttatgtgatttaaaaataaaagtgcatatgtcaggtaaccatgactgtctactgccatacaatgcacctgacggatggcagcccctctcacctgtgctacctcacttgtgccctcttccagcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggtgagtaacccagggccggtgctgggactacaggcgtgtaccaccacgtccagctaattttttgcatttttagtagagacagggttttgctatgttggccaggctggtctcaaactcctaacctcaagtgatccacctgcctcagcctcccaaagtactgagattacaggcgtgagccgccatgcccagcctttttttttttttttctaatttatatttatttagataggtatttttaaaaagagatggggacttactacgttgtccaggctggagtgcagtggctattcacaggcgcaattccactgctcatcagcacgggagttttgacctccttcctttccaaccttggctgtttcactccttcttaggcaaactgatggttcccgactcctgggaggtcaccatattgatgccaaacttagtgtgtagtgcactacagcccagaactcctgactgaagccatcctccggcctcagccttccgcgtagctggggctataggtgcacgccaccacaccctgtgtgtggctgggactacaggtgcacgccatcacaccctgtgtgcaccatcacaccctgtgtgcacacactttccctaaagcaggcttcctccgctgggaaacaagtcctctaggggcaggtgtggccagaggccaggcccccctctaagtgtgaagagcatgtgattccttaaaagcccttcccccagcacttctggactaccgagacacacagctctggcctcgggcctccccttggctggtgctgggggctgagttttctgctctgaggtgtggctttcctgtagggggacccctccctctgccaccctgtgctgcagacccccagactccaggccagagctaaggcttgaggaacacagaaggcacttaatttgttccagttcttgctccctggggctctttcccccatggccagagagcaggaggctgtattttgatacatgctgccccctccatctttgaagcccccccacccccgtttctccgtgtgtgtgtcagcagttttaaacctagtggagggtggtggctcgggctgggctccgcgtcgggctgccccgcagctgctcttgggcagccagggccgctgggtgtggggccgccgggaatggcgggcccgggtgagggcgggcccgggtgagggcgggggcggagaggcgaagaagctgcaggaagggagggtgacgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacctcgcatattgtcagtgcaggaggagatgggaagattggccttggtaagattcacagcaccttcgctgccaagtactgggctcatgaacaggaggtgaactgtgtggattgcaaagggggcatcatatcattgtgagtggctccagggacaggacggccaaggtgtggcctttggcctcaggccagctggggtagtgtttatacaccatccagactgaagaccaaatctggtctgttgctatcaggccattactcagctcttttgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagcgttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaaactgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccgctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaaaaaaaacctagtggacgtgacttggcctgccgccctcctgagaaatggagaatcgtgttgttggggggaaaaaaacacacatccagagctctttgccagataatattccgaaatcactcagagacttttttaaaactttaatatctgaggaacactggaatttaactttggaaggtttccgctggctgccctggaggccttgagctaccttcatgcgtcagatgatgcagccggaagactcggaggagaggctggcgttgcagtgggaagttgttccccataacgacgagctgagtactcacgtgtgttcaacctgggctgggtgctggggactccccaaggacagataggcccggtgcctgcccttgtccccatgaccagctcagtagggttggcccagcatcgctctgtcaggtttccgggttggacaagtcttaggaccaaaggagcttgcagtgcccttcccagctccggtgcctcttccaagcccaggaactcgtgatccacgtccagtggttcagaaagccagactcagatgcggcttctgccacctcctcctgtggggctgcacgggctgacttccctgctctgggttgtggttctggctgaagttttatcaactcagaatttttatttttctaattatttcaaacttacaggagaactgtaagaatggggcaaagagctctagtatagccttcatccagatacactgatgggaactttttgccacatttgctttatctctttctgtgcacacgcaaacgcacatagacacatacacacacaagcacaagaagttttccccctgaatacttcatttgctaagaacaaggacattcctataactcacagtagaatttgtcaaattcaggaaatttcacattcatgagatactattatttaatatgtagttcatataaacttcccccaagttaacaattacattcttcacagctgttttcattctctgattcaggacccggtttaagatcatgttatgtacttggttgtcccatctctctagtctccttccatctgtaccagttccttagactttgcttgtcttccatgaccttgactttttttttttctttttccttgagatagagtctcactctgtcgcccaatctggagtacagtggtgcagtcttgtctcactgcaacctctgcctcctgggttcaggcgattctcctgcctcagcttccctgagtagctgggactacaggcacgtgccaccatgcccagctaaatttttttgtgtttttagtagagacaaggtttcaccatgttggccaggctggtctcaaactcctgacctcaggtgacccgcccgcctcagcctcccaaagtactgggattataggcatgagccaccgcaccctgcctttttttttttcccttttggagatggagtctcgctctgtcacccaggctggagtgcagtggcgtgatcttagctccttgcaacctctgcctcccaggttcaagcgattctcctgtctcagcctcccgagtggctgggattataggcatgcgccgtcacgcccgtctaatttttgtattttcagtagaaactgggtattgccatgttggccaggttggtcttgaactcctgacctcaggtgatctgcctgcctcggcctcccaaagtgctaggattacaggccgccgtgcccagacaaccttgacattttttgaagggcacaggcccactcgggtttgccagtttcctcaggaatagcctcacgttctgcgtaacagcaccacagcagcgaggctgtgtgcttctcagtgcatcagatccggaggcacatttttgattagtgaaaaatgtggaaaggaattgcttagaactttgcacaagccacctggaagatgtgagctcctggagcaggagggaggagaagtcttgaaaggagtcctcttcccaagacccctgagaccctgctgagctgtcacctcttctgagaggctgtcctggtcctgaccacattctcaaaagcagtctccttgctctcagtccctgtcctgcttataaccatctgccattactttgcttgtgtgtgttcatgcatgtgtttatcaggcactgtcctgttagaacaccagcttcagagggcagcgccgtgtctgaattgtttaccactgcggtgacaaggcctaaagcaggcccttggctgctttgtaccaaggctgggaggcactcagtgacttgcaaaggagggaggagggaaagaaggaagagctctgggcctcatcactgcacggatgaggaagaacctagaattggaggatgcaaggactcctccaggtggtcagcatggcaggggcctggcaggtgtcttccagctgctaccctttcctcgtacactctaagacccttcttgcagcccttgtagggagcagggccagaagatcagacagtgccaagggtgcctggtttatccagcatctgggattgtcatctgtagaaacataaaattcaatataaatgcaaatgcacatggaaataaaatttaggtttgacacaaaacaaacaccaggagccgtgaatgccttgggcttccagcttgcagtcagctacagtgggagtctccagccctgaccagtgcatctcctgggtctgcccttatactccccaggcctaggtttgctgatttttccctcgctgcccataaaggtgttgtggggcccagagatggcagtgtctgctgcactcacacaagttgttgctgaatcgagtgtgtgtctgagctggaggtgcagtgaggagatctattattgccattggtttaataaagaacaaacaacacctctcgccttacagccggtcggtctccccccaccaggtgtgtagcatgacacctgagcaccctcaccaggcccaggatgggcttgtgtctgtgcagtgggaggctctcttctgcaaagacggccggacttggcatttcttatgtgtctgaagggactggacatgcgtggaacaccatgggtgggaaagggggtgacctctgtgtccagggtacactcttgcagccagaatgggaaagtgctgagcacagacacttgtccagattcactgacaacctcaaacttcagctgccgctcatggcaccatttcagcgaatggggtgggaggaataagtagctctggaagggaactgttacctgcctggcgccgtgagtcacttctcagcatgtcattttgggagcgggaagtgtgctgggtgcgtggggaggggagcaggtgggagggagcagcacggaagcgccgaggcctctgcagcctgtgtgccgtctgctgtccctggagtttctgcagagctgtgcacgggagcctgctcttcagaaagatgggggagcagcagcacctgtcccactctctcttccttcctccccctcaggccagccagctgggtgtgtaccgggccttcgtggacaactacggagttgccatggaaatggctgagaagtgctgtcaggccaatgctcagtttgcagaaatctccgaggtaatgccttgatgccgttcagacaggtgcaccgctgactcccacctgtaccctccacctcccgaggagaacagagtgcaccagatcaagatctggtcgtgaaccccagctgtttccagattctgttgggttcgttgcgtcagccctgtgctggggatgctgttgtgcgcagaccgaaggagcagcccacagggcgtcctgcctccccgggggcgagggcctgattctgggggttgccgagttccggggacactctttgcactgtctgtctgcagtgaggggtgtctgtagttctgcctgtgagcagctctctccacaagagtcctgaggctgactttgtacctggcactggaggcgaggccggaggtggcccactcttccttttctagcctgccagagaccttgagagcattgaggaagcattgaggggctagcgccgtggggcgagggctcatggcacctgtgctctgtggacccatgtggggagcaaagcgacaggttggagctgcactaacccaggccccaggtctgagaggctgctgactccctgcctgcatttagccccaggaagctgaaacctcaaaccatgtggtgttagcgcccagggcctcgaaagagtcattcagaaacagagaccatgaatgggccattcagaaggctggtggcccagccagaaccagaacccagccacacccctgggtctgcactccagactggggttctttctgcccttctccagcctgtgtctgcctggtggtcactctgcgacattttcctctttggaggcccttgcctcttcatgagccccccatctcgctgtagctttgccttctgacttggctttcccccacccagcaagggttctgagcagaaagccctccgtgtgagaaccgcagggttagaaagaggcatgggcactagaaatagggagtgaatgcggtcacccttgctgggacaccctcagctgtcacccctgggctttgttgctgaggctttgtgccgtcttattgtttatcaccggatggagcatcacgggcttcgctctgatgtctccagtggtgacagtacctgccgctctgttcttccagagtctgtggggcaccctgctccgccaggtgctgctggtaacaggctctgcatgtatccggggctccagctccctccccactgccagcctccctctggaccattcaatctgttctcttttcctttttcattaaatgagcaaccctcctcccccacagctggaatggtggcatcgaatttcaagtgaccttgacaaatcagggacctgatcttttaagaacaggttacagttaagcgggcaagttcaagtccacccagacaggtttctgcagaggagggaggaaacaccatgggacgccacctggggatcacgtggtgccaccaaccatgcaccagtggattctgagccatggttgagatgcagggagtgggatggggctcaggaccagctgcaaaccgacccaccgtgaaagtttgtggcacctgcaccatcagggcgacatgcactttggttctctgtgtttcaaaaaagacccagaggaattggagccacccaaagaaagcagagtcaaacgcaaggaagagaaagcagcaagccctgcagaggtgttggggggtcagtgctcaggcgtgggagttcgaagatcaccctcaagtacaggaaggagtggagtagtgtccgtcttctcctgggacagtcctgagagatgggcagcatccagttagatctggttccatggaacaccagctctccagacggtaggaataggaattacatgaaaagggctttgggagtcaggccagtttgggaaatgcagggttaaaccaaactcacaagttttcttgaggcaggttttcctggagctcctagataactcccaagcatcacactgtccacggacacgtgggccgcctcccaggctcttgtgagcccagcacctggtttttgcagtcttttgtttggctctcccacccccttacaccctttgggaactgctgagtcagatatacagaagaacagtcactgcgagggctgttaaactctcaggaaaggtaccaaagtgcatggcagcgtttggccccagtgagctggaaaacactttcgtctggtcttgagatgtttcctgcagcacaagaggttggcagagcaacctcagaacctcttctgtctctgtttatgcttttgttcagaagcttagtaccaggaattaatctcagctccttcccagaggattttaggcacacagggatcttttattctgcacttctccagtgatgctttcaacacaattgtatcaaaacagcctaggctattcacttacaagccctgcttttgccctgggaatcttagcacctcattttttagtaagtacacttgcagatccggagagggcaggtggaggtataatccagtgtcagtctgcagtggtgggcctgccctggccgtctccaaagatgggtgctcttcggaactggcagccccctgcatgctgtctaattgccccaagaaaacagtgacgtgtgtttaggagcatgctcctgttggcctccatttacaggatcctctgtgtcagaggatctcagccaggcgtgattttgttcacaagggacacttggcaatgcctggagacattttggttgtcaaaacagcaggaaggcagacgtgctcctgtacctataggtagaggccagggcagctgctcagcaccctaaggtgcccaggacagctgctcagagaatctgtagcccaaaatgtcaacagtgacctggctgagaagccctgtcccaggtggaccgcagcatccagggcatcctgcgtgctcggcttgctcgtgggtccctgcacaccctgtgacttcattatcagctcagaatgcacctggggtttgttgtagtgagggaaagctgaaattgttgccaaagggggaactgtctgcatcatcaaagctgcttctgtcatctgtgtgaacatgcgcttttctctctgcagaacctgagagccagaagcaacaaagatgccaaggatccaacgaccaagaactctctggaaagtgagttctgcatgctgaggtctctgtgtgccctcgtcagggaggctgctgctggcagagggggcgttgtggaaaagcagacacagtgcccacttgggtcatcccttggtgccttccctgttctctcttcagatagagtgggcacgaggaaagaacagctcagggagggcagggaaggataccatcaggaccagtttgccaccaacattagcaacaaggtgctgcttaaattgacttaaatgttatcctgttgaccccagtggcctcataaggaggattttttttttttgaggcggagttttggctcactgcaacctccacttcccgggttcaagtgatcctcctgcctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctgtttttgccaatgacaagtttggtcataaagtaatctgtgcagagcacaggctttaagtggctgggcaggaattgagtccagagttgctgggaaagtgctgtcaggaattgtcagtcacttcttattttcagttgttagggtgttgtgaatagttacacttgcaaagaacagcagcccccggagctttgtcctccaagcctcagtttccctatctgcaaaatgaaaatagcgatgagtgccttatgctggttgtgggagtcttgtgaagaacatacttggcatgtctcagaacacacctaagcgtctgtgcctgggacgggccacactcactgtcatcatggagaagcacgggtggctgaggctggccagggctcccaccatgccagggagttgctcccactgcagtggggctcatgtgcctctggagtccgggtgtcctcgggcaggtcgccagagaacctgtcaaaccaagagttgtattggcatctgagtaggtttctgcttgtctcagagtcaggtgtctgaaatgtcctgggatcgatggtaagagcagctaagaggtctgctcagcttaccctctgggctggggagcaggtctccctccagaattggggcccaccccagcccgtccttgccagggtgggttccctgacctcaggctagaggagcagcagtgctgagccttttcagctgttgccaccgagccagccatgcaggctcgggtctgacagccgctctggactctgcatgcagtgaatgtcctggacttaaagtgttcctgttgggtgctctagccttgcccttgtcactgcgcagaggggagatggggcctgtggaggctggggcagccccctccccactcacccttgcaccgagggtggtcaggcagctggtgtgcttctccatgtgcaacctctctcacctcccctctctctccacagctctgctctacaagcctgtggaccgtgtgacgaggagcacgctggtcctccatgtaagtcacagcgcccctctggaccgggaccaaaactgccccctcgggcacacacagcaacaatgttctgagacctttttttagttgtcatagctgcagccaagggggtgctactggcatctaatgggtagaggcctggggtggtgttggacattctgtagggaaaggacagctctctcttgtccctccacaaagagttactccacgcaaaatgtccacagtgctgaggttgagaaaccctgccctagatccttacagaggagtccttcttggccatgtgcatgcagcgtgagtttgctggaacacatgtaggacctgcttccaggatggtgctcacacaagctctgtccacaaagctggggcccaagtgagagagactgtggtgacactgagggagccggcgctctgggctccgtccacactttgtgtctgcactttgcacacagtggcaggtgccagtgctcctctgtgtctaactcaagtctttcttcctggggcaggacttgctgaagcacactcctgccagccaccctgaccaccccttgctgcaggacgccctccgcatctcacagaacttcctgtccagcatcaatgaggagatcacaccccgacggcagtccatgacggtgaagaagggagaggtgagtgtggcaggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtgtggcctggcacataatgaggcagatgcattcccaggcaggtagcagctactgagaacagccaaggcgtgtaagctggggagccagtgtccagggggaacagcttttgtcagaagcagcactgaggcgaggggagctgacccccggcctcaggggtctcatgcagggacagaagctgtctggcccaggcaggacacaggctgggcgtgaacctgactgtagttgcctcagaaccacctcatggctgggtgcggtggctcacgcctgtaatcctagcactttgggaggcctaggcgggtggatcaggaggtcaagaattcgagaccagcctggccaacatggtgaaaccccgtctctactaaaaatacaaaaattaactgggcacggtggtgggtgcctgtaatcccagctactcgggaggctgaggcaggtgaatcgcttgaacccaggaggcggagtttgcagtgagccgagatctcaccactgcactccagcctgggtgacagagtgaaactccatctcaaaaaaaaaaaaaaaaaaaaaaaagagaaccacctccttctctttcttctggttcatgggccaggtggtcggcactgtaccaaggacacgggccctgtcctcagggcccccagggtggacctgcccaacacatggggcttgctttcctcctcctgccctgggccaccaggcaggcagctgtcagccccatctgccacacaccactttgggaatggtaccctgagtgtccagagtctaatccgagttgacctttagtgagggacttggtcaggtttctcctggtgggcctggcccaggaagggcatggaggaggagggagctgtcccttccattccgctctccggcttgtccaagccctggagctgggcagactcagagtcccatgccagcatcgtgaggaccgacccactgggtggcctagagcttctcccaactgggcccattccttgtctttgcagcagggtgggaacatggccccacctcatcgggcacctgggctgtcaaatgggcatgatttagtggcagtcctcgccatccgtgttggctccttggcagtctctgagcgcattgaaggcggaagtgggtccccggcaccttccagtggaggcgttgagcagtgcaagtgttccccagctgctcatcccatggctgggacctgggagtggtgggggatcagatcttgcttcttggagcaacaaccgggccctgcccttggttctcttccctggctcagggccccagaaggagagcaaacctgtgacaaacctgtgggcagtccacacagatctaagtggatgttggatttgcttctcctaagcctccacgtgctgggtgggttcctgccaggttcgccctaccctcctgagatgcctgctctttctcttctaccgactattcttttatgagcgctctgacctcctgggaagtgagtgtgggcgtcctttttcccatggcttctcctgtgcctagtctgctccctgcaactgcagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactttgggaggccgaggcaggcggatcaccaggtcagaagtttgagaccatcctggctaacacgataaaaccccatctctactaaaaatacaaaaaattagctgggcgtggtggtgggcacctgtagtcccagctactcaggaggctgaggcaggagaatctcgtgaacctgggaggcggaggttgcagtgagccgagattgtgccactgcactccagtctgggcaacagagcgagattctgtctcaaaaaaaagaaaaaaaaaaaaaaagggctggttgcttcacaaaggcaggggcctggatctgcatcctccccaggacctcgccctggtggaggggcacttgctcattgaggaggggtcacctgggtgccttagctgcaaagcaaggtggaggactaatgactctagaaaagtcaccgtgagtctgaccagcaccccttcactcagagctttctatccgaggcacgttaagggaggtggcttgatggtggctaaggcaggatgatagatgcctgtgctttgcccctgcccctgccattcctggggcagatgctgctgatcagttgggcactccaagcctggacatccacctcggtatcccctggcactgcccaacgggtttgcagtccttgatgcagaaagaaagatgccagatgggcgaagccccgtcagggtccgctctccctcactgctaccagtgtactgatttggggacacccttttgcttccctgggtgtccgtgctctctgagggcaatgatgcagggtccgtggcccctccactgggtgttgagactgaaaaggtttcacagcctgcgagggactttatgaaagtgaggggtggtggcctgcccgcatgctgccatctgtgtcggaggtgacgggcgagctcccctgacgacactagccaggaaaggggggcagaagctccaggctacttcctcttagaatttgcagccaggggcagggcctgaacttttctcagttctgcccatctcttagtttggtacatgacatggagtgtcaagttcccaaagggagaaagggactgtgcctctgcattctcatgacagttctgtggggtcagaggtgatctcccttttacagatgaggaaactgcgactcagagaggttgagtgtcttgcccagtcacacagccactaagtagctaagccaggatgcgagtgaggccatgggcccctggccgcctgtgtgcccctcgggtgtgttactctttggttcccttcctcctctgtgagccgataggacgtttccacccctcctcttgttcctgcactacctggaggtaggaaagaggaagagatgtcccttttagctccgcacactaccccatcccctgctgctgctgctgctgctgggagtgtgtcaaggggttggggctgtttctgtcttccctggcatttgatgtcaagaggaaagctgcttctgttggcctgggtgtttcgaggttctcctgcagtcactactgggcctcctgggaggtggcccattgctacctgctgagcctgggcaagtctggcatcgaggagaggcccaggtatgagccctctgcagggtcagccaccccagccccagacccccactgtggctcctataatctcattgcccttttcagccacatcccatggctccagggctgtgctctttggggaacagtgactttgggctgcattccaggtagctccctgatgctgaacggtggccggcaggtgctccagcttcctggcatcctggcccaagcacacctgggggccgtgagccacaggtgctgcccaagagaatgccctccttagccttcccaaaatgacaggatcaaaggatcccgcaggcacagtttctttccaggcctgggttctgagggctggtgggtggcgctcatttgtttaggtgaattaacttcacagttagataaccaatccccactgctgggtgacttcccacgtggttgcctctctgtctactcggagccttggcaccatgtgctgctcagcaccccctccgcctgggctcggaagcatagcggacgatccagtttggatgttctgtttcccaagagccagccaggcattgacctccaatacccgttctctgcctgggattgcagaggcccctcttttaggaagaacacagacagcagtccaaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctataatcccagctactccggaggcggaggcaggagaattgcttgaacctgggaggcggaggtggccatgagctgagatcacgccattgcactctgcactccagcctgggcaacagagtgaaattccgtctcaaaaaaaaagagttggaaaacagttggagaagccagaccctgttggcaaagtttgcaaggggtgctacggagagggaggtgcccaccccaggggtgaagacaggatgggtggggttctcagctccactggacaccaaacagaagctgtaagtgcaaggctagtgcccatgtcgagggctgggcctttctgggcccttcataaacattggcaaacaaagcttgggttctcggcttgtctgggccaagttctaattccttccaggagcgtgggcacgttgcttacctcttagctgtttcttctccaggaagtggtggagctggagcctgctgcatgggagggttctgtggagtgagatgagatgttttacgtcatgctcttttcacaccttcttggcacccagaaagagctcagcaaacattagctgctaccagccaccctgactgtggctgtcagccagcattgttcttcccaggccctgccctaccctcctcctggcatagtgtctctcagggcataggaaactttctcggccagattggccatgggaggctttcttggggaccagagagtctgcagggagggcaagtcaagagcaggtgagagggagggaagggcgagcaggacccttgacctcattctcggctgcagtgtatattggcctgcctggtgaccctccttgctcctggtcccactgccaaacctctggagtctgccacatccctgcatagacagggccactgacaggcagtggcagccagttcagtggcactcagccaggtctccaggggtgtgcgctttgctctgggggcagggtagcgggggctgaggccactggctgcctccagggcccccccaccagccagcagctggaagctccaccttggtcttcacttgggccgtcttccttctccacttcctcagctgctatgtgggcttctttggcaacttttccttgtctcaccagtcaaggccctgctgatttgttgatgatcagactgtagttcgtgtacctggggaagttttccagcatctccatggagccatggtctctgattcctggagcatgtcgtagtcggttcaggctgctgtaacaaagtatcatctgctgagaggctcacacacaggcctttacctctcacagtggtggaggctggagatccggcagggtgccagcagggtcaggttctgatgagggcagtgagaagcacggccaccctcccactgtaccctcacatggccttcctgggagtggacatggagagagaaaaggacctctctttttttccttcttatgaggacactcatcccatcacatggattccaccgcatgacctcatctacacctactcacctcgcaaaggccccacctccagataccagcccattggagttagggcctcagcataaattctgagggggacagaaactttcagccctaacagtatgcttcttccagactggccttcctgggaaggccctggataggctgtgcctggggttgggggtgatgttgcactggcaacagctggaggaggcagctggcctgggggaagtccccttagcaaggaggtgcccctcctcactcccaccagcctgatgcgaccccctcctcagaagacagggcacataatgtgacctcacagggcctcagtttccttgtgtgtagaaatcagggttatggtgcctgccttgtagagtcctggtgaggagtgagtggtgtgattcatgggaagctgtgactgtcacattcccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagcatagccagcatcatcgtcacagagaaggagaagggtgggctcgggacagtgaagatgcaggctgtcctggccacccttgctttctgcgggctcctgtggggatgatgattttagttattcaagaagacaggtggcgtttcttccaactggtgtttcccacctgggatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaagaatgaacacacctggaaacatggagacacacagggacacacagacgcagagcacataggatcttcccctgtgcccttttcatacacagactcccatggccccggggagccaaagtgtggtaccgtccctgtcccggggccactgaggccctggccctctctgtcccacagctccagctgggactgtttgccctagttgagatgctgagccttggggacagtggtttccagccacgtggccttatgccggctttgggatgcagtcaggattgtgaccccggcccacccttgccgtgtgccctggaggacgactcgggtgggctatgcaggaagcctgtgctgatctcaaggccaactgtcctgtactccaggccggggaccaggctgctgagcgcttccgagagggacatctcctgggcagggagtgacataggccacgccatgtgggcctcccagccatgtgctggtgctgtgtgggctgggagggcaggcaggggccgagtgacggggactgcagagcggggcctgagatgctgtgacatgctgggctgcctgtggctttcgggcttctctcagatgagagttgcacaggtgggtggggggttggggagtctgtggcagcatcaaaagagtagcccagaaaccgccgagtccactgttcgagcctcccgggcctgcagcccgcaccccagaggggccacttcctccccacagtcaggcctgtgtgtcctctcaacgtggcaagccggcatgtgggtgctacaggtccccagtgtgacactcagtagccttgctgaaggccgagggtgccccttaggtgggttgtgggcagcctctgctggagagggagctgcgtttcttgaccgcaggcagagtgggctgggtctgcagtttctgagctgagcatggggtgccctctgctggtgatggcgagaagctcactgcctttgtatggagaaggctgccatccagccccgccactgccccagaaggaaggcgcctgagacccctcctccttggccgggaggccctttgctgtgtccctgccaagaggacctactgcagtccttcccgaaggacctcagtgtcctgggaccctacccagatctggtccccactgcagacccagcagtttgggttacccggcttcagcgctccagctctacatgatgtttctccaggtgcacatgctgtttcttgcttcccgtgggtgccgtcaccaggcagccgtctgccctcggcaggcggggtgtgggtgagtgccgatgagtcatggccttggcacgccggcagccttcctacccttccacttatgggcaccagcagcccctgcgtaattcattggttccccttcgcaagagccggctgcctgtcgtgagccaagctgcttatgatggtgacatgaagcctccacctctgagagtgtcggaggactggcccaggctgttcttgcaaatggggagctctgttgcctccggccccagaatgggggaaaagttcagagagaccgaggctccccgagaagaacctcaggctgcaggtgacagcagggcaaggtgcctggtctggccccaggaccagcctggctccctgagagcacaaggcctcatcacttctcgagatgaggacaggtgcaccgcctgcggggagacactgggttttcacactctctgttgtatgtgcctcccctgccaacccttctgactctcagtgcagggcgggcgtcgtcctccctgtgagccttccctgagaccaggtgggctgggtgcccactaaacacttggcctctctgccacgaggttgtggactcctgagggtagaggcctgtgaatgttacccctctctttctgcgctgcctgggacagagggtggacctccctgaagctctgttttctcattaaggacctgcctacagcctgttgtggggattgggtcaaataattcaggcgatgtgctcgtgcagtgcgctggtcccagcgtggggaaggcttgctgcgacagcctctcctcctgtccctgtaccctcggcacagcgcccaaccctgtgaggtaccaggcatgggtgacttacctagacatgcccattcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgccttcagaaccaggcccaacccttgctgtgacctcgagggctgccacttttcagagtgcactgggcctgtctccacccatagaccatactgccacatctgtacctcgggcaccaatctctccccaccacaggggcctgtgcctgagatggtccctctacagaaatacctgctcctggcatggctggcttcttgccaattctggatctccagctgccaccccagagaggcactggcttccctgtttaaagagggtccccccatcacccatcttcacagcagactgtttgcttggctgtgtgccccttcagacccacacccattacctccccctctcccccatcctcccaccctcttccaaaggctgaacacacaggagggattgggaaatttgttgaacaaagaagttacacataagccctgatgtgttagcaggacagtgagatgaacaaaacgttctggaaagtgggtgtgagggtcagatgtggagggagtgaaatcttcccagggagagaatgtctctgggtcaacctgctcctgctgggctgggagggccgaacaccccccacccatcaccccaggctggccctgaccccagccttccctgtgcctgcagcaccggcagctgctgaaggacagcttcatggtggagctggtggagggggcccgcaagctgcgccacgtcttcctgttcaccgacctgcttctctgcaccaagctcaagaagcagagcggagggtgagtgacgatgtggcccctgtcccagcagtgaccccaccctgactctccaggtcatggagggtcttgtcatggcggaggtcagtggtgatgtagctcgttacattccgtttctacttgggcacaatgccaggctccaggttaaagattgtcactagcaatctggagacgtcatggggcatcagggtgaccagctttgactcctgtagtgaggggtaaacccgaccgtggcttccggcactattgcagaaaggtcacctcaggacccatccgggaagcgtgagatcaggggctgcaggcagtgctgggtggtggctgctccttgtctccccgagcctggtggtggctttccgagttatcctcggcataggcgtgcacacactcccctcctccctcctccctgggttcacccaggttgcaccaggttggaatggagcaaagagggccacactgggaaggaccagcacggggctctttcctgcatcctgccgttgccctgctgagtgggtttaatcagtcaactcagaggagagccttagttcccccatctgtcaggcgaggggatgacgccagctagatctgtagtccctcaaactttacggccctgggggtggatttcagtcctgtcctgtcattgtgcagccttgatgtgctcccacatgagccttcaaccttagagccagctcaggacaaggtggatctagactcctgagatgcctggggcctgcggtcacatgttcagagtgtctgttcccaggaatcctggcacctgccagtggcctcatcccagtctgtcccatggaacacgtgctgggttttaggtcaggtaaaccatgtatggccgagaacactggctcttgggctcttgacagcagtgacatcagccatagaaggcagtcggtgcatgtgaacgttcttctctccccatccccagcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaaggtgcacaccaggggagcaagggccgggtttggtgtggtcagagtggcagcagcccccgcacacggccagtgggtgctttctccgtcaggcctctgggccccaggtctggtctctgggacccctgtaagctctcagctcttggagggctgggcatctgggcacaactaggtgtccagttgttctgagaacccccagctaaatggggagcaccataccagagcggctgccaacccaaccctccagaaaaatgaagggaactggtcgtggtctctacagtgcgcctttcacgggatacttcttagacctggtggactgcctcatgcttagttgtctgacctgtgaccaggggtccctcacgagagaaacttgtttaaactgtgtccagtttatgcccacctgaccattgctgtggcactgggagcctgattttgtgttttcactggcatccccggggaaaacttaacctaggcaaacacctcctagtttttcggaaacacagcaccacaataggaaacaagttcagagattttacctacaggttttggacaaggaggtgccatgagtagggagggcagtcttctgtccctgggtcatgcaaggcagaaatgaagagttagcgcatgacagctagcagtatttataagggaacagggtgtgatcactttaagttcacaggcaaatgcctggatggtccttttaaggaagcagcaggaatgcgggagctcagtcagccgggcgggagagaggcttccgggttctcacctctggccacgggcttgagctgttcaagtgtgtggtctcctgatacccaggctgcgtcctttgccgtgtggttccattacatgggtgaagtactgagtcaccagagagaaagtcacagccagacagtggagggcttggagtagtccaggatgcagggttgggggaggtgctggctgtcccccatacaagctaccctgatgggggccaggcccaggtggcagtgccacccctctaggtgttcaggactacctgcccttggttttttccagagatgtttgaagactgtaaaaatggtgaggacaagcccctcaatcaaaggttagccaggccagaggaggcgggtggcatcaaggttaggcctgggtccaggtatgcccaggtagggtggacgcagcaggacaggaggtcctcagcccttgcccagctgcccagcctgctgtacccaaacccagcacacttaggaacacagggagcttcaagactggggtgaacattctattgtcatccttgtgggactgtgacctccagggtagggtgtccccacacagagtgggagccagtgctcagggcagctgagccctattgactgttactgttgcattctccatgttcagctctttgggggatgggatggggtggggccctacctggtgacaggcagcacagttttctcctccccagggatagtggcttctagagtgaaacccatggctcagcataggaagggccttcccatccaggttctgttgacggtcgtctggtcttctgctggcatctccacaaacatgcccaggggcccgatgctgaaacctagttggattaggaagagggtgagggaccctgtaggtcacagcagcctcctggacattgtctgaatttgggaaaatgaaaggcagggatgttggtaaaagtttcttctctccgcccttgtgagaggaaagacttaattcctccaaaaaaggtttactgagcatgtcctgcagcttatgccatgccttgaccctgtaaaaaagctgtttctgtcctccagaggccaccagcaactgcggtctggggccctggtctgtgctgagtggagagatgggattcttgccctctgcaggctgaatgcagctggtggtggggatggatggaatgggagtgggttgtgtggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctgctgttccggcccctcctgctctcctggcctgggatgggctcctggttgcctaatggcagtgcgttttcacttggatgcgccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatgtctgtcaatgtccagaatggcttgttttctagcctgaccaggagaggcagctggtgggctctgcagaagcctcacctctgggctagtgtggggcttgtgaattgaatgcaggaggtcaggtctggatcaacgttcacctctgcagatcccacctggttacctccatgtccctaagctgtgcccctctgccagcatcacaccctgacccatgtagttcgggtgagagatggtgtgccagaggtgctgtggcacccagctggcaggaagggtagggagtgccggaagcgacatgccaggccgtgagcacacctggccactgggctccagccggctggagatacgagttgtgtgctctaaggtgccccgggcctaccaggcatttgcgtagccagggcggagataactgggtgtgttcttcttgcccaccctagagttacacgttcctgatctcctctgactatgagcgtgcagagtggagggagaacatccgggagcagcagaagaagtgtgagtatcctctgtcctgagaggggctgggcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatcccccttccccaggccctttccagattccacacctgcccctacacacacccctgccatctccccctagtctgctgcccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctcaggggcgctccctcctgtctggggcagccccttccttctctgggcacttccctctgtcagggcgctccttccttcgggtcctgcctggcagtgtcggtggggaaggcagacccggttccctccttggaggtttgggattcaccctgagctggggctctgcatgcctctggcctggcctgacctcccgcgccctcaggctcatcattctcacctatgcagagccacctctcggcccccaatgccaccgtggcctgggggatcaaggatctccgggcagccctgccagtgcttgtgtcccagggtttcctgtcataacataggagccccagccatttccagagtggcagcctctgttccctgttcagcattatgcccagaaataagccccttttcctcacctggtggagaaacgggggcctgtgttagcagaggacgggcagagccatgctgctgtctgtatggggagacctcacagggaggtgctcccagtccagccactcattctcagacctgccttgtggctgtgcttaggtagcgtgggatgtgtgtgtttgtaagtctcatgctaagactcctccaggcctgggctctccagggccacacctcactctgccgccagaccagcactgcacttgagagccaagtgccctctcctgagcccccaagccctggcaccagttcttgccgtgccccttccccagggtgtgtggtggaggtccagtgggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaataaggaaggtgggcccccccgtttccgtgtacagggcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccagccctcctctcctccagctacctgccagccggcacttttggtcaagctgttttgcattcactgttgcacatatgctcagtcacacacacagcatacgctatgcacatgtgtccacacacaccccacccacatcccacatcaccccgaccccctctgctgtccttggaaccttattacacttcgagtcactggtttgcctgtattgtgaaaccaactggatcctgagatccccaagacagaaatcatgatgagtatgtttttggcccatgacactggcttaccttgtgccaggcagatggcagccacacagtgtccaccggatggttgattttgaagcagagttagcttgtcacctgcctccctttcccgggacaacagaagctgacctctttgatctcttgcgcagatgatgagtctccggggctctatgggtttctgaatgtcatcgtccactcagccactggatttaagcagagttcaagtaagtactggtttggggaggagggttgcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtggggtccaagccaggagggctgtcagcagtgcaccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtctactaaaaatacaaagattagccgggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggttgggagagaggactaactgcagatgaacccaagggggactttttaggtgagagcagtgtcgtgaaaagactgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccgtgcactcaaccttgcatccccaaaccaaacctattattcatggaccccaaacttgttcctcttatgtcctgtccctttgaggggcaccaccatccacccgcatggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaaaatgcaaaccccaccctgcaacttaccgcccacagcccagcccactcttctccaggcctcgcctccctcccttccccctgcaccccacgacttctccagcactgagctgcttcctgtgccccacagtggcctggagtcccctttgccttaactctttgccccatagtacagcggggtctgctctgattgtaggggcttcccacatcccccaggatggctgccctctgctgtggcatcactgtgtaacaatggcgtgtacacctctctgtccccaccagtgcagggcccttctcatcgtaggggctttagctggggtttgtggatcgactgagtgaacgaatgttgtgggaagtcccgtttcccagccgcacccagggaaattccacagagcgggcaggggcatcgcatgaggtgctggtgttcacgccagaccacaattaggtgtttaatttttaaaaagaaagttacaaccttttttttttatttttattttttctgattctgcaaataacacctgctcttacagaccatgtgggtgatgtggaaaagacctgtgaccttctccatgtccacttctccccacagatctgtactgcaccctggaggtggattcctttgggtattttgtgaataaagcaaagacgcgcgtctacagggacacagctgagccaaactggaacgaggtgaggaactgattccacaagggcccagcctgccaggtggggcacaggatattttccactggagataatctaaaccttcaggggctccctgagggcttcccccgaaggcagtgctgctgaattccaggaatctcctggggggccagtaggtgacgtgtccaagagattttatctccttgttcctgaaaaccttacccatccctgtcatcacaaagaagccacctattttgctggagaagtgtttggaaagagacttaaaaaggctttttgtctgcctttgttagcgcttatgtttacttggtaggtttccatagtgtttttccgcagaagttggaatgagctcccgtgaccctcttggcttccggaagcctggggctctgctggtggggctgggacagggactgtagggtcctgcttgcttgtctcggggtgttgggtttgtattgtgtgtcgccgtgccttcctccaccttggagagctgctgtgtgagtcacttagccatttggccctgcaccttcgggagtaggggaatgattgcagagaggcccgtattgactaagtcccagatccatgagaggtgccatttcccagcttctgcagcagctgtgacctcgaaggtctcattcttgatgctgcaggtagaggccagctgggcctgcagagagctgcctcccacccctgctcctgcgaaggaggaagccaagagcccccaggctgcttggtctacacgggtcacgaggctggtggatggagcagtggggctggaacccaggtctcctttctcagcatccactactctttgatcattttagacatgttgcttgaatagtacaagggcacaaggagctcagtaaaataacctggtcattgtagctctggacatccctgcagaaagggctgagtggcagctgtgatgagagggggtataagagccacaggggatccatcgaagaagcctttgcagagaccaagagtgccacgacccagcagagacaacaagagagggtgccaggcagtgtgcaaaaggttcaggtgccaggcagccacggaagctccggggaggcatgaagacatgagggttagattgtagcaggtcacctccaccaccctcactgtccatgaagatctggacttggggacactcacatgttcctggcgcacccacacacccaccccctcccctattcaggttcagaaattcctgctgcttgcttcttcccgcaccctcctccatttccccgccaagaagccatgcgcgcacacgcctcggtgtgaagcgcagattcaccaacagcaccgtcagggtgatggaggagagagttaacaccacgcacccacggcagacaactggagagctcggggagcagtttttcctccaagtccctctccctcctgtatcaaccccaaggatcactcttttgtttccttttagatataattcattttttaaagagcggttttaggtttgcagcaaaatggagcagaaagaacagagttcccatgtacctcctgccccccatctcaattatggacatcccactccagggtgggacatgagttacagttgatgagcctgcattaacccatcattaccacccagagttcatagttgatgttaggtagggttcattcttggtgttacacatgttatgtgttctgacaaacgtggaatgacgtgtatccaccataataatatcttacagaatagtctcaccgccataaaagtgaacctgcatcgacagatcattatctttcagagtccatagaaatatctttttttgagggagagtctcacactgttggccagcctggaatgcagtggcatgatcttggcttactgcagcctccgcctcccggattcaagcaattctcgtgcctcagccttacaagtagctgggatcacaggcatgcaccaccacgccatactatttttcgtatttttagtaggatggggtttcgccatgttggctagttagtctcgtactcctggtctcaagtgatctgcccaccttggcctcccaaagtactgggattacaggtgtgagccaccgtgcccagcccatagaaatatcttaacaagtaccctggcgattgtgaggcaggtggtgtggggatcaccctttgagatgctggtgtaaggagtttggattaagtttgaaaggcagtcggagcttctggaagcatccgggctgggccacggtctcatgccaggggtgcttacaaggaatacttccatgtgtcccaggactaagggaggagggtctcaggcattggtccctctgggccagcaagggcagcagggagagccccggttcagaggacccttcagccataacattgacccgtttgttcacactggacttcccttctcccttggggctgcaggaatttgagatagagctggagggctcccagaccctgaggatactgtgctatgaaaagtgttacaacaagacgaagatccccaaggaggacggcgagagcacggacagactcatggggaagggccaggtccaggtgaggcagccatccctaccctcccctgcccgatgcatggcgtcctttttcatgcagcccctggggacactgagatggtcatggccttgcacccagggtggggtggggtgggcagctgtggctctgaaacatccatcgtgggagacctgagccggtgcctgcatgtatcttgatgggtcttgacgtaccaccctctgtctgcgtgtctgttgcgtcggctcattcccaaaggaatttccattcaacttggttttgcagctggggcctcagttcctgcccggccttaggagaacccaaggtggaacagttagatggtgtcctaggctgaaattggcccatcctgtgccagtcttcttagaaaagcacaggggtcccagaggctgcctgcaagcacaggggtcccagaggctgcctgcttggcatcccctatctgtggtctagacccaatttctagggtatagagctgtatctctgaacagggtgcacacagacaggtctcctcccaggctaatctggaagcccccaggtgagaccgagaatgtgtccatacaggaccagcaagggggccctggttcttaaggagactgcctgggccctctgtccttcagaagcttgtctagcccctgggagcacgccaccagggtttcctggaggatcatagctggcgccccaggccctgtttatcctgttcccaccctcacaattgcgcgggggtagctgagaggaagccctgatcgtgctttccttatagtgcattatatcagtgggttgtgggtacagctctctcttcccaggaccttccatcttcacaagaggcctctagagggagtgggtttggctttccacatgcccctagaagcacagggctcctcaggaagcccagtctccctccctaagcaggaagtaaaaatcctcttgtggttaaataccaagtgccaggctgggcgtggtggctcacgcctgtaatcccagcactttgggaggccgaggtgggcggatcacgaggtcaggagatcgagaccatcctggctaacaccgtgaaaccccgtctctactaaaaatacaaaaaattagccaggcgtggtggcgggtgcctgtagtcccagctactcgggaggccgaggcaggagaatggcatgaacctgggaggcggagcttgcaatgagtcaagatcacaccgctgatctctagcctgggtgacagagcgagagtccgtctcaaaaaaaaaaaaaaaaaaaaaaataccaagtgccaggaagaatgaagggagagggtggctcttccctgagtcacctgtcatctttgctgatggatcccacattctcattcagatcagcaaatctttaccaagtgctggcctcacccccttctgccaccctggcctggctggccacatcttcggaggtgcagctactgcctgtttttctaccttggaagcttataagggaactcagtggctcagagcctcctggggctccctatactttgagatcaggtttaaaagcaaaaagactcctctggcacatgcctgtattccagctactcaggacgctgaagcgagaggattgcttgagcccagctattcaagaccagcctgggcaacatagacccctgtctaaaacaaaataaattaactaaaaattgctctcagctctcctgtcgctgtcccactgcactgtcttgttcactctgccagcctttgtgtggattctcatggtgggagattgtaccacacagatgggccacaccactcttgatggagtacttagtgctggtctcctttgagatccgaagtattttagcatcagtcaaatgacggtcatagtttgggtgatggtcacggctcaggttcttttttacacgtgcttgctttggttgttgttgttgttctttgttttcttgaggcagtatctggctgtgtctcccaggctggcgtgcaatggcaggatcatagctcactgcaacctcaaactcctggctgaagcaatctttgtgccctagcctcccaagttgttgggattacagtcgtgccccaccatgcctggctaagttgttttttgttttttgttttttttttttttttcgagacagagttttgctcttgttgcccaggccggagtgcagtggtgtgatcttggctctctgcaacctcccgggttcaagcgattctcctgcctcagcctcccaaagtgatgggattacaggcctgagccactgtgcctggccacatgtgctttcccattcggtccttgcagcagatctttgagagagctcatttgacactcaggagatgcttctctaacctgctcagaatcagggccctgggtattcagggaggtagagggagcagactgcaaagccagtcgtgctcccatcgctcccacttctctctccctctccatgttttctgtctcccccacccagcctagggcattcctcccccacagtccagcctgcatctggcacagtgtcactgctcagcccagggatactcacagcctgggtgcctggctccttttttcagctcatcaaaccaggtaaagggaggttcagattctgccaaccattgactcaattcatccaaatcttcaatcactggaatcctgggagtggctggatttgaaccaggacctctgagtactattgctaagtaactgggggtctcagtgaaagagagaaaagagctgataggcctcttcctgtgttatcatgtcaggccatcttttgaaactcttttctgcaatgctactgaagtatttatgcacgtgacctgtgctcttctgtcagtctaggggtgctggctgagcaccccaccccatcccggggaagaggagagcagtaagtgtcgaagaaaaacccgagctggacagcagttaaagtggtaaaagcaggttttgtttagtaactattgtgatagggaaaagactagaaatggaaggcctagaaatgggctcaatgctgaagtcacttggatgagtggggacttgcagccaagaagcagggtaggggttgatggatggaaaatgatgaagtaacatcagggggaagagggattctggtgaaaccgacccgacaggattcttgctgaagacaggccaaagtgatcgatctcccccgggggatggcgtggggtgaggaatctgatcagatagcaagggcagggggttctggctaaacggacttagcaggattcttgcaaaatttgggctcctgagaacatgcccaaggatgggatctagctggaataaaaagctggagggaccagatgagttccgtcaaggagagtctttgtcactcccccaccacactcagtgtgacctgggtgaattactgtcccactggcccaaatgtgtttcctcacttttccttcccttccttccttcccttccttcccttccttccttttctttctttcttcctttcctttttcctttttcctttccttttgcctttccttcttcttcggagtctcactgtcttgcccaggctggagtgcagcggtgccatctcagcttactgcaacctctgcctcccgggttcaagcgattctgctgccgcagcctcctgaatagctgttattacaggcatgtgccaccacgcctggctaatttttttgtatttttagtagagacggggtttcaccatgttggccaggctggtctcgaactcctgacctccagtggtccacccgccttggcctcccaaagtgctgggattataggcgtgagctactgcacccagcctcctcacctttaaatcttccccaaatatttgttcaaaacaaacatcactcattttgtgttcctgctgcaacagaccccctggggcctgcccctctccaaggctgttttttgttttttgagacagagtctggctctgtcgcccaggctggagtgcagtggcatgatctcggctcactgcaagctccgcctcctgggttcacgccattctcctgcctcagcctcccgagtagccgggactacaggcgcccgccaccacacccagctaatttcttgtatttttagtagagatggggtttcaccgtggtctcgatctcctgacctcatgatccgccctcctcagcctcccaaagtgctgggattacaggcgtgagccaccacgcctagctccaagactgtttaggggctacgtaagtttctctcctatgggcgcctctgccacatggaccatgtctcattcgtctcggaatgccccccaggcacatcacagacccccctgcacgggtgaatggctgtgtggacgagacctacatggccctgagataatccttgaaatacaaatgaggattctcgatgccttcgtggccttacctgaccatacctcccccaactcccatcacgtcccccgtgacgtgatctttattttggcttatgtttgtctctgctgctggaaagtaaacgtggaggacagggctttgtccagttcattctctgtggtatctccagtatccagacagagacataaaacatacatctgtatctgtaagttatttaatacattgtttaatggatctagagtttatatatatatatagtaaaatatatattggcacaaagcaagtactgttacatgcactggaaattgctgagccaggcacctgccctctcacagatgaaggtgctgaagttcccaggggtggctggggcgggagccagccaagcctggggcttctccaccacgctgtgcatgtgcccagtggtggtcggggccttcatggtgagggggtcggggagttcagagtttggactcccacgtgcatccctgcaccatgggcagcctttttatcttagccagaaggctgagaagtaattccttcctttttaaaaaaattgtaaaataagcacaatgtaaaatgtcccaggtgtttttaagtgtgcagttcagtggcatcaggcacattcacattgttgtgcagccatcaccaccatcatctccagaacttttttttcatcctctcaaactgaaactctacacccattaaacaataactcccaggggggcaggtgcaaaaagaataactccccattcctcctgcccccagctcctgttaacctctagtccactttctgcctctgtggatttgcctactctagctacctcatgtaagtggaatcatacagcatttgtcttttgggtctggtttatttcacttagcagcatgtcctcaaggctcacccatgttgtagaatgtgtcagaatgtccttcctcttgaaggctgagtaatattccattgtatggattaacagacattcaccagcaggtggacgcctgggttctttccagtctgaggctggcatggtcagtgctgttgtgcacatggacataagatccacccaacttggtgttatctttgcattcgcaagctgttgccaggcacatccatgggctctcggggggaacagctgctgcagagtgggcagtccaacagggagaccgcccgaaaatgggtggacctcactgcgtggtggggacttgagagcagctgccagggtgccaccaggagggccccagtcagacctgctggcttgtacctggtcaggtgcccacataacccaggctggcagagaagtctgggaaactccagccagccagccagagcaccagcttcaaatgaagcagaggctcacagtccaaatctcatccccgaggctcacataaaacattggcaacaacaaaaatgaactctgatgcccccactggaacatgagttgtgagcccagcaagacacataaatagagcaggagaaatgggagaagacaaaagtctatgacttgatagaatgttgccctctaaggagaatagacagggctaacatgatttagcaacctagaaaatttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggaagccaaggtaggagaattgcttgaaccagggaggcagggatttcagtgagccagggtcgtgccactgcactccagcctgggggacagagcgagactatctcaaaaaagacagaaaaaacctgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtcccatgaatcttggatggatgttgatgccttcaccttgaaaaatccctccctgaagatacagattcaatgtcccctgctctgtgaaggcttctctgtcccgtgacctcacttcccaagtaaccgtgccatctgagccaccagtcaatctgggccaaagcctgccctggctcttggcacatttgccacatccttcctttccagcttctctgatctagaccatgaaggctggggagaggggtcttcttgttcttggggacccccccgccaggcatggcacacaggaagccttccatgactagggtggcacagcgggttcctggtgtctgaggatggaccaggatggcctcgctcactcaaatggctcattcaggctcggggctggcttggaagggacacccgacttgggtcctcttgcacctgcccacacacaaggacttcaatttgtgctgtcagtggctcttttctggactgtgggcaccaccacagctttgtccctgctgtactgtgtatccccttgcctttctggcttgtggctctgaacaaagcaggtcacccatcccaatttctagagcccccccaccgccacccccaccctcatggagcctctatcgtgcaagaagggaggtggggacctggcaagtcatccaggacaggcatttgaagagcaggagccaaaatctgagactcgggcaagtggttcctaaacccagctcatcagcaccattaaggggagcaaaaaaccagaccgggccaagcccccagcccagaagatcccgactcctgctgcccacagacaggcacatgagcagctttgctgaggactcctttccatcccagacccctgcccttggggcctgccagggacctctgccctcatggttggatctggacactcccgggatgctgcggcttctctacctgctgcaactgcctcacctcacgggagggtctctctacgcaacttctgagtcgaggtgcataagcagtgtgggggctgtaggcccctgtagctggctgcagagagccaagcgcctcccacacggtacagcacagaaggctcctggtgtcactgggaaaagcccagattcaaaaaggctgggctccggagtcatgcacatcctctctcaggtatccctgtgcagaaaacagtgtccacgggggagaaagaggccaggctggtgtcgcagagcgccaatggcatagtcaccaccactcctccgacttacttcctcctgggatcccacaaacaagccccccagctgggagcctggacctccagggaccagggcagccgccacctacttggcgtgagtcatgaatgcccttcacacagcaatcagattccttcctgtctagccatggttcccacccatcactcccactgacacagggaccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacagagaatgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaataggagagaaacttatgtatgtagcctcttaaacagacttggagaggggcaggccccagggggtctcttgcagcaggaacacaaaatgagtgatgtttgttttgaaccaatatttggggaagatatgaagatgtaaacatcatgaaaatgtaagatcacatgagcaaattcttacacagattccacgggattcttcttgaagcacaccgccatcaacatggatagtgatacaggtcctccttgctctattgagagccacttttggaccctttatttttaacttttgtaccatgaaatgcatccatttttataaccgaatgattttatagtaaatttacagagctgtacaacttttaccaacaatccagttttagaatatttctatcaccccaatttccttgttgccttttttttttttttttttttttaagacagggtcttgctctgttgcccaggttggagtacagtggtgcaaccacactcagcacaaccttgatgtcccaggctcaagtgctcttcctaccttagcctctcaagtagctgggaccacaggcatgcgccaccatgccaggctattttttttttttttttttttttttgagacaaggtcttgttttgctgcccaagctggtctcaaattcctaggctcaagtgatcctcctgccttggcctcccaaagtgctgagattacaggtgtgaaccaccgtgcccagcccctgttcccagttatagccactcccagacccaagccgatctgctttttgtctttagagatttgcccattcttcacatttcataaacgtggaatcatactagagtgggcttttttgactgatttcctccacttaccattatgtttttgaggtttattcatgtggtagcattgtttggttcctttttatgataataattttccattgcatacatataacatgtttttatttctgcatttactatttgacagacacttggatcatttctagtttgggctgttaaggttgatgcagccacgaacatgtccttggtaccagtctctatatggacgtatgttttcattcactgagtaaacacctagtaagattgctgggctgtgcaacaaggtgactatttggggaactgccctacgttgtctggagtagctgcaccatcttacatccccagtggccatgtatgaaagcccatttctctacatcctcaccgatgctggttatagtgtatcctaagggagaagggtgtgttccttttgaagtgatgttagagactggttgggatcagagaagagaagcaaagagttaaaagtgggatagaggccaggcgcggtggcttacgcctgtaatcccagcactttaggaggccaagttgggtggattgctttaggtcaggagttcaagaccagcctgaccaacatggtgaaacctcgtctctactaaaaatacaaaaattaaccgggcatggtggcaggtgcctgtaatcccagctcctcaggggctgaggcaagagaatggtttgaagccaggaggcagaggttgcagtcagccgagatctcgccactgcactccagcctgggcaacagagtgagactccgccttaaaaaaaaaaaaaaaaaggtgcaggatggatctcaggagagcagattgtggtcatagactacagcaggaggcctgtaatctctctcctggtgaacacagaggttctctggtggtctcagcaaagacccacccccgggagtaggttatagtgcagacacatggggcccagacaggaacaactggggttgccctgctggaccatccaggctggtgacgatgggcgtgaaggaagctgttgtctacaaggagctaagtgaacaagcatttcctcctttggaaggtttactcatagccccctccctgcccctgctgagggtgggtgagaggatgtcctccggctgcccattggtgactcaatccagccacactgactacaaagcaagcagggcagtgctgggcccccagcagagccaccatgcaaagtggtcagtgatgcttcagggcagcacacagcacctgccccagttgggcttcggcctccctcagcccccaccccaccacttccctgggatggatgtgcacgatagttttctaggcagacctctaggccaccatctgccaggcccgctgaccatagtcattctttcaaggctcctgccttacccagtccagggggagaggagcagcaacctggtccatcctcctgagaccactgcatgtgagcagacagacccctgcctgcccagtccccggccaggcagcaggcatgttcctcaccaagaccttgcaacccagggggaccctggacagcatccggagtgcctcggtttttcccttaagggaaaactgtttcccccttggtcatctgtttttccaaaccccagtcttttgcttgtttacttctctggtgctttaaataactgcacgagagagcgtaccagccttgagcaatgtttgggattggctgagctgaggcacaggcctcattatcatgctattctttatacggcttccgctctgcggcgcacactctgttctttggaacagagccagccttgggacagcctttcccactggagctgccagtcaggaccgccgtgagagccagtgcctggaggccaacaccctggtcttcagtcactgggagtcacagagaggggcccgataaagagccctcctggcagcatcagtaccaggttggagtgggcgctggacaccaccaatgctggggagtggacgctggctggagccccacccagggctgcacattgctcagccagctagctctgggggagcaggacctgagcagggtgtcctccaccctgggtccatcagaggcactgcatttgattattggggttacctgctgggagtggtgcagattctggacagtctggattgcttccagcacaaggcaggctgaccagtcatactttactcagtctccaaacttgggcaacaggaaactagccacttgagaaggaagctcagcttttctgggctttagaggagatggagacacgttggaaattcccgtaaccaataggctggggtgggagggtgttcttcccacacacagacaaaaaagtggaacccggaggtgatgggaagctttgaccttggccagccagactgcggggtggggtttccctcaaagcctggtcaaaaggccttggaggctggaagctctcgtttagccccaccagcttcccagagcagcaaggccaagcatgcaagagtcaccatccaccctggccatgatgcagggcctcctttggtacttccaccccagccgggcgggccggagccgggcggcctctgctgaaaagcacctgtgggccgtggttccaggggggctttgaggggcagccgctgatgtctggacagcttctctttctgtctcttcttacctggactctgggttgcttgttagctgcttctgcctgttctgggttttcaaggggagaggggcccagtgatggctgttctttgaaggaaaggtaagaatgtctcctgcttaacatgtttctgtgtttccagttacttggttggttagtagagccagggtctctcgctttgttgcgcaggctggagtgcaatggcatgatcatggctcacagcagtctccaccttctagcctcaagtgttgcccccacctcagcctcccgagcagttgggactgcaggcacatgccaccatgcttggctaatgcttttgaaaattttttttttatagagacagggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccgcatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtagggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgtaaatcccaggtcccactcagattatgagtcagttctctgcaggtggaacccagggaggtgttttttttgtttttgcttttatttttgagacgaagtcttgctgtgtcgcccaggctggagtgcagtggcgccatcttggctcactgcaacctccacctcctgagttcacaccattctcctgcctcagcctcccaagtagctgggactacagacgcccaccaccacgcccagctaatttgttgtatttttagtagggacagggtttcaccatgttagccaggatggtctcaacctcccgacctcgtgatccgcccacctcagcctctcaaagtgctgggattacaggcgtgagccaccgcacctggccagggaggtgtatttttaacaagatggtactgctcattcacccagcccagccagtgatcttggcatacccaggaaccgctgacatagaacgtgctccccataaaacgggagacagaggcttcacggatgggggacatgtggcttggtcatgacagggtgttacataccaggacagactgtgttcgggtgacattaaggacaagctcctgcaggctagctgtctggatagtgccgggtgggggtagaagttagaggggtcacagaggggcttcctcccggccccctcatcagctgcttgatttagggcttgtttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcacctttcactgagctccacatagcacccgtggtgatggaagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcggcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccgcaggccctgcaggacagagactggcagcgcaccgtcatcgccatgaatggggtacgtgtccgtgggactctcctggtgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttagaccttaaaagcaatgacacacccaaaaaggcccgggtataaatggtaaaatgttaatatttgagattcttggctttttcttacattattctgtctttcctacttaatttttaattgttactaagaaagagaaagccaggcacagtgcacctatagtctcagctactctggagtctgaggcaggagaatcactggaacccaagagttcgattacagcctgggcaacattgcaagctcctatatctaaaaaaaagcaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccctactgtagatcgaagtaaagctctcggtcaagttcaacagcagggagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccacctggcttggaagcagtaggctggctccaggaactgcccaagtgcagggttttctgcccttgcttggaatttatcacggtcccagattcctgttgaatggccgtaacccctgcccctttgtcacgagtcagttgccaagagaagcctgtttggtttgagagcagttcatgcagacatagaccacttcctctgagaattcatttgcttccccaggatggaatctggctgggcctctgaccttgctggtcacgtgggccggggcctccatcagtcataccctggactcctatctgtgtctaaacaccacgccccacccccaactgcacggcagccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagccgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcagatagggagcaggtctcctgtgttatggcccaagcagggctgttaggacactgagaacattccctcctcccgcaggagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcagtgagtgttggcctgcgcaggacgggatggaggtgtgggcaatggtgtccgcgatgagatctcagagtgctccatggcccaggcatgtcacatccttctctgtgtcttttcttcatttactgtgttattatttttaaaaaagagaagacaagagttgtagaaaaagcctctgtagaaaccagtttttaaaccatcctagccatgcatgccacttgctggggtaggccaggggtttctgcagggccttggccttcctgccttggggttggacaggaggtggaagcccaggactcagtgcagtctgtcccctgccatgtgtgaggatgcggcaggcagagggcactgatgaaattcagcccaggctggggctgcagcatctctgcctccatctcaccaaccctcacaggctatgaaggacctggaactgtcacaaatgccaggggagggcactgagaccccagagggtccctcccagcatcttcaacaggattttgtgcctgcagacccttctttggggcacacaccaccaaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccacgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagcatggcagggacggtgctttagccaaggcagggatggtgggtgactcactcaggatcttcaaggaggccgctgcatttccgtgctctttccagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcggtgagcactggaggccttggcctcatgggagacgtctcctccacgtgcactgctgcccttggaggctgtgaaaagtgaggtgtgggaacccaagctgtgccccctctgccatggtcggcattttaacccaacctcaaaaagcaggggaccagaaccgagcctgtcctggaaggccttgcccatccctagagggctccctgtccctactcctcaaggagaccaagaggctgaaatagtcagcactgctgtgctgtggggtcctaaagtctgctgtcctccttcctgcagaccagggctgaaggagggtgcctgggtgctcttgccatgggtcctggtccagccaagcatggtttcaaacatgacctgacccttagtcaacctggaggctgatgtctagagtgggtgctggtgtgtgcagtacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgttcctcactcccctgtttcattccatgctgagcctcccctgccttgggctcctctggggagggggtggtggcaggagttgtccaagggcagctctgcccatgagcagctgctctagcggctcctcctgctgctgtttgccgggtgctgctgacccctgcgaggtagagaaaaggcgttcaggtggttcacaccccacacaggtgcccctcacagggtcctcaatgggggccagagctgtgagactgaggatgatgacgagcctgggctgtgcagggacacaagccccaggtgctccatgtgaacacctcgggagaggtctctggctcgttgtgaccccaaggagtaacccaccgccttctgcagctctttcagacccggttgcaaaggagagctgcatgctcaacctgctgctgtccctgccggaggccaacctgctcaccttccttttccttctggaccacctgaaaaggtagcccagctctcccatggcagcccagggctccaggtccccaggccgcagagtgcccctctgctcccactagacccccaacaccgaggaccttttctcctgacccttgtctgcagtcactcactgcctttggcgactagtgccactgccacccctgccccagcctctcttctttgccaccctcctctctctgcactgtggccttaaaaaagagctcagagctttggccgtggccagcagtgcacttggacccccctcttccctccgagtcacatcaagtaggagacctccccaccagcccagagctggctccttgtcctgggccactgagacccagaagtaccagggctggagtcagcttgcagcacagccagggtcgaggtcactcccttcctgagaactccagcacagcccagcccctctgcctctctcctgggggtggcgttgaaacagcacccgctgctttggtcctctacagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtatgggaagacaggctccagcccatgcaaccctgacctgacagaggtggcctctgcctgccccacccccagtcctgcccatcttcttacttgcattgtatgtggtgtggccaacattcacagagagggacttgcctaggtctgcatggatgggagtgatagtgggggcccaggccacctcctggtcctgctagtgcactttgctggaagcttaaaactacctcaagtgttcgggtgtggtggctcatgcctgtaatcccagcactttgggaggccaaggcaggataaccaatcccaggtgtttgaaaccagtctgggcaatgtggcaaaccccatctctagaaaaaataaaaagaaaaattagccaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtccccagcacctgagatggacttggaggcttgggccccaaagacctcccaccagcagctgtgagccccgctctgagccactcttctcttccctactctgcccgggcaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttcttctttttctttccagaaggatttttgtgcagaaatgggtcttttgttgccgtgttagtcctccttggaaggcagctcagaaggcccgtgaaatgtcgggggacaggacccccagggagggaaccccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttttaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaacatggcatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgaagcaacgaaacaacccatgaaccatcccgggtgaaagagacgtccgccggatcggtgcgaccacaagcagccaagcggttggcgctaaagcatgctacacagtcttcgctaattatgcctaggtatacactgttactagcacataacctcggcccctctctcatgtgctatgaatcggacggtccatggtacaataagtggggtcggactggatttataaacggaactttcagtggttaatgccgtgcacctgcaggacccaacttgtgccaaccgatgtctaagaaacacaaaatacgccccaattaataagatcaagcacctgagattcactcggcgatcgactagccccaacacaaatcccgaaggggtataaatagggaatgggtagaggggaggcaggagcaccgaccactacatgctcccaattcagctattattgtggggcgcatgcctcaaatttctacaaaagtgtagtaccaacaaggactaccaaaaaataaaattcgtactccgaggtcaaagaagagggatctaaatcggtctggtacccccctttgtcgattgtcatctgcccatcgtcttcgagaaattgacgtaatatatgtaagacatggaccaccctgcctgcgtccggcccccctttaaagtgtacatggatgcttagacacgagtatggggtttatatattacacgtagagccgctgttctagagctaagacacccactgagcttcgaagagctca

SEQ ID NO: 12880 - DNA, 16672 bp, Human; identical to SEQ ID NO: 12322

SEQ ID NO: 12881 - DNA, 197336 bp, Human
  misc_feature (1)...(197336): n = A,T,C or G
cgctgtgtaaagaaatacccaaccatagacacggcaggaaggtgcagaacatgccccttgaagtaggggcggctgctggttgggtttcactcgtgtttcgaagaggatggaagcgctgacaaccacaggaggaatgcgtcatgggttccaggacagcaactggctggacccaactctgggctgcctagctcccccagccttcacaattcaactcatgccacctcttacaggaagtcctcctggatgcccagctctggagtcatctctgtggtatactaggattccagttccaactttctctggaaccagttgggtcatcacaggtcacgagagcagatgcctacagagagtgaggagaggcgggacctgccacaaactgcaaggtaagtgcccatttaatggttgctaagcaggactgtggggctagcgtggccacatcttccaatatctcaagaaaagttaccaatctaaatttccatgtgacatctcaccatgcctgggagctggatccagcctcgggcacccttaggtgacacagaaagagtacagcttgcaggtgaagatggctgtccagctgcgatgctctcacacccaggacccacaatcgaaagaaccaaggacgtgagatcacagttagagcctgctgtgtaagtcgtgtttcccccaacgactgggacctcctggccagcagggagaggcctgagtcatctccgggtcctctgcccctggccaaagcaaagaccaaagccctggccacacagacctggggcagggcaaatgagaaaatcaaaggggtgggtgttcaccctctggggaagtgaggcagaaattgggggtcccagggcagagatgatcaacagcctgagagggggctctcaggcaggccctggagagaggccgctgagctcagacagcatgggaggatcagggccttgctggagaggagggactggggaggggttccggttggcaacgggctctaacagcaaactggccccagaatgggcccaggtgtccttggatgcttgggtggaaaaggtaggcagagcttggagaggccatttcaggttgggggccgggagtgcaatggcgggaggacagaatgcatacgtggggttgaggacagatgagggcaggagcctgactgtgctcatgggcagagagcccaggtctggcaggaagaggctgtgctgaggctgcagcggagggatgggaaggcagatgggggacaggggacagggacttcagaggaagaggaactggggactgaaggagccttgcctctctcagtaagggcaaaagttgatctttggggtcgcgccctgggtgtaccctcctaacagcatcttctggcctttgcggcctctatttgggcattcggcctggctcagaccttggacccagtagtcagtcccccctcccctttcattccctcaccctgtcctgccccagagcacagagacagggggatgcaccccttgaattccagggctgatgggtgggacccggcaccccaagggctctctaggtggggacgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgcctgggttttggaaaagggttacctgggagtcccttgggagggcaaggcctgcgctgaggactttccgcgcccttcccgtgctttagtgagcctcgtgctccaactgaagggcttggctggaaagcaggttgttttgactggtctgagcagggggccatttatgcatggggagcgcccgggtctccaaaaggctcagcaggcaggagcgtgcgcctctctcttttgcctgcctgaacaggtctctggcttgcatccgggggtgggtccgtgtatgtgtgtgtacctttgtgagtgtgtgcacatgtgttgtggaacgttggtgtgtacctgcatctgggtgcccgtgcacctgtgtgaacatgtgcgtgtgccagtgtctcttgtgcacgtatgtgtctgggtttctgcacatcagtgtgttgagcatctgttgagtttgtgtccgtccttgtgcatactggcgtgatatgtgtgtggtggacttatgggctggcagtcagtcttcctgtttccttgcgtgcgggtaataccagcccagggagctggcagtgatgctgaaatgcccagttagccctctgccccttggctgaccgggaatcattggtttttctgctgtggtttcctgttgaactccagctggttctttgaaaagttggttttctctattttgagctgaggggtgcatttggaaatgaaggctctagtgcccatgagctgctcgatcttttgggggcagcgcctgaaggacaagagagaggctaggggatcccttttgagactgcctgcgcctctctagtcctgtgactggagctctgggaagctctgcttcctggagagggcaggagggaccgtggctcagcacaagggggcctcagaggaagcctggatcgatgctgagggaggaggctgacattggcggtgctctgtccggctgcccggggcctggcacacagcagaggccactgcagttttctattttggattgggtgtgtggtggtcaggctggctgtgctggccagacatctgaagccgcccaccatgggttccgctctaattgctactcagggaactcctgccccgagtgagtggccactctcccagcccccgtggcccctgagcacgcccgtactcgggcagctgaggctcatcctacagtctgcagagccggcaattacaccagggctctgcaaccactgtcattctttttatggagacacagaaaatatcacttgttgctttggaaaatcactgcctttggctggatttagttagaacttggccatattgcaaacaactgtaaatatccctggaggagctgggttaaaatggtgagcccttgacatcgcccactgtctctgaggacatcctgggcctcagaggtgtgtcccattttacgctggaggttaatttcctaaatgaaaggagatgtttgctgcggacttagggtgaggtaaggtggtgggagttgacatggggttgcagtctgttggtgggccaacacctgtgtactatgcattcctgatggagagcattttggggaggacttgtcactgtttcattcattcagcagttcatttggtgattcatttttcagccagcaccttctcatatgtttatcccctgtactggtcagcaatgaggcaggtctggtacccacccagggctcctgtcgtcagggtggctgacggacactctggccaggacttggagagtgtgctcctggggggctgtttgaatgggggctggaagaatgagtggccagctggaaaagacgcaggttggcaacccgggcagagggaggagcgtgtgcagaggtaccaggtgtggattggcctgggcaggacaggcctgctgaagtgtcccatgtaccagacagagctgggaagaatattggggttggaagaggagctgggacctgcctgagcggcattgaatgctgtcactgaataatggccttggacagtgggacagcaccattggttctgttttctttttttttttttttttttgagacggagtctcactctattacccaggctggagtgcagtggcgcgatctcagctcactgcaagcgctctgccttccgggttcacgccattctcctgcctcagcctcccaagtagcagggactacaggcgcccgccaccacgtgcagctaatttttttttattttttttaaaatttttagtagagacggtgtttcaccgtgttagccagggtggtctcaatctcctgaccttgtgatctgcctgcctcggcctcctaaagtgctgggattacaggcatgagccactgcgcccagcctcttttcttttcgcttgtcctctttctcttctcttctctttccttccttccttccttcctttttttctttctttctttccttttgatcaggctggtctcaaactcccgacctcaagcgatctgcccatcttggcctcctaaagtgctgggattacaggcctcagccaccgcgcccggcctcttctttccttttctgactttgttgctgcgtatgtgtctgtcctactgttaaatccccctctgctgccaccacgataggcttctttgctaaggacctgggtctttacacagggcacctcttgtcctcacagagccctggtcggggaggcatctcatccctggttacaggtggagcactcaggctctgggaggttgagtgactagacggaagttattcataataatatccacagcgaggggttattcatagtatccacagcaaaatgtccctttgcacaaggcatgagcaaaacaggctgcacagagtggtgttgtgcctcacgttgctgcggaagagttttccagtatctcctgggcagcgtggtaggcgtgctaatttcacgtggtttttacatgcccattaaaaacccagtgagaagccttttggcgtaaaaggtaatgatggtaagtgacagttgactgtgttcctattaacattgtgtgccaggctctcagctgagccccctgtgccacctcgccttgtttaatcctcacagcaccctacggaacatatcccgacatcatcccccttctacagatgaataaactgaggctccaaaagtcgagatagcttgcttcaagcttcgaagccagtatttgaacacaaatctgattccaaggccatgctcactatgttttgttgccttttcctgcatgcctacaaaaagaattttaaaaatgcatttctttacaacatttcccacctttcttatttgactcctggagacgttctcattgtgggtttgaccatcgtcagtgtgagtggagccgggagcaggcctgggagctgagtggccttgactggctcgtgacctgcgctgggctgcagctcctatgggtggcctaagtcctcactggtgggggactgcagctgggacttccgtgggatggaagcaaccctgcccgcctctgcctccccactcagggcagcacggggatcctctcctgccaggctgggcagcagtggatgaagcctccatgggctgggcggtggagatggtccgccctccaaggcctggtccaatcctggggcccaaaggaggaagtgtatgcccttccctggatgcttgatgcgaaccccacaaccctgtgagatagggctgccccactgcgtggctgaggctcagagagacccaaggttgcatggcaagaagaaatccagggctgctgcctttcaggctggggctcccctgcggggctgctgtctgggccaggcacccactctgtcttgctggacattaagagtcataaaggccacagagagaagtcagaagccggcctaagggatcgagatgagtttcatttttcccagcaaggctgctgccttcgaggccacacactgggctccagcaggctcaggtgctagagcagatcaggcaggtgtgagcgggtcctgggactgtgcagtggggtgaggggcacctgagatttgcagctgccgctggtagggtcttccttcctcccaccccaccttggcactgcctggatcgcaatgagaggttgtcaggaagactaaagaggggctgcaggaacctctgggttccctagggtgtcggggctccccaggtaggagcagaggctcctgtgggccccagctgcaagcagcctacacagctgctaaggccagtctcagcctccgccatacttgtcaccttaagacttgctcagtttaagtgacagaaacccctgctcatattggatgaaacaaacaagggacagcatggccccaattatctgggggtcctgaggagtgttggcttcaggcctggctgaatccaggggctcagagcatgctatccatttctcagccctgcctctcagtgttcatttcagaattgctctccacccctcaacccccggcccaccagcggctccaggcccaactcgttttccaaggaggcaacctttgagatggaaagccctcctctctgggtgacacctgtgagagttgggggagggattggaggcccatcttcaaacccatggctgtgatgcgggcctagcccaggtctcctgcccacctttgggactgagggggagggacagactcccaaactctggaatgaagaggggcctatcatacaagaagggaggagaattgtgcagggtggtgaacacggttgtggccacccttctcctggactccagaccccatgttgggcttagaagtcctcctgggctccaggcttgcctgctcggctgcctctggaacccccttccctggatgaccccatactcaagtcacgtggctctccccactctcctccagaccccacccttccaggatcgccctcccctagccagctccaattctagagctctctcagggcccggcttccctccacgcctggtgccaacccctgctttctgctcttgtaccccccactgccccatggtctctccccgacaacccttctccactctgcagccagagggatttttagaaaccatgcagcaactcatgtcacgccttcacttaagacctctcagtggttcttactgctcttaaaaacatccaaacccactggcctggcattcaaggcccccgtgacctggtcagggccctccagctccggcctgagtcgcctgctctgctggtctggaatgagactccgggagaaagggctgcaggaggcagaactccagcgttcccctcaggtgcccctgggagggtggggcaatgactccctcccctgctgccttacgtgagctgagggcccctacagagatgcctgagggatccagcagtgcagcgcagtccctctggaggcggcggccagcctcaggagggggtccggggagcagcatccacaccatctacctctgcctggggctttgaacccagtccctgcggttttcctgtgagccagccaccgtggccccatttcacaggtaggaaaccgaggctctaggagttacatatgcaggttctctgtgtgggctggcgtctctcctggaatcctttagggaggggcagagtggagccggctcccagcccctcatgaaggccggcatagtcagcactggtctcagccggagcccaccaaggccagctctccctgggagagctgcactccattgtgtggctgggtatgtttctggcactggtaaatgtgcgcggccatgtgctcattcaggtgtggcaggcttctcctgcccaatggctcgccgtggcttccctgtcccccatgtctccagtgcttagcgagtcatgcctgagtgaatgcaggccctcctgcagagtcagctgggaggtgaaggccaggtcctcacccaggcctgctgtgaggctcacaggggcctcacctgggtgagtgagtgaattcaggccctcgtgcagagtcagctgggaggtgaaggccaggtcctcacccaggcctgctgtgaggctcacaggggccacacctgggtgagtaagggaatcagccagggacatccgctcagcagcgaggctggctttgcctcgtggctgcctgagctatggtctgggcctgcccactgtggtatctgaagacccaaagaggcaagtgtgcatggcagccctcctgggaccctgggtctgtgctggcaggcagacatgtccttctttaccccacctgcctctctggcttgggcagccctgggggtccctgtgttgctgccggcacagcaggctggtggctgcatgtggacgtgtgcgtgtcctgggcctgtgcatggcgggagtgtgtgcatgtacgtgttgcctctgcatgtcttgcatgtaggagtacgtgcatgcagtgtgcgtgtgggggtgcatatgtttgtgcacgtctgaatgagtgtgtacacgtgtgtgcacatgagtgtgtctgcatgggagggtgtgcatttgagtgagcatgggccagcatgtgtttatgtatttctcgggaggggtttcctgcactctgtagaagaggggccttaagtggggttgaggtactcaggggagaggaggaccccagccccctcaatcttggcgccacgttagacacccccatcccctactggtggttaccccggaatgggaggatccaggtaggagctgcacactctgctgcgtatgtttcatattaaatatcagctgtccacagggtctgcggtgctgccattaatatggagaagttattaccgagcccggagctggctcctcgggcttgtccatgaatttcaattacactgcacgacgactccagggctgcagagtggggtgcacagcttccgctcagaggcacagggaaccctagtgtccaggaccaaggcctgggtgctgctgaagccaggcaggctctacgccatccccaccctgccttgtgcatttcacgggttaacccagggaaggcaggggcctattgtgggctggaggctgttgcgggtcacatggtccgctgtgctcctcgtgaccggcagggcggacaagcaccacgatcctgagaaccttagttcctccaatagcaaaagatgggttctgtccgcacgcacttcagtggcagtgaaagggtgggtgtgcagcaagcgcctaccccaggcccgggggtgagaaagcggtggccgtgtctgcatatcattagctctaaggtgccatcggttacaggacacaccattactttatacgccaccaagaaagaggagacactcccatttaaactgcaactctgtgccttgtggttccctggaggcgcgggccccactgccacagtgcttggtttctctgatgctgtctgcagcctaatgggtgggccatttctgctgcctggccgtcgcttgtcacggctcccgggaactgagttcggttggcttcgtccgcctccgggggtcttcctcttgtgaattacgaagtagcggtccttcctccagggataggtatttgcctcaccaatgcaaagctacatgcgcctttctgcgtgcaccctaactttttgacctcacagcgtgactcttcaaagacattttgagtgtccagggtgttgacagtgagggactgcgttggaagtgtcgtggcccaggaggcgggggccagggccggggcctgagacccgccgattgcatcctcagttcaggggttgggaaatggaaagatgcgtgttggagggaccagccctcaccagctctgtgcagaatgtccgggattcatctttaaacctgggtatttttcctttgaaagccctaatctgaaatttcaatgtattaaaagtatttccaagtgttaaagcctgtcatctttacacccgggtatttttcctttgaaaacccctaaacgacaaggtttggagagctttgggttggtgaacaggtgaggtgctgggagggtgagtgcccagagagggcgtggaggctctgcagcccttcccgttaccttgccctgcccatccctcccacgcggctgtttgaaagcagggattgggagcacatggaaagtagggtgtcttcacgtttcatgcaaggcttgtctaaggcttgctagtggccattctgattgggacagagcttctggacatatgatgaaaaggggcttgagagctgtgagcatattggtatgtatttacatctgtctattttatgggttatagtacaccatcgccagtcagttgcaaatgaaacctcaggttaagcagtaccgcagatacattctacttttccatctttctgttcttgtaccaatattaagctgtgtttattattagaactgtaaggctctaatagtcaaagtattaagtactttgaagctttgctgtccaatacagtagctataagccacacaaggctattgaagacttaaaatgtgtctggtctgaattgagaggtaccctgagtataaaatatacattggatttcagagacttcgtaccccccaaaaagaatgtggaatgtttaatagatcattttaaagtattgattacaggttgaaatggtaatattttgggcatactgggttaaataaaatatatttctgaaattaatttcacctgtgtcttttttttttaaaaacatggctacatataaagctcgagttctatttctgttggactgtgtggctttggaacatctggctggatacgtccccctttgctggtattctcttacaaaattttcttggctggtcacatatgtttattctttcaaatgaattttataattgttttgtcgggtagaaaaatccctcgtgaatttgattgatagtaaattaaacttagaaactaattaaaggaggaattgacataatttacagtattcatcaggaacatagtatattttttcagcttatttcattctgctttgatgttgtaccatgaagtattatatatacatatttttatacaggtcatccatttttaaaaatcaggattatttcaaggattttttttctttttgccattgctcattgaatactttccatctattggtacacaggaaggctactgatttttatagaactatcttttatcaagcagcttgattgaactcattaattctaatatatctttgtggagtcccttgggttttctaggtatacagttgcactctgtaaacactgataattttggatcctcatctccaatctgcaccgtctggaaccttcagagcgatgttaagtcacagccgtggctacacgcatcctcatctgtgcctggctttaacggcaacgcccccggtatttctctgcttaatacagcgcttgctgtggattaagatggatttcatgtgaaggcaatatcctctgaattctcgttttctaagatcccatttttatcagtaaaggagctgaaatcaagataaaatgtgtcttaactcttaacgctcccttctctcacctccaaaagccagaggtgttgcgattccggggtgtttgtgttctcagcctcggcctcagctgtccactttgctgggccaggaatgaaacccagtccccatttacgcaccatgggaagccctcgtagggaggggcagccttcctgcagaaggtgggggagccagcacctcccggccacgcgggtgacttctggaagaacaggaccctgttcttggaaagccctttgggccatgtgtgggggcatttccactttcatctgtgggttctttcttccctcccagtggcgtctccctccctctgtccagtttctctggagcaatccctccattctcctcctgtgtcttaacagcggactttgcccgctgctctgaggtggtggcactgtctgcagagtctcctgctcttccagtcccactgttatctgttatcccatgtgcttctagaaggtgtttttccaagcaaagacatttccctccttagaagaaatctgtaggcggggcacagtggctcacgcctgtgtaacttgaggaggctgaggcgggcagatcacttgaggtcaggtgtttgagaccagcctggccaatatggtgaaaccccatctccattaaaaatacaaaaattagctgggcatggtggcacacgcctgtagtcccagctacttgggaggctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgctgcttgcgctctgtcctccttgcgtcttcctccttcctgcttcctcctgccctcttcctccttcccgtcctctccctcccttccccctcctctccctccagcttctcctccccttccctcctctctcttcccccttcttttctcattcctctttttcccactcccctcccttctcttctccctcatctcccctttttcccttttctctccattctccctttatgtcctctcccctccctgccccttctgtcctctccctgttcccacctttctttcccagagtctttcatcagccaggactcctggggacccttcctggctgggggcccttcgtcgtcagctgcactctgcacctgtaccttcctggtacattctgggaaccaacaacgagccatcccaatgtgctgggaggaaatcagggcacagcgatggggatgacccaccccaggtcccacagagcccagagccagctcctttcactgcagctggagcaccagatgaaatctgtacctcctcagaggtacagataactccccacctgtacaagcagggtgaattgctgaaaaggggaattcatgtctcctctccttggcctgctactgagttcttggtgcattttctagcaaacaaggtcaaggctgagtccctgccctgccagagcatcctccacctcagatagggcggcttggcctttgggctgtctttcctgttggggtgcccaggctgtcacgggctgtgtcctcactggggagggtggcccgatgagcagggctgctgggaaggttgtgcaggtggtgtgctgggcaaggtggccaatgaggccagcctttgctccgtctgggagtgaatggagtggaggttggagggtgcccagcgctgggtggagatcacgggcactgggggaggggaaatgtgtgccaggtgtctgcctccacagtcaggttgccagagttgctgcgttcttctctttgcagagcttctgcattctcgggactagggacattaaaaaccaaagccggggcagttgcagggaggctgctggacattgcaggtggccctgattggggcagtctcagctgtggtgactacgctgtggcctttggggccagggatggctggtccaggactgggcatggtatggggtgggtagatgtaggccgtctctgtcttggtgtcagcctgtcctgatagactctgggggctcagagtcctcacagccttcccccaacctgcctgcaggtgcccacctggctccccaaggcctgcaggagtccgctggggctgggctggcctgggacccttggtgggagtcaggcaatcgtgttattgttgaaacttgtttcctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggcctgaaacttgtttctttaatggctggtggttacggcccccaactttcctcctctgaagctgattggttctccctggggctagtcattaaccctctgctagcttgggtgggtttatatttgcagagcttccttttttattctgccgggctggtgttttgtttcttcggtcagctctgtcagcctctctagttgctttcttctggttactcagcctgtagaaaagtatcagcctttcaaagaaatactccattatatgttttgcttttttcctgacttgatttttaaatatataactcctttaattcaagtgaaatgtgtttcttatactgtataaggtgttggttttaagtgttcatttttttctaaattgccatgctgttgtctcaacaccattcgtttgctaattcactctttcttcttgactttggaatgtatattccatcatctgtgaagttcatggaggatatggggtttatttctggcctttctgggttttgttttgtttttttttttttttttgagacggagtctcactctgttgcccaggctggagcgcagtggcactatctcggctcactgcaagctctgcctcctgggttcaagcgattctcctgcttcagcctcaagagtagctgggactacaggcgcccgccaccacacccggctaattttttgtatttttagtagagacggggtttcaccgtgttagccaggatggtctccatctcctgacctcgtgatccgccctccttggcctcccaaagtgctgggattgcaggcatgagccactgtgcctggccttttctgtttttcttttgcaccagtccaggggtctttaattgctgttggttgacaatatgttctgacatctgatagggcaagtatcaccatcgtgaggttttaaaaaaatgcctaaagtagtgtcccctttgcagaaggccctcagcaaatctttgctgaacaaatgaacgacatcttcatgatgtttaattttctcacggaaataagaagattgattcagatgtttaaaaacatagcccagtaggtttattactaagagacttagaatgttattgccattgtcaatagggtcttttccattatattttacaccagattgttatctgggaacacttttaatttataatacagtaggtgattatttactcagaatacctgggacctgcttctttcagactaatgatattctcagaatttagacatctttattcccagggagaaaacagagttaaaaatgacacattagtgcaaatcatacatgcatgtgcagagctgccacgaaccacttgatacccatggttgacctggcaagcccaagccccagcattgctgtcctcaaggcgcgcccttcctggcaacagcccctgcttcagatcctttgctcccaatgacctgcatcttcccatgtcttagcaaagcagtctctctgttactagaatggcacaaatatgaaccacagataatcacaaaaagtccttctgaaataaatctcttgccgggtgcggtggctcacgcctgcaatcccagcactttgggaggccgaggcgggtggatcacgaggtcaggaaatcgagaccatcctggctaacacggtgaaaccccgtctctactaaaaatacaaaaaattagccgggcgtggtggtgcgcgcctgtagtcccagctactcgggaggctgaggcaggagaatggcgtgaacccgggaggcggagcctgcagtgagctcagatcgcttgcaccactgcactccagcctgggcgacagagcgagactctgtctcaaaaaacaaaacaaaacaaacctaaatctctcgcttggatgtttcccatgtttgcgttcccagatatatgagtttctctatttattttgcatctagactttttatgaacttccttgttattatttggttcctttttttggatgtttttgggggtgaggattctctacgtgtgcagttactttctgcagttcataatattgtctcttctttttcaacatgttttcgttttatgtctttagtaattttgtgtgggagctacaaccatgccttcagagcatctagccccgcttctaagggaattgagaaccaggtgctgcttcttctgtgaatgctggtggtggtagacccaaagtggacaaaccttggcctgaatggatctcccaggcccatttccccacggtggcacggctttcctttccctgctctcttgcatcaagtagagcttcgaacgcaggatgtgcccatgttgtggttttatggggatgagtggcggcggttgaccttccctttcagtcaaggaggctctctcagtccctcgtggtctgttaggtgtcccctgtggttggggagcagtgcaccgggcatgcacagggttgtttgcaggctggcaggaaaactgcggtctttgaaagatgccctgagtttctacgggggatgtggttcagtgagacactttcaggagaaggctggcgagtagattcggtggtacaacctggagactctatgaatgtggactgaggagccctgttttgagtccctgccttacccttcacaatgagataattttctgcacttcagggttcccattgtgcagggcggagtttgcacactggtgggccacgggccatgtccacccacagatgagttttgtttggcttttccagtgtttgaaaatttctcacaaagctcaagatttccagtttctcttgagaaccaggaaatctgccgggcctatgtgctggagggctagagctgagcaaggatggaaccctctagaagggtcccacagttccaggtgccttgggagtctctgctgctccctatcattaccctggcgggcttcacgcgcattcactccctgtgtaggcacctgagagtttctcttattttgagatgagtgctgcatgggctttggaacggtcatttcttcctcccctctctctccctctccctctccctctccttcccatgacttcagtttttggccatcagcccctgcaaggtcccgtgcgctggagtcagacgcgatctcgctccaacacgtgggcttggttttctgctccctccctccctgggcgagcgagcctcctgtttctcatctgtgaaaggtaaaagctgatgacggtaactactctggtgggttatgatgaggattaaatgaagcgagggccagcactgagcagcgaagggcctgttactacaagatcatattttcctgatggcgctgctaggagggaccacagtgtgaaagcgcttggacacacggagccaggtgcagattttgtctcttttgagagctctgtgggcggggcttgggcgggcatgggagtggggggcggggccgggggcggggcacaggccggggtaggatgctctccctgccccaggcatcaccggcctgggatgtgttgccagtggaggccgttactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaagatgcggaaaagatttccagtctggaatgggagaagagtctcgtggcgggcaggccccaagaagggaaatggaggtcagtgtggcgaggggatgtgcaggacggagaggcagcctttgttgggggagcgctctgatcccttcctccgcacccctcagctgggaggacttggccgcctggccgttctcctttgggagtgaatccggagggtgtggcccagaggcggctggcctcgctcctgtcctcccatccacacctgtgcagctggtgcctgtgcccctgtccctcccacaggccatccccaggtccacactcctgtgactgcaagtgacagaaaaccggggcagaagcggctggggccaaagggggaatgcggggctcagggcggcagcccaggcctcccgcacggtttcagctcagccgccctccccgtgggtcctgcctgggcagtgcaccagccgcccggcagagagaggcccaggttccccgagggtttctgggagagcccagtggtgagttctcactggctcaggttgggtcacatgcttcaggcaaatcactatggccaggacagcggagcaggacttcggctggccaggcctcgtcacaggactgctgtggctccagggctggcgtctgtcctctgaccctctgggagtgggtcggggagaggatgggccccagaggaaagccaggctgatgtgtcaggaggagctatgggtccccattgccttctgtctccaggacatctgccctgtcttctccctgcccccgtttctcccactcccttccagctgcccatgataagcacgcggtctcccttccgtgccccacccgaaatgctccccatggctcctccactttgagggtaaagcacaggcccccagaaccagcattcaaggcccctcctgaccatcatcatttcctgcttgctctacccaccatgtccaccttcccgttcatcctgtgggcctgggacaggagctccgaaagatcacacacacccatcaactgtcaactctgcccacgttggaaacagtgcctgtggcaggtgcaggaggggaccatttgtcttggctgaagttgaatctgaaaatgacctaaggacttgaaggaaccagggcctagtgtgtgtcggggtgtgatcgggtggctgaagaagctgagactccttgggcctcatgggctttgcattagcagagcagacagtggggggtccctgaggacctctgggcttttgcctgaatgctgggaaccccataggcctggccaacttctcatcacccctcttccagcaaaccttcctgtcttctgtcctggtagttagcacagctgttccatgtcgtgaaccctcctgccagcctggtgaggcccatggacccctgatcaaaataatgtgtttagtgtacactacaaaatacaaaggaaataaatctgattgaaataaagctatcggccaggcatggtgcctcacgcctataatcccagcactttgggaggccaaggcaggaggatggcctgagctcaggagtttgagaccaccctgggcaacatggtgaaaccctgcctctactaaaatacaaggaactagccgggcgtggtggcgggcatctgtagttccaactattcaggaggctgaggcacgagaattgtttgaaccctggaggtggaggttgcagtgagctgagatcgcaccactgcactccagttggggctatagagtgagactctgtctcaaaaaaaaaaaaaaagagaaaaataaagctatcaacatacacatgcttttaaaatttttaatcattattataccttacacatttttgataataatgttattgagacataattcacatactatgtattttaccaacttataacgtaaaattcaatgaatggctttagtatgttcacagaatggtgcaaccatcaccacaattttagatcatgttcaagactctgaaaagaaaccccagaccctttagtaacccccaattaccccgtcctcccaggcctaggcaaccactgacctaccttctgcctgtatagatttgcctgttctgggcatttcattagtataaatgaatcacacaatatttgccctttgtgtctggcttctttcactcagcataatgttttcaaggttcatctaggttgcagcatgcatcagagcttcattactttggatggaaagatatgattccattgcatggatgtaccacagttttttaaatccactcatgggttgatggattgggttgtttccaccctttagctcttgtgaataatgctgccaggaacattcatgtaaaacttttttgtgtgcttttaattgatgcattaaataataagacctaggagtgcatcttacagcctctataatttaagttgtgctgagtgtaaacaccatttggtctggtctgcagcagcggtgctgacagttgccgaagcctgtgatttctgccctgatgggcgcaggtgctgttaagtctggggttgctgcctctctccagagttgaagggaatggcagctttcagttcccagttagtaaagatgaagttgaagtgttctcttttcccagtttatggagcccaggttaagaactctccagggagctcccacagggcagtgacaggacccaacggcccctggcaagtgctgtggcctgtggcaggaccaggtgtccagatcaagctggcggctgttctgcctgccctcagccatgctgacacctgccacgaagcctggtgtctgcttctttctcctccccgaagtattctctctgtccttagcttgggagtcctacagctggagggtggggggcccaggccctcctggactgctgcccctggggccccattgtctttccttctgccaggccatttcccttcgcagctatttagaagggaaggcagccaaaggcctgtcagaagggggaccacggatggattttccatcagatgtgcagacctgctccctgacactggctggctcggtgcctgcctctggagggcaccaggcctctgtcacttcctgtgcagcccctgccagccatgagacaggtgagggctccttggttttgtggagactgtcagtcttggctctggagtggcctcagtcctaggcagctcaagttctgcctcccgccagtcctgtctgcaggcaggatccagtcctcacgcacccatgctgggcacggccctgcttccacaccgtgctcaggaggagagcgtccactcccaggagaggccttgccaggcacctctccttagggacacctgcagttaggggtctggcgccagcttgtgtgtgagagatcaactccccctggtactgtcaggccccgagtgagggagccgcagcccagagaggcctctttctgtccagtttgcatcgccacatttgggtttctgtcccgcctggcctgggccccacctgcctgcggagctgccgaggccctcgtctagtgccctcccagaggggcctccagtcctggttcttatattacagaggcagccagaggcttccctgactctgtggctggcgcagccttgacaagtcatctggaattggctcacggcctcctcgcgtctcccggtgtctgatgtggcaatgaagctctatttcagggcctgcgggaggacccagcgtggctcagggtttgtcctcaagggagggcgtggatcagagcctgtagtgcggacctgggtgggggagggagaactggaccctgcactccctcctgtgtgaccatgggcgggttatttcacttctctgcactttcagagtctccaccttgagatggccccgtgaggactgattcaaagaaggcacgggccgtgggcgcatcctctgctcctctccccacctgcgctgggtcccatcagattttggcattcccagcaccggcagtcctggggtgactcacgatggctggcaactttttgtcctgtctttaagttaaaaactgtcgtatgtgccttcatataaaacagaatgcagaaataagccaaaaggagaaaatggaaatccctgcagtgccattagctttcaacatttttgtgtgtctcccacgtccatgcacatatgtgtaaacatacttaatgacaaaagggtcgtattgtaccttccctttgtgatctgcctctgcccatgccacacataatggaaatatttctggatcatccagtgttctgccggaacatctttcaatagaggcagcataatctactcaggaaacatggagaggccgggatctccaggcacttgggtctgtgggcctgggggctgagggagaggctgaggaaaagcactccccagcttttgacttgcacagatgggtggtagagaggaagggtagcttggagagagggtttgtcactggggctgtctcttggaaggagtctggcagctggaaatgcaggtcctaggtgcaggggcaaggtctgggtagaattcgggttgggagcgctctgtatggagggctgtggattccacatcctggggtgggtgggcgggcaccaaaggaagagggaggcagaaggggaaggaagtgctccttggccccccaccatgtgcagacaagtggaggaggcagtggggtcttaggagcggggctgcccacctgctaaaggatgagagaggttcaagaggagggggttcagggaattgggatggcagggggcatcaggcccagcagccaagagggggctttgcagggtcgctggggagttggtggaagctagactgaccaggtgaggggccagtgagaggcaagggagtggagggaagctggtgcgcatggcacacatgctgcggtggggcagacatcagctgcggagggtgtgcagtcttagatgtgagtgcagtgtttacgtgtgcgcttgtgtagatgtgtgtgtggccctgcctcgagcacagaggattttaggtggcttgagtttgctcagggaccgaggatgaggatccgggagatggagagtttgaagctatagaagagagagtgtattagtcaggtgttattcctcaagtgttggaaatccaagtaaaagtggcttcagaaaaaagaaaaaaaaacttattggttaatctgcaaaaagaaaaatatctagaactatctagcttcaggtgtggctggatccaggtgcccaaataaattttcagttgttttttttcccacatccccaacccttggctttgctctcctctatgtcgatttcactctcaggcctgctcttctctgaggcagaaaaatggatgcaggcagctgctgcattacctcctcacagggcaacaacccgggggaaacagcttttcctttccaacaattccagcaatagttcctggatttaacttcatggaataccttgtggcaagtcctcatccctgagctatgttcatgtagtcagatgacaacgtattctacctggcctaggctgggtcatgtgccctccttgcccactggtgacgcagggatgagagctggttcctgagtgacacaggggctgtgctatcagaaggagaagggtgggccaggaacagtggctcatgcctgtaatcccagcactttgggaggctgaggtggacggatcacaaggtcaggagattgagaccatcctggctaaaatggtgaaacctcgtctctactaaaaatacaaaaaaaaaaaaaaaaattagccaggcgtagtggtggacacctgtagtctcagctactcaggaggctgaggcaggaaaatggtgtgaacccaggaggtggagctcgcagtgagtcaagatcgtgccactgcactccagcctgagtgacagagcgagactccgtctcaaaaaaaacccaaaaaaatggaggagggtggactccaggcaggcttagggttcccaaggaagtggctggggccaggattgggagacctggaaggctggaggagggagctgctgcccaggagcacagcaggagagagaaggacacgaggcagacatggagcgggagggaatttcctccgtggcctcccttccctcaccaggcagggcagggacagtgaggctgctgaccagcctctacagctctcctgggagtcggctggctctgcaaggcaaacagaaggctggggaggttgactgatcaccggctgctccgggagccgtcaggctgggcagcaggagtggcctgaatgcagagaagcaagccttgagatcaggcagggcagtcttcctacattaggagtctgggaccaggcattctgtgggccaggccggagatgtggcaggctgggtgtgaacgtgctgaccagtggggacctgggtttgggtgctggggagccaggcgtaatgactgcgggggctggtgaaggctgagtccagtctgcacgcatgcttcctgtggtttctgggtgaaaagagggtcacagctttttgcctcaacagaggggagaggcttctattctactggttgagtgtggatggggagggctgggaggggtaggatgaggtggtagagacatacaataagcaaaaggccaaataaacaccttctcaggtagtggcaggaactgggaaagtaagcaagcaggcagtgaggctgggagcagcaggagggtgtgagtgagtgcatgtgtgtggctgatgtgtgagcacgtcagtgatgcatgtgtgcaaatgtgaggcatgtgtgagtgcatgagtgtcatgcatgtgtgcacatgtgcgggcgtgtgcatgtataatgcatgtgcttgatgcatgcatgtgtgcactgcatgcctgtacatatgatacctgcatatgatacacatgtatgaccgatgcacatgtgtatgtgtgggtaatgtctgccatgcacatgcatggggcatttttctggtgcatgtgtgtacttgtgtgtagtgcacatgtgtggacatgtgtatgtgatgcatgtgtcacaggagatgcacatatgagtgatgtgtgtgtgcatgcgtctgcatggtgcctgtgtgacgcctgcgtgtgagtgcacacgtggtgcatgtgatgcgtatggacatttgtatgtgggtgcatgcatgctgcatgtgggagtgcatgagtgcacatgcatgtgtgtgggggcctgtgtgttgagggaatagctgttgggaaccctcagtcataacagggctgtgtgaaatcttcagctggaggaagacaggagagaaatagcgtgcagctgtgttcctaatggcacacacgccccttgcccagagtgcatggtggaagagggctttctggcccagggaccagctctctttgtggcccaggcctgctgcttttgggctggggtctgaccttcctggaagacccttcggggccccgcctctcagaggccaggccccaacgtctcaacgctcaaacagcgacatcagtgtttcccccaggggagtcatcctggggaggctcagctccatcctgagccgagggggccttggcattgccccacctgccctggtctgagaaggagctgtcctctgcctctctgtggtctcatggggacaaatgccagccactggacagtggcccttgtcgtcttctaactgtcaagattccaaaaagacggaggcgaggggtgtgcgggagcaccctctgcgtgtgcttggcttcttccccaccagccttcttgtgagagggctagaagcagctgtcccactttgcagtgggccctgtccctcctggcagggcagctgtggccgtccctggctgtccccgccccgcccggcatctccttctctccccatcccctgtctagctggccccgcctctcctccctgtcttgctttagtctcatgcctttttaatgagggctcagcctcctgtgtgctgaggctcagcggcagcgcatttaattaatactctcgcatcgcagttcttcagagtaaatgctgccattttattcctcactaattggaaggggctagttaagctctgagataaatgaccctttctgctgggagtgtctcagctcagagtctccatgagagtggctggagccttggatgggaagggcaggagggctggcctgctgtgttcctcctggtccaaggggggcctctttgctaatggccagggtagagacgtggccagggtgaagcctgcctgacctttggggaggacgtgcaggtggaggctctgctgaccagcagggcttcagattcatcactgcccgttcctcatgtcccggctccaccccagccctggatgagccccagggaccccagggaaccttcagtctgggtttccagaacctttccctggcccagtctacacctgcctccctccctcactgtggaccagccccacctctaccctccatcctgtacgtctgctccactctccccaactggcgatgagtctggccagggagtctcagctggtgctggcacgctaacctcccctagacgcgtgctgaaatgtacacgtgtgtgtgtgggtgatgtatgcgatgcacatgtgggggcgtttgtgtggggcatgtgtccctcagcacacatatgctctgtgcccgctggccatccgggggacatagattacaccaacactgcagtgctgctggccacccatggtctgggcagcaggaagaggtgcaggagtccccacacagtgtcgctgggatggcctctgggtccgtgcttatagaagtctcatgagtgcaccctccgcccacctgctcgcatctctctccctccacgaggaactgtgctgtggcctcctgggtcttcaagctcctttcctgttgtgttggtgacaggaatcggggtcagaagggcagcgtccgagcaggcttggatgagatgtgtgatattgtgttaccatatcagcgactctgctagctgagtccatcttcagggacaaggatagctgtagccagacctacgcatggatttatgaggaactaccaagaaaccactgggaggaaagacgccaaagtgctgaggaaaaggatgctcagaggtggccctgctgccagctggcagagtgacaggagggctggaggctgtggggacccaggccacgtggggttggggctctgggctttgtccttgtgttcctgtaattgtctgttgctgagaattagctggaatttctttctttccttcttttgttctttccctatcctttccttcctttcctctcttctttccatcctttctcaccactgtgtattctttttaaaaaattaaatatatttcctttttttgagacagggtcttgctctctcccgggctagaaggcagtggtgcaatcgtagctccctgcaaccttgacctcctggttcatgggatcctcctgcctcagcctccaaagtagctgaaagtacaggtgtgcaccaccatgcctggctaattttttaaatttattttttgtagagatggggtctcactatgttgcccaggctgatcttgaacttctggacttaagcggttcttggcctcccaaagtgctggaattataggtgtacaccactgcgtcccgtccccacttcatgttcgacagcagttctccgtgcctgctctgccctgggccttgctggactggggttgaagaggcagccttctgttctcttggagctcacaggttcctggagggacacagcaggaaggtctcaaatgccatccctgggagtggggagggtgttctgtggggctggggagccctagggggcctaggcaggagcctgggatgcccacatgcaatgaccccctgagctgtggccgactccccagccctgctcctgagggccctgctgctctcagcatctcccagggtgtcacccttctgggttgctagatctctgctgctctggtgtggcctctgtccctgccgacccctctgagggacacagctgtcctctgctgcggtggctctggcctcggaatggggcagcctcttccctccaggcaagagcctttgaattctttgccagcaggacttcctgggctcttgtctcccgtctgctgcccggtgcccacgccccagtctgggacttggatgtctgcctgctgcctccctgtttacactgatctgatctgctctttccctctgggagcttttgaactttctctttgtctttgatgttcttaggtttcattatcgtgggtctagctatggagctttttcttatatatgtattgataaggcctctaggaacccatccatgctggaatctttcatgtaattttgttttttgaaatattccttctctcacctccccgactctcttctgggacttgcccacgtctcgcagcttttctccctgccctctgtctcttgctcctttcttagcacacagcgagagctctgtccagatcccccagttctgcggtggctgtggctgttcagttcctctgttctgctcttcggtgcagccaccaagccctctctccagtggcgtttgtgctcagcagctcctgggggcggccagttcctgtggccatctggggctgtgctttgtctctggaaggatcgttgtttcagttttcctctgcgtgccatgggcggtcctgggtacggcctctctagaacatagtacctgcgccactcagatcccagctcgtgtccccggaggtggagactgtggctggtggtgctaggagggctcatgccagcttctagctctggcttctcctcgtgagcgggacaagggagatgggaggaaagtccccagagatggcttccctcccacccaagctctgtttcctgacctgggatcctggctcccaatggtgggaaacaaaccccctttggggacacccccacttcactggcaggagtgcagtcagccctgggatcccgacatgaccttcccaaagcactgtggcctcagtgctttccagaagccaactgtggcctcagtgctttccagaagccaactgtggcctcagtgctttccagaagccaagggtatttaatcttgtccatggcgacgtggacgcgtgtcttgggaggagccctctggggtggggcagaggctgtgttaggtgggagggtctgaggcagggacccaggaggaacagaagagagagagtgagtgaggcctgctccatgcaggggcagggggaggaggaggccggggtggggccttggggattgtggggggggtgggtgtaggaatccagtaccacttccaggttccttccaggcttgaataactgggagaagggggcgtagctggctgtgattaggctctgggaggggagtcgcttaatgtcaggaaagagagttacttctaggtaggccctgggcttgaggctcccgggccatgctaagggacattcctatgtcccttgcagctcttggttgggcctggcacaaaaaagtgtgtgcccaagactcctgtctgtaggtggaggtctgctggagtagaggttgggggcactggcgggggacaggagccccacctgggtgcaggaaggctacaagggcttggtggaagagcgtggaagcccccagaatcaggggcttgtaattctggcccgtcaccctgtgggacaagcacatgggcctctgcatgctgtctcacctcatctgtaaaagggagacagtccagtgaggatgtgggcccgtgagagagagacacggcccggggggctgcagaggcaggagcgctgtgggtgggagggctgcttcctgggctctgagtacagcacggtgcatttactactcttgtctcaaaaagcagggaaaactgagtattccggccacgccacgccacgccacggggtggggaggagcctggccttgccgctccctgcactctcctctgcgctcacttagctcagagctggcggccgcccagctcccagtgagacgtggcagccaggaggctgaggcccagccaagccccagatggctggcgagaggtgcttcccccgagctgagcaagacaaggacagggccgacccggtgggaggggcaggatgggaccaggagcccgggaaatgccagtcctggccctggccctggccggtctgtgtgctcccaggctgcgcccaatccgaagcctccgtgtggatgcagagcctgaagctggaggtctgggcataggcaggggtgtggggtgtgtgaggaacccccccgccccaccatcaggttctgcctgggaactcctggtcctggagctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcatgagtgtgaatgcgtgtgcgtcccctctgctgacacccctgctctggccaggccctcctctgtctcggtgtgatgtgtgtgtgcatgagtgtgaatgcgtgtgcgtcccctctgctgacacccctgctctggccaggccctcctctgtctcggtgtgtgtgtgtgcatgagtgtgaatgcgtgtgcgtcccctcttcacaggccactcctgaggagggagccccggtaaggctttaggctgctggctggttctggggttgccatgaagtcctgaaatgctattctattgctgtttcttgatgtatcgggtttcgatgttgtccattgacttcctgccctggaagaggagggtttagctcactgacaacactgctgcccctcccagccccattcttctaccataattctctcaccacttttagtccatatcagagttccccattgtattggtttctgaggctgcctgcaaattactacaagcttgctggtttgaaacattagaattgtatcctctcacggttctggaggctgaaatcagtttcaacagggcaaaacgcaggtggcggcagggccgcgctccctccggagcctctaggggaggatgcgtcctgggctcttccaggtcctcgtggcagccagcagtgcttggcttgtggcctcttcgctctgggcttcagggccgacatcctccatctccctctgctctgcctgtacgtggccttctcctctgcctggctcatcttgctctgccttcctctgataaagagaagtgtgattgcatttagggcctgtcttagtccatgcaggctgctatagccaaataccataaacggagcggcttaaaagcatcggaagcttatttctcacggttctggaagctgtgcatatggttgtggtgagggtctgctccctggttcaagaaggcatcttgttgcatcctcacatgctgaaagggtgagggagctctctggggtccctctgatcggggcacaaatcccattcgtgtggatggaatctggtgacataatcacctcccaaaggccccacttcctaatatatcaccttgggggagtagctttcaacatcggaatttggggggaatataaacattctgtctatccctgggcccacccggaaaatccagcagtcactccatctcaggatccttggactcaccgcatctacaaagttcttttttgccatggaaggtaacatttatgggttccagggattgggacccggacgtgtcttcgggggccatttttcagctgaccactgccatggtcgtctgactgttatatttgcacctctgcagcttctaacattagcctggggcagagggtctagagtatgcccttagcggcacagggttcccatgccccttctccctcctccccactgctgtcatttctaccttcccttcagcaaggcagagtgttgttaaatgaaaaatgattcaatgatacttattaaagcgcggtaaggcggactttattcaggaccatggagatagacacaggaaccgctagagtgggctcttgcagtcggggagagagactgggctcaactccgaatacagcacgggcgagtggggggtgatagccaaggagcagggtaggggccaggggatggggaattactaagagcaacatcaggggtcggggattctagctaaactcacctaacatgattctagctgaagacaggctggggtgaccagacatcaccagaggggtgatggggaggacgagcctgaccagatatcaagggtgatcagatatggagagatggggcattcgtgacttagcagagttcttgataaactggatcttacaaggaagtgggcgaaggagaaggttcaggagctggactaaagtttggtcaagcaggagagtccctgtcagtgtccactgttcaggtcctttgttgtcattgaggctttgctggcaggtggatgtccctgtgattcttggcatgctgctcaccactgtctgaccctggcccattgctgtgcctctgagccaggcggcgcctgcccatgggctagagagagcagagtggaggggcatgaccctgcacaggacagagctggacgaggcccttccagagaagtggccagccagaggccagctccacctgggccaggagcgccaggccctgggggagagggatggggacgtggccttcctgttcagagggcgggggaggctcggcctcagagtgaacatctgctgaacatacgcatcctccccttatataatgctgtctggaaaaatggtttcctgttgttgttgagataggagtcaacgggccctgcactcggtgggttggggggtggggggctggggagtggagagggtggtctttggctccaacctggggtggaaaggggcggaggtccagaggacccagccggcaagtgggttggggcaggcaggggcaggtggggttgggcaccctgctgagctgctgtcctgggccatgcctccctgacccctgcagtttggccatggtctggggtggtggccctttcactgtccccaggaggactaaggccctgatgcctctgcgtccccagggcagggcagtagggcctctacacccacctttgagggaccctgggagggtctagagcagtgtgtcccagacttcaatgtcatcagaccacctgggaacttgccaaaatgcaggttttagttcagctggtctggatggggcctggattcagcatctctaacaagctcccgggggcccccaggctgctccaggccacattttgcatagccaggctctgcaccaccatccctcaccccagccgggattctagcaccggtgggtggcccagagacgccaatcagattcttctgtggacttgaacctctccttgttcctggaaatcctgagatatttaatgaccaggggagccctctggggctctctaggccatactgtaccctgcaaggcagcctatgggggggcttcggaaaggcttgtagatgcctcctgatcctccagcttggagctggggggctgagcccccaaagacaacaagaccagttctctgtctttcttcactgtgtttctgccttgtggtatgagcaaggcatgcctagatccctgcccgctgggagctgcagcctggtgggggaggagggccgtccacaggcccccacagcagacagcagagcatctcagcgcctgagcgctgtggggacatgggacgtgcagggagccctgggcaggcgtagtccggggtggtctctcctggagggtcctgggtgacaggaaggagcagtcaaggcatcaacctgggcagatccacaggacattcaggggcacccttgtctgtccccagggccgcaggctactcccaaggcctccctgacttgaaccccagaagccagagggcaggggtggggcagggaggacaggagggacatgcagtgggggcctgctgggtccagggtcctgccctgccctgaggcaaacccagggtgttttgccctcagagctcctcccctatgcattttaaatagaagaaactgaggcacggagaggtgacccacccggtcaagtggcagggccagagcctttttttttttttttttttttttttttggagactgagtcttgctgtgttgcccaggctggagtacaatggcatgatctcggctcactgcaactccgcctcccaggttcaagcgattctcctgccttagcctcctgagtagctggggttaccggtgcgtgccaccatgcgtggctattttttttgtatttttagtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttggggggacatcctgtgacctgggtcccgaagaggtggcctttctccagctctatccaccaatggccccaggcctgtggccactgaaggcagaagcagtgggactgggtctgccccagtgggtgcctggctgaagtctccctgcacaacccttgggaggcatgctggctcctaactggcctctacccggggaacacagagttttcaactgaattggtgtttgcgcctctctgctgagctggcccatctctccatgtagcttcctgtggatggcgcagctgcagaactccagtccacagtcaggaggcacggggctgccagggcagcggaagagacccaagggcaggaacgcccgcctcagccctcttcgtatctttccctggacccagggcctcaccatggcctggcctgtcctcctagaagaatggctgaatgaatgggcagctgagggggatgctaaaggcagggaacagtaccccgagggcttcagtggctgtctggctcccagctggcctagctgcatcccagggcccctggggtgggaaggaagaggaggcagaggggccaggaacctgcaggagggtggggttccatggcagcccgcgccctgcttccactcaggacgccagccagattcatctgctgggacaccaccttaggaaggaggcacttctctgagaggccttgggaatttcccccaatccacatacacatgggcatcatgttgggagaaactgttttgcaaatacaattaaaaaggatcctcccaaagttttgcctagaaaaaaaaaatgaggctgtctattatgggggcctgcaggcatggtcatcgcattgcaggagctcctgtgggctctggtgcccctgcacccttgctcgtgaacagtggcggctgcccgttcctgtcctcagcctgcccaggggctgcgcggctccccttccagctggcgtgcgtgacctttccagctggcatttcgagtgctctctctgggcaccgctgagctccacggatccccaaggcggtcatttgtcagatggtcctggtgactcccgacatcccatcagcgtctcctgctgctaagacaattgtgtcagacaactctcagcgcctgtcttcccacctccaccgagcagcctgaatgctttactaactggggagaaatcagagcaccggatcctccacttaaacccctgttttctccttgttgtcgctccagaaggcggcaaacttggcccactctgcaccacagggaccttggcaaggaaaccttacaccatcctgaagtaggggaagggagcctcgggagggccggcgacctcccgtactcaactccatgcctgtgagatgccaggcactggtctggtgacgtggacccagcaaggacaactttgctctcgtaagatccctggtcagggggcagagagtgacccaataaagaacccacgtgtcgatgattgggaaatggtgttacaaaaaaataggacaggatggcagtgtggagtgtgatggagaagggacacccttcaccaaggtccttgtgaggaggcatcggagctaggacctggacttctggaagaaggccattccaggtggaggcagcagcaggtgcaaaggccctgaggcaggtgctgagttgaagtgtgccaaggacacagaggagatctccacggctggcacttgagtgaaggagaaatcagcggggaccggggcagtcatgtggtgggaagccgctggagggctttgggcaggcagtgacaggtctgagtcgtgtttcagagattctgtggggcagccgtgaggagcatagagaatgaggtcacaggcttgggacgcccgggctcccagcctggcatacgtgatggtgctattagtggatggtgcagcatgacccgggaagcccctgcgtggtggtgccccccggaccgggctgttgaatgctcatgggcagagctgcttctgtgtcatggagctgtcctggagtgctgagcagtggccacccagggttggccgggtgctcgagccctgagagggccggtggacctcctgtgggccccaggtcttgccgtccctgaaggctgaggcttgcagggtgcgatgctctcacagcactgctggggcagatggcggagcacagcagggcaggggcgcgtgggccggggcagctctgcagtgcgggccccctgtgtctgtctcatgctagcagggcgagggtctgggccgggcttaggctggctggccactgacttccccgagagattcttcttactcggctgcccctctactacgtgctggcctcacctccaaggactcaggcccagggttgatcctgccagggccacaacagatgtgggactggccctggtggccaattccccacccagcagaagactgccctgccctctcatccctcaggctgtgctcctgtcaggcctggtcctggaataagagccatgtcctcagagcctgtgggagcacttggtgctatgagactcgatctcatggagttgcttccttcctgggtgtcctttccctggttgagttcatctgcctggctctctgctggcaccgggcttggcactggagatcaaagcttcatgaggctggagcaggagggcccccgcttcccctaggctttaggggccagtcacccttcctggacatccaccttccccaggaacacgggttttggggaagctctctggggccctttcctgccctggcctgagggtctgtgctgggtgctgggtgtgtacagaggtgctgtctaggactcaacccaaggttgagtaggagtcgtgaaaatgctccttattttaggggaaaacagtttctcaggatgcggtattgtgttagctttagtttttttgtagatattcttaccaggttgagcacgtttctttctctgttagttgagagtttttaatttttagtcatgaatgaatcatatcatatggttttctctatcacttgatataagcatattttttttccttcttcagtctgttaatatgctgggttacactgacttttggatattgtgccagactctgcaaatccaggacaaacatgacttgtctgttgtgcactctgctgtttatacatggctggactagacttgccagtgttttgctgaggatttttgtgtctatgttcattgagggatattggtttataggttcatgagggatattggtttgtagggtttttttttttattgaactgtctttgtctggttttaatatcagggtaatgttgacctcataaaatgaatgggagaattggtgccattttttcctgagaggttagtagaattttccagtaaaaccgtctagacctggaaatttcttttttgcaggattttaaactatgaattctttttctttaatagttacagaactttttatgctatctactttgtcttgggtaagttttggtagcttatagtttttgaggaaatcatgcatttcttcaacactgatggatttatatgcatagaattgtttatactattccattatcttttttatggctgtgatgtcattagtgatatcctttttaaaaatattctgatactggtaattcatatttttttctgtttctcttcttcagtctcactagagatttatcagttgactgatctttacaaagaaccaaatttggtttcattgatcttctctattattttcatattttcagtttcattgatttttactcttatcatttcctcccttctacttgctttgggcttattttgctttttctatttgagcatgttttggtattcaattttaatttacctattgtgtttggttgtatatctttgtatagtgtttactggttgctccagggattataataaacctatgtaactcttcagagtctttttcaaatcaatattttaccacttcaagttgaatgttgagaccctgccatcatataggtccctctgtcctcccctgaatgttgttgtcttttatacacctacatacatggaaaactacatcagacagcattatcattcctctttaaaatacgcaagagcctaatctgttatattttttcaggtatttctgttgctcttcctttattcctgatgttcaaaatttctttctagcatcattttccccctgtctgaagaacttccttcagcaaccatcttagggtagatctgctggccacacattctataagttttgcttcatctgagaatgtctttatttctccttaattcttgaagtgtatttttgctggagatagaattctgggttgacagttctttttttttttttttcagcattttaacaatgttttgcacttcctttggacttcacagttttgataagaaatctgcagttatctgaaccatttttcccctataagtaatgcactgtttttctttgactgctttcaagacttttttttgtctatagttttcagagtgtgtttataacgtgtgggattgtgtttccttggatttctctcatttgaggtttgccgatctgttgaattggtaggtttatgcatttcacagaatttgagaagttttcagccattatttatccaaatatttgtttagtaatacattctttctcttctccttctgggacatgactgttagttagatctttcggtattttcccacagtctctaaggctcttggcattataaaatatttttactcgctgcagtttgaattgggtaacttctattgctctatcctcaagttcactgactcattcctctgtcatatccattctgctcttgagcctatccagtgagttcttaaagtttctgttattgtatttttcagttctaaaatttccgtttggtcctttttaaaaatatgtcttccgtttcttgctgagactatctttccattagttgccagagtttttgcccttactttatggagtatttttataatagctgctttaagatcattgtcagttaattccaacatatgtgctatctcagtcttgttatctgttggttgtatttgcctggaggagttgagattttcctggttcttggtatgccaagtaattttggactgtatcctggacactttgatattaccctatgagactttggatcttgtttaaatgctatggagaaggtcattatttttgtttgatcaggtaattaacccttgggttaattgggttccggctgcaagttccaatgtgcctgtggattgcggttcaatgtcaggtccattttcaaagcctgtgcagtcctattctgatcaatcccatgtaaacacaacccagtggcacgtctgggacctgggcattggtccacctcctaagtcagtccccagaacctatggcgtgttgtttagggtcagacccactcgtgcacggctcaagcacgagcccaggagtttctaaccaactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacgaagaaaagaaaaaggaaataggaaagaaaaatgaggtgttggcttggctctgagcattcggaaatgctttttctatccttgagctacaacaacagggcttgtctcgagctctgtctgtctgtacccagtgcccgcttctggagtttgacctgccttgtatctaggctgaggaataccagagaatgaagagtaaactctgcgggtttgctgaacctcacattctagtcttcttccccaatctgcatgctgttatttattttgcagggtcctcagctagctgctcatgaatccagtgcatttgggtggctgcaggcagtgggggatgcaggtgaggcgtgctcacaccatcctactggaacctgaaccttctcctagggacctctctatgtgttgagcggtttataatcagggagggacttctaccagcagaaatacagccataggcagatccctgctgaacaggaatttcatagagagagggagggagatcctgcccccagcaattctcacaacatgcccagagcaactgacaggggaatcaggtctcttccaccctccaggggctgcccactgcacagaggagaaaatccaatctcctccccacagcagaggaagctctgtgcagtctgcccccgcccaccactctgacctcctgtaccccacccaggcccaccactctgccctcctgtaccccacccaggcccaccactctgccctcctgtccctcgcccccgcccaccctttgctctccacactccactcacattggccttcttccctttcctcaaacatggcaggtctgttctgacctcgggtcctctgcatgtgctgttctctgtgctggagcccacttccccagatctctccatcgctgcctctttccaatcatttaggcctcagctccagtgtcatctcttccaggaagtcccccgcccccctcaacaatactctgtgctgttgtcctcacggctgcgtcactctctgtcgacttcctctttgcttgcttactgccatttgcccccccgggagatagcacccagggtctgcattcagccacaggtcgcaaatgtgaatgcacctttgtggccacatctatcggtgctgctggcaaggtggaggttgggaagccggacccactgggccacaagtcctcagggctccttcctggtccagaggacccccaggaggaggcagctctgcctccgcagagaatcttgctgcagtttgggttgtccggggccttatcactcccccgcttttttttttttttttttttttttttttgagacggtcttgctctgtcgcccagagcagctgggactacaggcgccccccaccacgcccggctaatgttttatatttttttagtagagacggggtttcactgtgttagccaggatggtctccatctcctgacctcatgatccgcccacctcagcctcccaaaatgctgggattacaggcatgagccaccgcacccggccatcacccccgtctattttcatacatgcagtggggtgagaggcagaagtcccggcttctgctcctgtgtggcttcctactcactctacactccccttcctgacgctggccagaggctggcggaagggctgtgctgggccaggactggcttgcagttcctctgcagggagtcccggagcctggggcctgagggctgccttggaagggcacccaggggcgaggtgtgcaggctgactgttcccaagcagctgggggcctgccctcgctcctctcccgggcacagcacgctgtgagcggggcatcccgcacgccctgctgccaccggctctccggctgcactccttcttcacacactggatgagaggacactgctggggcagcagggcacatggtgcaggggtcctgccctcatttgtgtcttttcccagaggatgggttgtctccaagttctgcgtcaaaactgaagttcagcatacttaagcccagtggttcacaaaggagatgcttgaaacccacttctctcccccagttactcaggtgctgcccagtggagagagatctgtgcacacagccttgtctccctgcggcatctgggcgccacagggcagccctcaagagatgcccctgtcccagtgcggggctggggaggagcccagccctgtgcgagcagatccggatccaccactcattagctgtctaatcctgaaagagtcatgtcatctcttggagcctgtttcccaatctgtaaaatgggcataatgatactgagctcacttcctttgccttcattatcttattttcaatcccttgacaactctgtaaagtaggtaatattgtgccattttagacacggaaaagcagaggtcgaaagaggccaaatagccacaagtgacagagtggggatttaagtctaaagatctcaagtttcggctgggctcaattctttccttcagcccaggatgttcagggatgacagccaggctgggcccctgagcaatgccctctgctgtctttttttttttttttttcctgggggacaggagcgagcagagcctccagaacctttgcccagatcacagtaggcggttcttgcagctgggaccagttcctcccacttggacagagtgaggagtccaggcttcactgaggccaggagggggctggccgccggctccagactggggaagcctgtgtttggggcttgtgctcagtgtgtggggacatcctccggcctctgtcctgcgggacctctccgacttttaattggctttcttctggctccgcgtagatgaagagtttttgccagagccagagccataacggtttatctgtctgctggcttgcgtttctcagactgttactgaattaagttgtatgtatgaagactcttaaataaaataatatcatcgtgtttattcggagcttggccttaaagtgcacttttgagtgtgcacatcattcttcttaaaccagggcctcctttataaggggatttatcttcactttgagaaacgtctgctaaagcctgctgtgccaaagtcctcatgcttactgctagagccacagaagtgaaggggggtctggcttgtcctcaggcagctcaaagtcagggggacggggacaaaagaccagccaaaaagtgttgcaaagacatcaatgggtgctataagaggatgctattcttttgtttctttagttttccattgtttacaattaaacattattcacaacaactgacaaaacatgattcacaataatttacattattcacaattaaaaattacttttgaacatacaaaacatatggtcattatcattgaataatgtagaaaagtattaaggagaaagcaaaaaccatgaaatcctacccttttgagatagtctctgtgagagacagaataatccttctcccaaagttgtccatgtcccagtcccgagaacctgggaataaatcaggtgacatagcaggggcagtgaaggttacagatggaagtcaggttgctaattagttgacttttaagataaggagattatcctggatggcacagtgtaatggcaaggattcttctttttttttttttttttttttgagacggagtctcactctgtcgcccaggctggagtgcagtggcataatctcaggctcactgcaagctccacctcctgggtccaagtgattctcctgcctcagcctccagagtagctgggactacaggcgcctgccaccacgcctggctaattttttgtatttttagtagagacggggtttcactgtgttagccaggatggtctccatctcctgaccttgtgatccgcccgcctcagcctcccaaagtgctgggattacaggtgtgagctggccatgacaaggattcataaaagtagaagatggaggcagaagttcagagtcagagaggggtcagtagatgctccggtgctggctttgaagatggaggagggggccacaagccaaggaatgtgggtagcctctaaaagctggaaaaaaacaaggaaacattctccttagagcttccagaaggaatgcagccctccccacaccttgattttagcccagtgagacccattgtggacttcagatctctagaactgtcagataataaatgtgtgtgtgtgtgtgtgtgtgtgtgtgtgtgtgtgtgtgtttgagttggagtcttgatctgttgcccaggctggagtgctgtggtgtgatcttggctcactgcaagctccgcctcctgggttcacaccattctcctgcctcagcctcccaagtagctgggactacaggtgcccgccaccacgcctggctaattttttgtatttttagtagagatggggtttcaccgtgttggccaggatggtctccatctcctgacctcgtgattcacccaccttggcctcccaaagtgctgggattacaggcgtgagccaccgcgcctggacaaatttgtgtttttaagccactacatttgcagtaatttgttacagctatacaaactaaccgtttttccatcttgttacatatatgtcacactcagaagtgagatcttgtcactcatgctatttgtatcaacatctttaggtttatggttgctctctcttctgccctcttgactggagcactggcttcatttattttcactctggtctataattaagaaggttgtgaacttgcttctggtggtggctttggtctcatccacaggttctgatgtgctgaattctcactgtcatcattttaaaaagatttatgattttgattccagtaacttaagagctatttagaggaatgttgaaaaaacttccgagtggttggattttaggttattaagctttgcgttgattcctagtataatccaaatgttttcagaccttagcatctctgggtttaaattgggtcttgtcagcatttatatctgcatcttgccattccagtgacaccccacccctaaccagcgcagatctcagtttcctacaagggcttgtgaatgcctccccctcaacccctctagcatttctaggcatctcccagttccgtagagcccgtccacacccctcctgccacgtgtgtattctgagcatcccaggctctgcaggtgtccctccgttcaggctgccataacaaaatatcacagactgggtgtttagaaacaacagaaatttatttctcacagttttggagtctcacatgtgagatcggggcgccagtgggtttggtgtctggtgagggctgcttcctcgctcatagctggggccttcttgctgtgtttgcacacagtggagggtgcacaagctccctgggcctctctgataagggcactaatcccattaacggggtccccaccctcatgacctcatcaccttccaaaggcccgcttcacaccatcaccttgggacaggaagagctcatctccatggaggcttggcagggccaggcctgccacagagttaggagtgaaggggacagcctgggttccccgagcctcggggaatttctgaaattgcctctgtctcctggtgtttgctcagcttctatgaatgtcaggtgggcttctgaagggagcacggaatctgcgttgcagggtcactgtggcacgaggggaccctggcctctggtgctgtggaaaccggagcagctgggggcggccagagagaggctgagcaggagggtgtggaggtccccggggccctggggaggagggacagaggccatgggcattggtgcgtgggagggagcagcagaggccagcctgctgagaagggctgtgagggaagggaggtcctgtggctggaggggaagcagagtcttcttgttcaggattgaagagacccggttctgttgttgggctgagagaggactttagagaggaggaggccgaagacgcagcaggggaggcgagaagggacttgtggagagccctgagggagctggtggtgggcagtgggttgtctcggctcagagcaagagctctccgtcctctgggattatagtggagggcgttgggggcactctgccagtgacttcatcagtaggggtggggagttggcattatgccccatgatgcaagggcccaagtcaccctggagagggaagccggggtcttgagggagggtcctgggagacatggggcctcagcgtattggggaagggaacagtcaagagaaaggggcaggctgtggggagggccttctggctggacagtactagcagggagtggggcagaagggggtccccataccaacttcacctcttggttcttggtgccgagaagcagcaatctcaggtttctgcattgccaggcaggtggggtgggaggctacggctgacaggcttgggggattcaggccaggcaggcaggggaggccgggatcaatttttgtaaatgctcccccatgcttgtaaagaatactcatttgctttcggttgtaagtcgtcagatccatccagaaatcaatccggcccatttcccgagtcaatgagtctgtgcccctctgctgtggtctaggagacctgtcacccactgggagtggccgttcgcatttccctttgacagggctgttgagccacttgtgtttctaaccatggcagatgctgcggcccttggtttgtaaagcttggtgactgtgtgctttcaccaagccttgtcaatacaacaggagtttccagtcatttagtacttgctctgagttctattttgatgatactacagacaccctgctttctgggtttgcagttttctctgtctctcttttagcatgtttcaggcatgtgttacagacggcatgccttgtttgttccatctcagtctggttgatctctaactgcaatgttaaacccattgatggttgtgttagtgataccagtggcccgtccttttttcggcctgcacctttgcatctttatgcttgacttgtcccctgtccaccctgggagcaggcaggcagctggtcttcccaggcaccaccctcctgacccacagcacgcagcagcctctctctgcccgccgcctctccctcctgccctctgcccaggccgcccctggggaccttacccactgagcccatctccacctgccttgcggtccttccttatccgagtcggatgccactggtcctctttgctgtacttgctccctgcctgtaccactgtctcccgcctcctgctttccttgctgaattgctgggtccagccccatccctcctcccttactttcctgcctccgagcaggggccccagcctcgctgaaggatctacttcgacattcctgactgctggcctctgcaggcagcatccccccttgggaccttcccgctccctgctcacccacctccttgctcacccacctccccctcctccgagcacagacaggccccggcattgcccctgcccgtcccttgagctccggctgctcccgggtcccatcattgtcagcattctcagaagcacagcccctgccgccacctcctccatggctctctggcatcacccaaagcgtctgctgaggtcccacggaccacagaggtgtggatcctgtggtcattctcctgtccccacggctcaggcctcccccatcctcctgcttcaccatcactgcatcgtccgaggcaccgccagctcctcggtttgctcttcccctgggctctgcaccttggcacgtgctgtgtggctgagcaggaccctcagtctcctggaccacagccagaaaggcatttcctcctgcagtggggcgtcctgggttggaggagccttccctcctcatggcagcctccttccacagccccacctgtctccacgcctcccttgctcccagcacaggccccactagtggtttcagcggaatatggaagggcttttgaggacgtgtgtggaaggtggccttggtggctgctcctgaatcccttccagagcctccagctcctcccaccccgactctcacttgcgggactgccccagccgccatggacggggctcctctgccctgctcagaatgttctggaccagcctgggactttgtgtcctgagtctgtggtggttgcagggaactggctcacccgtgtgcttcagggtggaaattgggctggagtgtggaagtcccatcccaaaccctagagatgggaccagcacctggactatgagagtgagggctgcctggtcgggctacagggcatgtcggatcagtcaggggcctgggacacataagggatcaacagaaaggagttgacaaaggcacaactcacagagctgcgggcaggacgagggagcttgcagggcggggaggctgggggccaccacagcgggagaaataaaaccttctgtctctctccccagccctggcttcctgtcggtgccccccttcacccagggagagccaggaggagccagtccatcaggtctgcctactgggctgtaggacagggcagaaggtgaaggggtggggagcccaacagagacccgccagcccagaacatcagcctggaaggaagggacgcagggacctggttcttctctgtgtcttttcaaagccaggtttcctttctaatccagaatctatttattcagccaggcctggtgccagatgctctcaggctctgaggatgacagacaaacccagcagcctccagtagggtgctcaaggcctggttttgaagtggaaacaatgatccatgcggccagtgggaacccgccaagttccccacaggcccgttcgcctagaggcagtagttgagagcgacaggagggcctccatgccaggagtctgcacagtgactcttccttccttctttagactgcctcagaggctgtcagcatttggggtggaaaagagttgtcctgttgagtgtatacatgacctaagtctactggagactcaatgagggaattgaaggatttttcagggaaaatgttgacatttcctgctgaccctagaaagcaagcccctccgcttggccagcaggaagtttctctggcatcaggggcaggccaccttggaagctgggcacacggggcaggggccaccctgcggatgtgggtgcagccctgcggggaagctgcagtgggggcgggggcagggcttggggtggcccttccactccccaagtctgtgggtgcccaatctccagaccaccattccggacctccacaagctgcctccttgggccacgtgggtgggtcagacttgcatgggtgctcagcatccctgggtcgggttgatcctggcaccccctagggtgggtctgctgggcagccctcggagcctggacagagcttctagccatgcacccatcttccctgttcatgggattgagtcaccaaaggaagggcattcattaaaaataattggctggctggacgtgtttctgggctgtcagctctgactgtaggctgcgtgccttcatcaacatctttctcccggttcccagtcatattttttctttttgaaagtgtctttttctgttacccaggctggagtgcagtggcagcatcttagctcactgcagcttggaccttcagggtttaggtgattctcccacctcagcctcccaagtagctgggaccacaggcatgcaccaccacacccagctaatttttaaattatttgtagagatgaggcctcactatgctggtctggaactcctgggctcaagcagtcttcctgcctcggcctcccaaaagtgctgggattgcaggccccagttcccagtcattaagtggaatgtttgagatgcacaaataccttaaaacaaaaaaacaaaaaaacaaaaaaaccttggccaggtgcggtggctcacacctgtaatctcagcattttgggaagccagggcaggcggatcacagggtcaggagttcgagaccacctagccaatgtgatgaaaccccattctactaaaaaaatacaaaaaaaaaaaaaatttagctgggtgtggtggcgtgtgcctgtaatcacagctactcgggaggctgagacacgagaatcacttgaacccaggaggtggaggttgtggtgagcccagatcatgccactgcactccagcctaggcgacagagcaagattccatcttgagaaaaaaaacaaacaaacaaaaccctaccctggaatgccaactccggtgcttgtcttgggctgggatctatggggcactggcctgttctggcctagcaatgggaggctgatgtcccacgcttgtcctgggctgtggcccggaggcgttggcacactccagtccacatgggaaggccatgttccctatctgtctagctcagcgcacggctctgactcactgcagttagcagggaaaatactcttcacattgagatgtcagttttcacttcaagcctgatttctgatccataaacaaagcctgcaagaatcagaggctgctcatgtgggagtcagctaattaatctgactttcctcaaggaaggcacaggccgctgcctcttttgtgaagattagcactttttaaggacgtgtgagtctgtcaggacaaagcaacaccaataacgttccttattttcggggagcagaggaaagtggggtcagactgtcttccccgtggacaaggaggagcggcttcaggttagcacttacaccagtgctgtgagtgagaagctgtggctgtcaccaaggtgaggtcatggctgcaggaaagacgcttcccaccctctccccccaacaacagaggatgtcccaagcccaggggaccggccagcgtagctcctgacaacctctaggaaaacaggagggcttctctttggatggcaaaactgacctcaactcacttaagcagaagacaattcaaggcaggctattggggggctggggctggaggcctggaaatggggtaccttggagggccccagccaggacctcaggaagccgtctgggcagtggtctgcactccagggtggggtgggagcttggattggccctgcttacaatgggcttctctctcagatgtatcttgcaaggagagagagtcaccttgggcaagctgactcccacccacccaggccccttcctgacagtccttctaggctgttcccaaaggcatggctggctgtccctaggatacatggggccctgggcatatatttcctgcaggactcctgtctatatagacaatttgattaaaaaatttataacaagattcatgagcccacatggggaatagcaagatgtatcaaggaagatttaggggacggggaggagaagcacgaacacatttgctcactgtctgctcagtgcttgcagagaccctcgttactgctcaggctcaggagctatctcttcctgttctttatggtcgagtgtgctgtcccagctaatttcatatttatatctcccacagctggggggtaatagcaaagctgttaccgctcacaatgtgtggctctttggaacctgtttgtgtggagatgctgtatatcttcttgccccgcattccccagccccatgtatttagtgctggttgtggcatttctcctgactccgccgcttctctctgcccccgggaatgccggcttccgttgttcccttgaaggtggttaccgtgcttcattaatgatgaccaccaatgtggatcttgcccagagtgtgcaagaaaatgtgagccatacgtcctcatctggtcgtgttaaatttaatgtttgggccaggtgtggtggctcacatctgtaatcccagcattttgggagaccaaggcagtaggattacttgagcccaggagttcaacatcagccctggcaacatagcaagacctcatttctacaaatttttttttttcttttaattagctagctgttgtggcacacgtctgtggtcccagctacttgggaggctgagttgggaggatcacttgagcccagggggtccaggctgcagtgagctgtgtttgagccactgtactgcagtgggtgacacagtaagatcctgtctctaaataaataaataaataaataaatatcgtttggacctttatagcgaagggaagaaccacacatcttgcagcctcatcttccccatcagtcctgaggctgttacttctgcactcccagaattcaacctcgtttaatggtgggcacactcccgccttccacactctgccaccagcaggcagaatgacaagagaagagggatcccagttgtgacaggcattccatccctctgcagaccagcctgggaggagagcatgatgtccagcacggcttggaggcaagagaggacacgggaagggtcgtggcattgcagggcaacagcttccctctgaaagcactccaagcaggtggatgcagccagccctggaagactgcccggaaatgacacggaacctttgagggtgtgggccaccgccctgggcaccagtgacagaggcacagagtgaaggatgtctgctgccactgcccacccctgaacaccagagcccggaggtggccccacagccgatgcaggagcccacaagtgccactcaggcttgaggcttgggcagctgtatcccagagccccgcactcattctgtctgatgtgagtgggaatcctcaaaacccacgtgtcagcatcatgctggtggctcagtcccattcacacctgtgaaggaagtcccctcctggccagtgagggtggctcgctcatcaagccactcactgagacctgaagcaacctcatagtcaacagccctagagctcctggggcatccgtggccccatgcacagggcagagggttggagagtgccctgaagggaacggcagggcccacagggcggctcaggcataggccctctgcacaagagcattgctccggctacacggttctccctggtgttcctggaacacgccaggcttgcttccttctcagggcctctgtacttgctccccgatccctggaacctaccaccttctacaggacctgctccctggacactggggatgcagtgggcgcctccactccagggaaaggcagccaatgtgaagaatggaccggccagagagcactgagggaggctggggcccagttttatttttatgtgtttaaagttttaattttgaaataactttagatctatgctgtcttggaaaaattgcaagaaaagttgcaaaaatagcatagatttcctctgtgcccttcacccagcttcctccgtatgcaacgtagaacaaggactgaaaccaggaactttgtaggttgatactaagcgttggtacttagtgtcttagttttagtctattttgtgttgctataatggaatacctgagactgggtaatttataaagaaaagaagcttatttagctcatggttctgcaggctgggaagttcaagagcatggccctggcttctggtgaggcctttttgtgctgtgtcataacgtggtggagagggtcaaagggaaagcccatgtgtgcaaagaagggaaacccagggagtgtcctgcttttataacaacccaggctcgggaactaatcaagcctctccagagcaagaattcccttgctaccttgagaacagtatcaagccactcacgagggatcggcctccatgattcagatacctcaccccaggccccaccttccaacactgccacactggggaccaaatgtcaagatgagttttggtgggaacaaaccagtcacattctaaccgtagcactccagactgcactgaattttgtcagtcttccgactcatgtccgttgtctggttcaggctccccctcaggatcccacgtggcatttagttgttgtgtctctcccgtttcctcccatctgaggtttcatgacctggatgtttttgaagaggactggtcagctgttttgtagacggtgcatccccatgggtttttctggtgtgccttgtactggcttgagcttacgtgtttctggcaggactgtcacagaagcactgtgccctccgtagggcaccacgctgggactgtcacattgggatgtccagttgtctcctattgtcagtgatgcccttcttcatttggctaaggtgttacctactgggattccactggatgccccgggagctctagggctgtgactgtgaggttttttcaggtctcagatgagtggcttgatgagcaaaccactctttcactcttttttcccattgcgatgattaaatctcccgtgggtagctgctgtgacgtgatgtgagcattctgtttcttgttatccttttgctcactaattgtagcctccacggataagtcgtacctgccgcagtcctgactgtgctgttgccgatggggtttactaccatgattttctatctcatcatttcttttacatttttagttgaattaccctgtgagaaagagctgcccttcccctcccacttatttattattcagttatttgtttctaccaatactgatctgtggatatttattttattcaatgggttctaacctattactatcatttattattgtgttcaaattgccccagatttgaccaccgaaagcaccttccagctgcctcctccatcgttccgctgtgcttgggtgtgatttcacacggggcggtgggacaggccgtctctgagcagggagtgtgggtgtgagcagagccctgcaggaggggcgcagtcctgtggcagtcagaaccagctggggggctgcagcctgctctcggggaaggcctggtatgcacaaggtcagcacctggcctggagctgccacctgctcacctgtctggtttctggtgggggccctgagatcccgggcttggcactgccggagggcggggctgtgctgcggtatggatgccgtgccgtgctgtgctgtgcaggcagggttactggacataagcctggtgtggcctttcataccctggggtgccactgtctcccagtgtgacacctggtggccttgtcccttgtgaggaccaggatctgtggggcacttgatcccatgagttcagtctccccgaatctgtagtggcatccagggagggcaggtgcgcctgagcctgcctgcattctggatacggcgcctttggtcattgctggcctcgctgctccggctctccagtgggccaaccacccacagaggggcctagggccctggcggctgctgtcctggctctagaataaatacacatcccagagtcaccagtgtgggctcaccagtgctggggccctgcccccgcccctcccccggagccaccctgggtgggtggggacacgggctgggcagtgtctgaaggcctgcagagcagcctggccacagcccagacaacctggccctcagagccctggctcttcccataaataaaccagacaggatccttcgtcagatggtatggcctgatttttgttttgggaactctggacagaaggggaagcagacagcctcgggcctggcagggctgcccgcccgggagtggcagctgggcaggcgggcagaggacggtcggcggtcagcgtgccctggatagcacagtgggccccagagatcacagcaggaaaagaagcccaattcaaaggaagcaggagtgaggcagtgcacaggctctgtgtgtgcatgaggccggaggggtcctgagaggggcctgtggcccagggacccggggagatgacagcctgtgatggaaagtgaaagggggggtcctctggctgggaaaactgcctgatctgggcagctttgcacaagcagacatggaggacatgccccactgagtctcaccatcaactctcaactgcagccccctctgggggaaccgaggctttgagagaggaaaggctgatccttgttgcacagtggagtggggggactggcgttgggcgggctgcgtcccagcctgtgctctccccatgggagttcctgtctgcccctgcttctaagggggacgtccgtcgggtagtgtgtcttccccacactgctgggagccagccaggcagctgggcccttggtgggcactggtttccctctgagcacctggcccctcctggaggagcacccgctgtgggaaggagcagaccctgcctcctgggtcctcgagactggggacctgctctccgggctgagctgccacagaaagggtattggatgctgttcaaaacacgccacacatctagaattgcataccccgtcttccaacagctgcgtagactcagccttgggatcgcccagaaaattctggggtgcagtgggcatggggagtgcccccacacgggagccttagccagcctctctgcaggaatgtgagacaccagcctcagctggctccagtcgtgggctctggagcagggctcctgctggaccgtgagagagtggcctgctgctggcggaggggtcctgaggcccgtccaccacccaccggctgtgcagcattcttgtctccctgcgcctgcactcactgccccgtgtccccatgtgagaatgcccagtttagaaggaagggtgagatgggcatcccatgtggccagccctgggcgggctcctacttccctggagtggcagctttcctccatgctggatttctggcccctggggagtgatcctggcattgaccttccggcctgtccagagtggctccccaaggaacagcccgcccagctctggccaccggaccctgccagcagcctgctccgattctgtgtggacttggcgcctggaggctgttatgggctgagtgacgccctccctagatcccccagttcctttgttgaggtcctaaactcccgtagatcaggatattggctgtatttggaggcagggtctttaaagagataattaactgaaaatgaagtcactgattcaacatgaatgactggtgtcctaagaagaagcgattaggacagaagtacacacagggggacggccatgtgaggacaggggaaagatgctgtcgacaagccaaggagagaggcctcgagagaaaccgcctctgcccacaccttaattttagagctctagcctccaggactgtgagagaataggttctgctattcaagccccggcctgtgctgccctgtgatggctgcccgagcaacctagggaaggcgccggccccgaccttttgtgggagggggtgctggcagtctacctgggcagcatctcctggtggatgtgggtgagcctgctgtgaatgctgggggacggtcctgggtccccaggccctcagttcttggagtgcagccttgcagggtttggttgctctccagggtgggtcccctggggaatctggtaaggaagcatatgttggcaactcccagacatgtgcccctgccaccccagccccctgagcagacagacccaccgtgccggctctgtctctgggagtgctggtgctcaggcgtgctggtctcccgggctggttggaggaagggaggggcggtgtgtgcagacctccaaggaggcagggaggctggcagggaacagctgtgcaaaggtgttaggttccagctggtgtgggcaggtgccagcccagggaagggcctgtcgacagggtcttttttttttttttttttttttgagacaagagtctctcactctgtagcccaagctggagtgcagcggtgcgatcttagctcattgcaacctccgccttctgggctcaagcgattctcatgcctcagcctcccgagtagctgggactacagacgcccaccaccatgtcccgctaatttgttgtattttggtagagacagggtttcaccatgttgcccaggatggtctcaaactcctgacctcaggtgatccgcctgcctcggcctcccaaagtgctaggattataggcgtgagccaccgtgcccggcctgttggcaggatcttgaatggggaagttggaccttattccatgagctctcctccaccacacgtctcaaggccacaatctgctgtggtccagctggtgagacatggaagctcagaaagaaaaatcttgctttttgatagtttggcaaatgttcctgcagcacgagtcatttttcttctttagtagagagcgccctgttatttatgtgaatgttaatttgtgactggggacgttccccgacgtgggcttcatgctgaacgagacctgggaaatgtcagccagagaatctggccgggacgagtgtcagttctcgtcacaaataggcaggcctgttgcagtcccagagtctgggtctgacccactgacctctgtgtcctggctgggtctggctggccagctctgtttcctggaggctaccccggcattggtgtgtgcaggagccatggagatgggggagctggctgcagagggctgagtgtgggacattctggacaggccaggtcccgagggagccactcaagcgttgcttgatttagcagaaggccgcctggctggcccctgcgctggccccgtgaggcattcttgtcggcatcttgtttattccattttcccccttatctttctctctgtgctctccccctttccgtctctcctgtcttcacatgaattgtctgttttgctatatgccctttgtaaaaatgtaaaacaaaaaaaatacagaaaatattaataaaaagtgaaactcacccccgatcgtaacactgctgaccctttgttacgcgtttcctaacagctgtcatgccatgatcatcatgatggtgatggtgctgccagtcggctgatttatcacgtgctgtgcccagtgctagagacgcggtatctcgcttagccctcacatcagccatggaaaccctgttattatctccattcaaccctgcagacactgtccacagagaggccactcagtcagaggtgaagtaaacatttgaatcgaggcagagtgactcggaggccacatgcttaattattagactgtgctgacgtttggcacagagatatacatgattttacgtaaggaggtcatgctgcagctgggcttgccgccttcttcggtcaccaatatgtcatgggtgtgtctgttccttaagtggtcaaaaaatctgagaaactcttttagcctagcataaatctgtaaattttgtaaaattattttgcagggcatagagtgttattgaaataatctgactggctgggaacggtggttcacacctgtaatcccagcactttgggaggccgaggtgggcggatcacctgaggtcaggagttcgagaccagcctggccaacatggcgaaaccccgtctctactaaaaatgcaaaaattagccaggcatggtgttgtgcacctgtaatcccagctacttgggaggctgaggcaggagaattgcttgaacctgggaggcagaggtctcagtgaactgagctcaggccactgtactccactccagcctgggtgacagaacaagacactgtctccaaaataataataataataatctgaccatttattgtttttgttgtctgtttttgtttgtttgtttgtttttgagatggagtctcactctgttgcccagaatggagtgcagtgatgcaatctcggctcactgcaacctcagcctcctgggttcaagcaattctcctgcctcagcctcccaagcagctgggaccacaggcgcgtaccaccaagcccggctaatttttgggtttttagtagagacggggtttcaccatattggccaggctggtcttgaactcctggccttgtgatccattcgcctcgtcctcccaaagtgctgggattatggacgtgagccactgcgcccggttggattttgggtttttttgagacagggtatctctctgtctcccaggctggagtctccaaaataataataataataataatctgaccatttattgttttgttttgtttgtttagttttaggttttggtttttttgagtcagggtctgtctctgtctcccaggctggagtgcagtgacatgatctcggctcactgtaactctgcctcctgggttcaagtgattctcccgcctcagcctcctgagtagctgggattacaggtgtgcaccaccacgtctggctaattttgtatttttaggacagatggggtttcaccatgttggccagcctggtctcaaattcctaactgcctcagcctcccagagttctgggatcacatcatgcccagcctacatttattgttatatatttgttcttacttctgtcatctaatttatgttttctgtttttctggatttttttttttttttttttttttgctgtttttctagtctaccatattttctatatggtctgccttcagtcatttggaaggtatacattagttttactagttgtgacttttctaattttgagtagaattcttcagcttgtatctactgattttagaaacttaccagtaactgttgatgctaactgaagattctgaagattaggaaacgagtgcaattaaactgtaattccttttttcttcctctactctttgtctgattgttgtgggcttgtttggcaattttttgcctgcccccatttattaaagttaaattatgaatagtttatatattacatagctttttttttccagaatatatgctaaatgtcttctgatttgtaaccctcattatccctgtagcatagatgcagagggcaattccgctatttcgacctgtgatttccccacttgccaggtgtctcagttttaaagtcaagtccaggctgcgtaaagtggcaggtggggggtgctggggagggatgccaagcagaactgagacagacgctctcgagggcattctctagcagcagggttgaagccatccctctgtgcaccctctcccagggcccagagttgctcacagtggctcacctggttagttgatagacttagggctcccatctcaagatgacatggttttaccgtgttagccaggatggtctcaatctcctgacctcgtgatccgcctgcctcagcctcccaaagtgctgggattacagggtgtgagccaccatgcctgaccaagcccttggtttctaatgcagagtttctttgtaggccaatgtttcctaaacattggcctaggaggtgaactaatgggtaccaaacatgactccagaatgcatttaattctatcaaatcccagctagctttgtggcagaaattgacaagctgatcctaaaattcatacagaaatacaagggatccagactaaccaaaatgctattgaggagaagaacagaggaagggctcatgctttgtaattctaagacttactacaaagctgtagtaatcaagactgtgtggtgttggcagaaggatagacatatagattggtagaatagaactgagagtttggaaatacatcctcatattgattcttgacaaaggtccaagacaagtcagtgggggaaagaatggtcttttcaacaaatggtgttggcacacctggatatccacatatggaaaaatgaagttggaccccttcctcacaccatacacaaatattaactgtaaatggatggatcatagatctacatgtaagagctaaaactatagaactcttaaataatgtaggagtaaatctttgttactttggattaggcaaagtcttagatatgacaccagaagcacaagtggacaaaagaaaaaaataggtgaactggacttcaagaaagtccttcatgacttcagtggacactaataagaaagttgaaaagacagcccacagaacaagagaaaatattcataaattgtatatctaataagggatttgtgtctagaatatataaagagctcttacaggtcaataaaaagaaaatggtcttattaaaaatagggaaagtatctgaatggatgtttctccaaagttaaataaatgacctataagctcatgaaaagatgcttagcatcattagttgtcagggaaatgcaagccgaagcatgatgggacaccacttcacacctgctggatagctagagtcaaagagcctaagaataatgagtattggtggggatgaggggaaattgaaccctcacacactgctgggggcactgagaatggtccagcccctgtagaggacagtctggcacagttactgtatgacccagtaattccactttgagaggaatgaaaacacatgtccacacaaaaacttgtccacagatgttcatagcagcattatgcataggagccaaaaaccaacaacccacatgtccatcaactggcaaatggataaataaaatgtggtatatacatgtgatggggtattatttgacaataaaagaggaatgaaatactgctatatgctacaccatggatgaaccttgaaaacatactaagtgaaggaagccagtcacaaaaggccacatagcatgtgattccacgtatatgaaatgtccagaataggccaattcatagagacagaatgtagattagtggttgcccagggctgggttggggaggagaggttggggaaaacatggggagtgactgccaatgtgtacggggtttctttttggggtgatgaaaatgttctaaaatcaatagtggttatggttgaattgttcactttcagcatatagtttagatggctgagatgtatggaatggtaatcacagcaccataaagctgttatatattaaaaagcattgaactggccgggcgccatggcttatgcctgtaatcccagcactttgtgaggccgaggcaggtggatcacctgaggtcaggagtttgagaccagcctggccaacatggtgaaaccccatctctactagaaatacaaaaattagctggatgtggtggtgtgtaccagtaatcccagttacttgggaggctgaggcaggagaatcgcttaaaaatgggaggcagagtttgcagtgagctgaggttgtgccactgcactccagcctgggtgacagagcgagactctgtctcaaaaaaagaagaaaaaaagcattgaactttataatgaaaaatgattcccttttcagttgcattttaaactctctggttgagtcgaggggagtctcagtttggtgctgacagatctttaccagctctctgctacttactgacctctataacaagagagaagggcagtggtgtaggctttgaggtgcaaatagaagcccggagagagaggaagacactgggggtgcgcccagggacagagggctgctgggaccccatggaaggccttgcgtgccatgggacggccttggcctttattttacaggagtgggtttctggtttttggtttggttctttctccttggtcctagtagagttttagaaggatgatcggtacctgccaacgtgtgcggggtttctttttggggtgatgaataaacaggataagcagtaattcataggttacgtagtccagctcctcagtttgcagatgagggaactgggggcctgcaagggggcaggactggccatgaccgcattggaaaccagggcccctggctcagcgtccagtgcttactctccctgcctgcctcgccccccaccctgcccttcaaagtggagtctagctttccttagagcctcgctgggcatgtgactgtcggggctccttggtcctgttggaaattggctccggccagcttaggccaaaaaagagactttctggagtaaaggtctgtagggcctgaaaccaggtccagggaaggttagagtggccaagcaaagtcatcaggttctgtggagctcagaggcaactctgttgtggtcactgtgctcagcagaaccctggaaggcccagctccagccatagctccaagacagagccctagacaaggggtcgctctccaagaggaaggacgggagtggctggcacctggcgaggatcccatgagacagaggaggagctggtggagatgcgggtgaggacagctgtttcctaaccccatggacagctcctgcccgctggcgtcccttttggaaaagtggaaaagtcagtgtgtgaaatcctctgggatgctgaactgtaaaggagcccccagtggtgaggaccgagtggctcaaatcccactcgatacttcccactcctgggactgtccagtggtgaggacggagtggctcaaatcccactcaatgacacttcccactcctgggactgttcagtagtgaggggtccagcccccttccctgaaagctcccaaggttgttagagacctccctggggagctgggagaggcaagagagtgcccgagcaggctctgagaggaggcgccctgggaactgcaggcactgtgcagctctccctgtgagaccgtcattccaccaggcagctgtcacagcaggggaggctgcctggccattgccccgttgtccagcagatctcccaggttcattaccaaaaggaagatggggagaaagaatcttggagttagaatactttcaggaatgggaatcttagcagatgccagcatctgggggactcttggcaaggtgcgtgctgtgtgtgtatttcggagggaggtgagtttgagggcaacagggacttgcagccttgtcccttggcaaagtctgggtccctctgtgcatggacctgtgtgcttcctatgctttgtgccttctatgcttgattgttgccactgcaaccttggcacacacctgacagtgtttatgctggaggttgacagggttgagtgacagaccaggtcccagtcatacacaggtggggggctgctgatggctgcagctgtggcttccatgggaaggggcagtgggaaccagccagcctgggtgctctgcagaaggaaacaggatgcatgcttgtgtttcctgtgaacccctaacttccaggctgtctgtggttgaatacttaaaaattcagagtaatagaggagagctgttaagcctttggatctttataaatttttaacatctagttgccatttctagtaactactttaccatcaatccaactgcaaaggagcaggttctatagaaggaagaggcagggcaggcgttgtgtaactcaccaggatctgaatgccggcaacttgacttgatgacccgggtactaccaggctctgggcccctgcggtggcacctgaaggtcagggacagagccctccccatgatcctctctctgtcccccaggggagaacctggctgggtttgccagacatccacagacttcaagagcagagcgggactcacacttagagccaggtcggggtaccaacctttctgtaagaccccaggctggacagctgtggggttggacagacaggccaccagcaggctcccaactgagtgcttttcagcctagtgtgcttctggagtttctttaatatttattgagtggggagaggaaactgattctaattaataaaaattacatgtaaaaacagatacacttgacactggcagcaggaaaatcaaagtcccggaaaaaaatgcagcaaaacatagctcacattttgtgctttgctctcctgtcaattttcttctgtgtgttttagacagatcattcctgggatgcatatactgaagtgtttgaaaatcagggaataaaatgatctccacttcttccgtgaagtgccccccgccccgagcattattctggccagcggtcttggcaggacgtcagctgatggtcctgggggggtcagcctttggtctcgggggggtcagcctttggtctcgcggggggtcagcctttggtctcgggggcggtcagcctttggtctcgggggcggtcagcctttggtctcgggggggtcagcctttggtctcgggggggtcagcctttggtctcgggggggtgtcagcctttggtctcacgggggggtcagcctttggtctcagggggggtcagcctttggtctcggggggggttcagcctttggtctcggggggggtcagcctttggtctcgcgggggggtcagcctttggtctcgggggcggtcagcctttggtctcggggggtgtcagcctttggtctcgggggggttcagcctttggtctcgcgggggggtcagcctttggtctcgggggtgtcagcctttggtctctggggggtgtcagcctttggtctcgggggggtcagcctttggtctctggggggtgtcagcctttggtctcgggtggggggtcagcctttggtctcgcgggggggtcagcctttggtctcgggggggtcagcctttggtctctggggggtgtcagcctttggtctcgggtggggggtcagcctttggtctcgggggggggggtcagcctttggtctcgggggcggtcagcctttggtctcgcggggggtcagcctttggtctcggggggggggtcagcctttggtctcgggggggtcagccctttggtctcggggcaggtgccaccatgttcatcgtccagcatgcgttgtgcgcatcgcacggtggtcaacagagacgggcggggctgtgaggagcatgttgaacgtctgtgttggagaatgccaccgcttggaggcttctggctgtgtgaggaagcctgagcccaggccctgcttcagatggaccccagtgtgctcctgtgccctccgaggagtcgcctgcaggggtgcccttccaggaggcaaggcccagggcagcatcagatggagctagtgctgttggctcagcccagtgattgtcctcagggaggcagccagggaggggagcctgacccctgctggtcagggagaccccaaactgtcccccgggttactccggccagagagtactgcccttccccaggctgagcctggcctcattgtcacactaggtccctccagaataaccccagggcctcaggcctgtggcatcgatggctcccgacctgggctgcaagttcccccagaagatggagctgccataaggggtcctcatgccccagtgtcctgccctaattggctcaatcggcccagtctggcccagggacctgtctgggagatgccctttccgtgtaggtgtgagttctgatccctagaacctgtgtgtccccagcagcctgtctgcccatctaggcctcggtttcctcatttggaaagcaagctggctggatgaaatcacttgggtggaggcgtggcctggttctcagtgtctcccaggctgcatgtgctcctgtgtgagtgtgcacgggaaatgaccggcctcatgtacagacgagtcactggacgcttggggagcttgacaccttgcctgaggtcacctggccagatagaaagggtgccaggaagtcagaacttcacgctccaggacagcttgcccgctgccgccccccagggttaattcctgcacttcatccaatgagtttcagtcataagatggatttgaggcaccagccttctccacaccacgcaccgggaccatcagtgctggaccctcccaactcctgcactggtaaacacactgcccctgtgccagtggacaggcctggctgtgttcttcccgcctgcctgctcggtgcctcccttgggggacgtggcctgcagctttggggtcatcggttcgctcattccacaggcatctgctgagtcttcgccaggcctggttgagccctgagacccagggatgagtcagaagcgtggggcctgcagggttcccaccccctcttccgctctcctcccacagccctgctgacctccttctccgacctcggtcttgccctggtaactctggttaccactgcctcctaggcctcttccccagaagcccaggatgcctgagcccagagggtcctgcgccccttgcccttcttctcatgcccctcggagaatggcacccactttgccggccacccaccaggaccctgaattacttttctgcggctgctgtaaggaaccacttaaaacagcaggaattcgttctctcacagttctgaggccggacgtccgaagtcggtataacctgacccaaatccaggcatcggcagggctgcgctccctctggagactctgggggaggacactttctggcctctgccagctcctgggggctgccagcattccttggcttgaggccacatcgctccaatctccaaagctggcatctggcatcctccctgtctgcccatggcctcgtcctctgcgcatctgcctaatccccctccactccccggcataaggaagtgggcaaggactgcattcagggcccagccagccccagagctgacctgatcacacccgcagagtctctttccaccatgtccactaccctcacagctgccagggatgggggcctgggtaactttgggggccggttcttcagccacagacctggaagcccaccaggtgcttcctcctccctcccatctcagccggctctaccctaccacgtcctgtccatttcgctcctcacctccttcatacctgccactcgtccttgtctctcatgctcccgtctggaccattacccctctcccaggtgcctgtaacaccttctccccaggaccccagacccatttttgttccgcagcccattccccctgccgcagccaccatgcttctgaactggaatcagatcaaggctccccccagaagccctgggctgcctacaatctccctcaccagccccctgagtgatgggccaccgggcaccgtgcccttgatgctcctgtccacccacctggtcagctcttcccaccagctgtgctccgtccacctccccggccatggcatgtgcggtttcccccatatggagcactggtcctctctctgactctttgcctggccagcacaaagggattgggtgggtttgggtagatgtcacctcctgccggaggcatccttcattctggagccaggcctgatgctgggctctgtgttcctccaggccctgcacctccaccagcccctgcctggcacatcagcttcccgagggcccaggctgagtgcgccgggaggcatctccagcctccctcgctacacttgaggctaggggcagccgcccagcaggccctggggggcactgactgcatctcggtctgcagaggctcccagccagcaacaggatggggctcaccgagcacctggggtcagggagaaggaggggcagcccgtgcgccaccgtgcccccccacaaccaagatgatgatatggcagaggccatcatgaggttactttggggggggtgtggtttccgcacatccagatggcaggtgccgggggctgcccaccagagggcacactcctaactggacaggggaccccggccagcgccagctaagctggagtgtcgatgggtgctggaaatgccagcttttctgattttcaagagagtctggaaatctggtcgtttatgtgaactctcctgtttcttaagtttggcaacaaattcaagcttttaaaatcccctgcatgggtcataagcttgtgatctgaaggaaacactctgaaggctggacacagtgtgcacttccagtgtgagaccttggtttatggataatggaccagaagataaaagtgtaggagctggagttgtcatgggatgggtggacctgatggtgccagcaggctggatggcagggtatggcaggggagggcagggtatggcaggggagggcaggctggatggcaggggagggcaggagacgtgaggggggctgaatcaggccttgaagggggaacacaggtttaccagatggccgagctggggatggggtggtggggtgggagaatggggattcctgagttggcagcatggggttcaggggctgggtggctcggcagggtgcacccagcccagtgagaagcatggggtggtgcaagccgcggtctgggagggtggggcaggccaagagcctgaatgccagcatatagagcagcctgagtcccaacggaaatgaggacccagcgaggagtttgtagtcagggagggtgctggctggcctagggggtcaggggcagcagttcagctgcctgtagagtctgggctggtggctgacacagagagcaggagagacagttggggggcagtagggactggagccagttgcaggggcatgtgttccatccaagacccgctgtggtcagggcctgcgtttccaaggaaagctgggattccatgttcaagacatgaaatctcatcattctgagtgttagcttcagagctttaaaaatattgtttggcccagatggaacatgtgtgtgggcagattcaatccccggctggctgttttgacctttgtcttggactctgggctcctgggagtgggggcagcacttggcccatattgatgcactttggtggatgccctcctggggacacgcacaggcccacagctgcccttgaatgtctccctgcttctctggacggttttgactttataaacacagtaacttttctgaaagcagacagggttggtgtataggggtggagatgacccagacagaggcccctttcctagacagggtgggcggcggggggcggcctctgggaccacatgttcataccctccggccagcccagggttcaagctgagcaccagctggggtgctgggcagggtcttcaggtgggaggtactccctgagggggtctcctcgctgttccccttccttggtcttttgtgtgctggaaatctgatcctgttgtctttgtcccgcaggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggtgaggctactgcaggtgggcaggctgtgtggagagccctctgaggccctggtccccaggggagcatcccagagactcaggcagctctccacagaccagcttggctgctgaggctgagccccggtctcagtggctcagaaatgggccagctgcctggctgacggcagggcgtagcagggctgctggggctggggcctctgttctgggtgcatgtgggtgacaagcagcccagacacctctgccttcatgtctggggcctccatggtggactatgaaggctgtccaagggcccatcttctgttgcctaaaggcaagcaagtgtcgtggagcggggcgggggcccccggccaggcctgagtccagtgcctgcgtctctgagtctgtgcctgtgaagaggcctccagagccccagacagcgcctctcctgctctgtgctgccatggtccctgggagggtgcctgtggtaggtcccaaccctcacctggctgctcagggagaaaggccctgcatgctctttctggatccctggaggcatgtgccctacaaggactctggaggtgctcccagcagcctcagcagtctctgcacagactcatgggcgtctgtctttttcaactcagaacccacgtgtgccctgggcccagaaacgtgaaaggagctgccaggcggccatggtgacagtccatgactgtcgcctcagatctggcctcactgtgccagcccacacctcccagcatcccccagtctctggtcctggattgtggtgaagccagggttggtgtctgatgtggttctgcaggcccatagttctcagggtcccccgtgtggtcagggactcctggcctgtgcttggctcttgctgggagagtgggaagctgcgagctcagccctcagcctctggtcaggacccctgggtgaggagagtctggagtctggggcccaggatcgggcacacctgcacgttcacagcgagtgctccaggggcctgggctgggccagcccccgtgctgtgatttactaaggtactcccgtcactccatagcagccccgcctcatttactgtaggtctgtctgacttcctagcttgacagaaaaattgggtacagcctggcaggcatacttctaatttcatgaaacggcatcagatacctttgcaaaggaattgttccatcaggaagcccaatgtactctggagccaatcagtgcaaccggtggccccttgttccttggtgacaaatcagcgtctgctatgctgcagacagccgggccactgggtactgcctgcccagccttttccagctgtggtctcagcctcgacttatccccacccttggactattttgcagggaaggaaggaggagtaatctaggagggccagcgtggaaggggctgagcgagtgctccagacccgggggcagggccccagctttgctccttgctagctagctgctgtcgggcaagcccagtggcattagcaacccctgtgtccccgagagctcaggggctggtcacttgtgctgtgggcttggtgcttctggctggcctctcctggaagattcagggtggttctgggggcctctgctcaggcgaggtgagctggccacgtgcccttggccatgtctctgatcccagattccatatggtgcttgtcttcctgaacatggcagcccttcccccacagcctggccggccttgccttattttctgggcttctgctggtgtttggcatcttctgctgaatcctccctccacccccacccccaatccacatatctttaatgagaacttgaaattcagaacacaggaaaggaatttcaatctcagaataagcccagaaaccattggccttagaagacgctgggtgaggccagctgccaggtcaggggtgaggctgggctggaaggtgggggtttggtaatgggctgtcggggaggaggtgagcctgtccagccttagctccaggcctggggcccaggctgtggatgtgagcgtgggcctggggctataggtctggatcccagaacttggggctggggccaagtcccctttgcttgatgttcctgtctggtgtcagcagaccctgcatgaggggctcgggccttcagtgagctagctcccacgccatgcacctaatcgttcccacgtggccctgggctgagatcgacacactgactggaagggcaccaggcccagtgagtgccggagctgggtggagggcccacggtgacctcaggcgtccagctttccatctgcctgggccttttcagggcccagagtggcaactgggagatacataaaagctgtgtcctgtggccaggcatagtgaggggcacagcctgcctggcacacaactccaggacctgggtgcgggtgtgtgtgtatgtgtgtgtgtgtataggggaccctttcttccagtgaattctgagggaaccctgatatatcagtgtggccctggcagaagctggcaggaggtgctggctggcagtttcttcctgcctccccaaaagcaacgtctggaagtgggtgtgaagcaccctgctatttatgttctgccggggaaggtgacacacctgccctgggtgtcccagtggggggtgggcatctgtctgggtggcaggatatccctgcagcgtcaggggtgcctccttttcaggatgtcctgttttccccgagaagcccacgggctgctcagggtgatctcggggactcatggagcctcagggaatcattttcactaatagtctctgtcatccaagatcagttgctggattgcagattgcctgggggaaacggatagaaaatgacggttttaaagcatttcacagacaggccagggatgagtgtgtgcactgggcagcttaggcaacacccgggagaggatgttattaggaggggcaaggggtgagggagcggggagggtccttttctctcctccctggccatgctggccttggcagaagggtcctgctcagtgctgctggcctgggaacctggccaggaccggaggccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgtaagtccaataaacctctttcttttgtaagttgcccagtctcgggtatgtctttatcagcattgtgaaaacggactaatacaaatgcctctctcacagctctgtgggccagaagtctgaaatgaatctcactgagccaagatcaagggtggacagggctgtgctccctccagaggctccaggggagaatctgtttctggcccatccccgctcctgggggctgccagcctcccttggcttgtggctgcatcatgccaatctctgcccccgggtcatgtcgccccctcctcttctgacgtgtccctgtgcttccctcttgcaaggatgccttgattacatttaggactcacccgagtaatccaggacaggcttctcatctcaagagccttactgcaagcacatctgcaaagccctttcttcccatagaaggtacccgtctcaggttgcagggatcaggatccagcatctttgggggcaccatgcagccagctacaggatgtgaatggccctcacgtacaaggctggccatgcagtgcacagcacacccgggaggcgcccgtctgggtcacgcggaggagcagcactgtaggcttcacttaggcctccccagggcatatagcccagaggcacagcccaggcaggccctggtcctgctgcctccctcactggaccctccaccctgtcgtgtgggagctcttccctgcatgtctaagtgccagtctcagcctggcagtcctcccccaccgcccgcgttaagggacctggagcggctgactccaagaccacgtgcacagagaagccaaccctgtgctgacactgagggcctgtcttagcttcccagagactgaccttgggactctgtgaaggttgccacacagtgagaaagaccccgagtcacgtgttgagcatgtggtctctgtttcagacacacagtgccatttgcagaaagacaagagctgcaaactcagagcctgcagggcctggcaggcaatgccaacaaggacagcagtggaggaaaaaaagataattgcacccacccttggcctggctttcatttctctccttttgatggaaacgtggagaccaagaatacatctccactaaaaagaaacagcagtgggaatgcagccacacgtggtgtccagccctggccttgccatgggcacagggcgtctgggaggccctgcaaggagggacagaccctcctcaactcccttgacctcaatttggtagaagttgggtctggtgcagctgaacatcctatcaagaaaatccagacatcagactttttatgtgaactttcctgatgttaaaatgtggcttaaaatttctggaatgagaggatgaactgagaaggctccaggaatccagccacggcgctgagctcagtgagtcggcaacagctggcttggcagggcccaggccgacccgggtacgagagacagcccctatcaccatgcgaaaggaccaggcctcaggggtctggggagtcactcaggaagtgcctggttggagacacagagacaggtcctggcacaaggacgctggccaggtccagggctcagccagcaaatccagacaaagccctctttccacagaagcctccacatcagctctctgcctccagccctgggccctgcacacccagtgggagctgtcatgcctggggtcccctcccgtgctcactatatagaccaaacaaaacacggtcccccattggctacccatgctttctgtgatgcagaggtagaagcatcttctgccctcctctgtgggctgctctcctggggctcgccccggcctggccttgggacagaggaggggcaggtgcttcccatcctggggaactgctaccaggctgctgtgcacacaccctgctgggctgaaggaagagaagtcagacagcaacgtgccagtgaccttggctgcctccaccccagacaccgccggtgccaagcctctgcctgctgctgtcaggctgcagcatcctccctgacgggcagacgaggcacgccaccacgggagcctctcagcctcgctgcaccaaggaaggccctccaggagacagaggacaagcgccggcactgggcagctcctccatgtggctgagcgtggctgccacctgcagcccacagccagcccttccccaccaggccaggaagagcccctcctgacccacagtctccaccctgtgactttgccttgagttgggtaggagttttccaggccgcaggggatcctgggggaagagtgggcggcgggggtgggggcggacctcaggcatgacagttccccctgggtgtgcagagcccagggctggaggcagagagctgtggggcagcctccatggaagcagcagccttgaatgacccaaggtggggatggcgccctccagtctcacaaagagttgagtgtttcagcaagctcgtactggttgcagtgtgagggaggctggtgggggaggctggagcaatggcacaggagagagagaggagctctgttctgtcagaccacaggactggggagcaggcgagactcatccattcagtggcgagcagatagccagccccactgacacagcggatgtgaggcttggcccaggtgggggctggggggcccaggatggggcaggagggccgtgtgctttgttggggggtgccaatttgctgaatgccaggtcagagagcctttctgccctgtagctgtcgacgtccatctcagcttcctgtggctgctgtaccaggttacccacaccttaatggcttaaaacagcacacctgcattcctcacagttcgggagctcagaactctgaaataggattttaggggctaagatcaaggtgctggcagggctggttccttcgggaggccccagggcagaatccattcctggcccctcccagctcctgggggctgttggcgttccttggcttgtggcaacattgctgcagtctctgcctccctggtcacgtggcttctcctcttctatagccagctctccctcttagaaggacacttgtgataacatttagggcccgctgggaccatccaggttactttccccatctcaagacccctgatttaaacacatttgcaaagtctcttctgccatataaggtaatgctcacgagttttgggggattaggacatggacgtccgggggtcatgattcagctgacatgtctaagtgttgaaccttgggtcctaagggagaatggagagagggctttggctggatttgcagggtgagccctggacctggccagcgtcttgtgcccagacctgtctctgtgtctccaaccgggcacttcccaagtgactccccagacccctgaggccagggcctctggcgtggtgataggtgctctctctcataccctggtcagcctgggccctgccaagccactgttgccgactcactgagttcagcgcctcggcgctggatccctggagtcttctcagctcatcctctctttccaccctggagctgagcctgcagcccaggccccgggaaacccagggagaagcactgattgtgaaacccgaggcggctccgggaggcgtgcttcagggctgagcgcacccttggcagacgccgcggcgctcctgtcctcgtgcagaccgggcccttgggatggctgttggagatgccagcgcggtgatgtggcccacgcggaaggggtgggcgggggccggcgctgggaaagccgaggctgcacattctccgaggctggagttgcctggggtcagccggggagagcaggaggggccagctcccgggcctggctggctctctggctggagtctgctgctcagagcgctgccctgtgggtgcttcccaccccctgggctgtgaaggcagaagcgaggcttgcagccccagcgagggctgggccccccttattccacagtggagacgtgccagggtgtgctccccctccacggcgtctgggcctggcactccgcctgacagcccccacgtgcgcagcaactcccctgtgcctccgacataaatttagtccctgagtctcaggcttgcccttcccccgccacctctcccctcccgacatggtttctggttcaggggtggagccgaccaggtaaatgtggctggcaagggcctggatctttggtggagcaccgtgggcaggtgacaagcctgacccggaggatggtggccttggccctggcttggctgcagccccaactcgagtgcaggggacagttctggaagaccggccagtggttctgaggagctgcattagggctgctcccacagatgcttccagcactaggtgggtgagtggggtgggcagcgggcagtttggtgcagggttcagtgtgctcagccccacccggcatgctgctgttggtgcaggggtcagtgtgctcagccccgcccggcatgctgctgttggtgcaggggtcagcgctggtgcaggggtcagcgcgctcagctccgcccagcatgctgctgttggtgcaggggtcagtgtgctcagctccacccgacatgctgttgttctggctcactaaggggcccagagcagctcacccagcccctcaggatctcagaacctgggtgctgagatctccactgtacctgggtgcagtggcacaggggctgctggaattacgcagggcacagggcgcctgcccagtgctcactgcgacacttgctctccgtcccctttccctcctctgcctcgccatcttccacagacacagtgaattgatactttctttccttcccttggatctgtgttgggaatgtcctccaaagagcttttcgggttttgcacaaggtaacagtccctggcatgcagacagtacacggctcaggggtgaagctgtgatctgctcacgggggcatctggcgtttgatcagcaactgtgggctgggcatgccccctcttttcaggtccccagcatggcagaggcaggcttctgggagagaggcatgtgtccagggcatcttttcatgtctgtgacatctgtgccttggatgtaggagcctgctggctggggtgaagtttgggcaaggagcagtgggacctgcttgggacccaggtgaggcttccttcatgccctggctgccccatggatgacggtgaaagagacatgggcaccctgcataatggggacaaagggactgcatcccatagtgggtccctagacagaggcctcttggggatagagaggggtggggcgacaggtgagaggcgttgggtaccagcatcagggctgcagaggcagctgtagggacatctgaaggggacaggaagctcttccccagcagcagcgaggacaggcctggctcagaaactgcatttgggtccgaggtccaaactctgccagtttgtgccagccggaggcctctgaccacaggccccatctcctctcagaattctctgcaggttggcagacacttcagccagctccaagcctgaaatattttctataaaaatttccaattttctttgacccgtttctctttgaaattaatcctaggcagcgctgtgctctgggccctgaaggagctctgagcggggaaaggtcgcgcagtcagatgggcgtgctggcgtctgtcttctctctctcctgctctctggcttcatttttctctccttctgtctcaccttctttcgtgtgcctgtgcacacacacgtttgggacaagggctggattcttcggctgggatgtctctcagagctcttgacttggtccctttggctggggcttgccgtgaggtgtgggctgcgccacgagcacagctggtagagaacccggccaggagcgcagctcacgcctcccacgcctcccatcccaaactgtcggcacacccagagagagcctgcaggacaggacaggaggtgacctgggcactgggcctgtgtggagaggtggctggtgcgctggtctggttgggaaaaggccgggcacctgaatgccatgcgggttcattaatgctcaataataatgctgctccccaaatcatgggggaataatgctgctccccaaatcatgggggaataatgctgctccccaaatcatgggggaataatactgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatactgctccccaaatcatgggggaataatactgctccccaaatcatgggggaataatagcattagcagctctactgcttagggggagactgaggctcagagagggcaccttgcctgctgccacaagtgtattttcctgcattcactcgtcacgttcttgctatgtgtccaccatgtgtctgacaggactgggtgctggggctgtagcagcggaggaacccgatcgagtccctgttctctgggctcacagccccgcaggggagacctggtgagcagatgctcgcagacagtggagaatcctgtgaacaaagtaaaacggggtgaaagggcagcgtgagaaggcaggtaagggagggaggcgccccaggttggtgatgatgggaaagcccagccctgggaagggtgttccaggcagagggaacagcacatgcaggagccctgaggctggagttaccgcagcgtgaccaaggggcagaaggaagagctagtacctggaactgaggacgtaatgggggagtgggaggcgtgcagggccgggagggatgggtggcactcatcgctttgaagggacggtcacggtacggggtgagaattcattccctgtgcggtggaggcctttggagggttttcggtggacggtgtggaagcagggaggagtcccggtgacagatggcggtggaggcagtgggttcaggatgagtttgaggtggagcttccgggacgtggtgtgaaggaaggaatcaaggacacatcctgcccctgagaggtcacgtggctgggaggctggctggtggcctgaggctggccgggcaggtgtgctggtgggggtggccgggcaggtgtgctggtgggggtggcaggttaggtggtctgggccacgtgcaggagtcagaattggcacccatcactctgactccacagctgcccgcttccactgctctgcactgccctggcccagagggaggtgttttcccaggaaagaaggtgccaaggccaagacccatgtgttcccagactcacggggcgggggcaggagcccccaatgcagccccacaggcagccaggccctgggatgcactgccacctcctcttgctccgggaggcagaggctgtgctctgtggggcgggctgtcagggacagtgtgaggtttggggtcccatggacgtgtgtgcatccttgtttgtctagcaggaccggtccagcttccccttgcctgccactgtggggagggaccccagactggccgggatgaatggatgcaggaactgtggcctgcacgtacttaggagtgtgcagggcagggtgtgtggctgcctctaggcctttgcaggcagagccttcctgtccaccccaaggggccgcaggcagcgctaccagctgttccccacacaaaagctgcccgagacagctggaatgctccctgctcctggtgcaaactctcttgaaactcaggggtggggacatcctgggagctgacctcaggttctgttcctgcaaataggtatctgttgctgacccggcagatggcggcctgagccagcccagacgcgctcgagccctggccctgagcagccatcagggggcacctactgagtgactaaatgaattaggaaatcccagcgcttaacagactcaccactcggggcagagccagactggctcccacagcagctcctggtttctccaaatcctcaccagcacgggggctttagtgtttaatattttgctgctccggcagcaaagcggcgttgctttttgcgctaatttgcgcttctttggttactggcgaggatgagtgatcttccctgggtttgattactctgcatgtctcctattcctaagtcctttgcctgtttatctcctggggtcttatatattgggataagccctttatctctttttagatattgactttctgtcatgttcgatacaagcttttccccaggccatagttcctctttcctttccagttttgttagcgttagttgcacaaaagtctgtttttctgtagctgagtctgaatgatccttctcctgccccgttggagccaagtttgcgttcaaggacatgcccattcaccgagggcctgcgcgaaggtgggcactcttcatggtgtcatttaataggcacggtagtcctggaagcagagagaaaactaaggtgcagggctaccactgtccaagcagtagcgggaacagcagggagcaagaagaacgtgacgcgttcctggagcacttaccgttgaccgcgtctgccagcacgctgcaggtacatcatctcctaggattcttgtaatgagccccacggtgggttggtgcttttgctgtgcccacgttacagatgaggaaactgaggtgccgacggtcgcacagatagtaagctgtagaaacagtgggagccaggccttttgactcctgcatcaggagggaggagcaggcttagaacccagggctgctgacacccagtgcagtgccctcctgtccccgctcagagcctgggctggcaaaacccggtagcctgtgaccccatctgtttgttggacagagggccttccaagcaccaaggcctggaactccacttaacggctgcagaaactggggcccagcgagggtgagtgaggatgtgtctccaggtcacttagcacgttagcttcggggagaatcttttgcttacagtggaatttgcagcattttgaggaatgcctggcacacggttggtgcgtaaatatccgtgaaaagaaagaataagcatagtgcctaggaagcccggtcgcccaggagctcactccgggagcaacagttgctccctgcaggcattggagggcttggcactgacgcctcctgttgttgccacagtgtcagggctgcagactcaggttggcagctgtgggtggctactggtcccatgggcccatgggacattgggtggccctgggcctttgctagtcccacttcctcacacttgagcaggactgacttcgccggcttgtgacccatccggcagggccctatgcccactttaacactctgtcattcctgccttagaagtcgtaatcactttttgaacaagggactgtgcgtttccattttgcactgtgccctgcaaatcaagtggccagtgctgttcatcactctttcttctgtgactctgcttcctccctgtggtctcatggagctgtggtccaggccccgaggttgaggacacagggcactgcacagtggccaaaattgggggtgcccagtagacacgggctcccttccttccaggcccaagcaccagcactttctgacagttaactgtctgtcctttatttgggaatgtctgatgccagactgcagatggcgaggaagatggccctgtccatgctggaacgacagacccggtatcaggaatgtgcccctgtgactgccacaggcccgtttggtgcctgagggcagcaatgcgtgaatcccagcctctgccctggggatgccgtcgggctggagcactgctcccagcgtgccttggccactgttccctgcgcggttgtctctggacataaagcacctgtggaatcccagggctgctccccttcctctctcccttgattcatccaacagatctctacccggcacgcacagcaggaccgggcactgggccaggctctgggaccagacaggcacagccctgacctcatacagcccacagtgcactagtcagtccacaaatacctgcacaatgaaagacttgggaagtgccacagagtgagcccgcagtcactggacgttgggctgaggcctggagtgtgggttgcagttccccaggaggaaaaggggccagggcagcagatgcgaagtacctgaggggtgaggacggggcttgtttgggggtgtggcaggaggggcagggtgagggcctgaggggactggaggtcagatcacgatggcttctgtgggctccgtcgtggaggaggggctgtgccatgcagcaggtggcatggtctggtttccgaggagggtgagcacggaagaggcagggagccggcaggaggctgctgtcctgtgtgcagggagagactgcggcctggatcaggtggccatgggaatgagagcagcggccggatcagcccctcagcgccatcgtgcaggaagggtgttgggagtcctggtaggcagtccacaggttggtcagagggggatactccttgcctggcagaaccgtattcccattccaaatcaccgtgaggctgggaggacccagatcacagccccacccggctgcctgtgacagctccacccctgtctggacctcagacctgtcgaggtggcgctcgctagaatcatttcctctgtgggatccgggcctgggaaggtccctgtgtctggcccttttctcaaggacctttcccagatcattctggacacatatttgagtccagctgcagattcctagctgcgagcaatgctgcccaggcttgagccttttttggacgactgcagggactccgtggggtgtgccatgggggctgccttcagcctcctcatgctctgcctttgacaattcacgtggcaggagctggggccgaggctggggtggccaggcttggagggatggagtcaggagaacaaagggctgagatggctctgcaagtctggccaggcgacgtccagcagggcgaaaaggactaggtgctgcccaaaccacagcaggagcacctggtgggctgcggggaggagctcaggggtcaagttgacgaggagttcagtacacattgtctgggttggcggggggcggtctgggggtgtcaggctgggaataagaagcatgatggcctgctcaggtctgcccacccaaatcagagcccacagccatgggcagtcccagccccagcgtgtgcagagggctctggagggcagagctggataacactggccccaggaaggccagagcccccaggatgagagcatctgtcctctcaaccttgcctggagcctgggggtcaggcgttcgctgaggacagtggtctcgtatgggcacactgatgggggcctggcaggtgacgccagcagagatcactgggcccaggtagacacggggtcggccagcagcaggagggcctccaattttataagagaagctggaaattgattttacttacaatctcttcattttaaactgttggcagctaattcaaaatttgtgaaagccgtgtaagggttgagcagcccggggcagtggccgggatgggggtcaggaggcggcctcagtgctggggaccttcactggagcccacggcgctcaggaccgagcttcttggatgtggccagggctgcctcggagttgaaatgtacttcagaggaatttttattttcctttcgggaatgtcaagagaggcctttccagcggttccgtttctgtgaggcgaaacctgcggtcgtcctgttgttcttggaggcagcgatgaagcccatctgtagcgcatcagcgggagccagcagcggggagggtgcagggccccagcccaggcagacagagctgttggatgcggcactgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctgggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatccacatcttcatccatgtaggaaatgctggagtgaaccgagccgcacccaggagcttccctgagctgggcaccaggagcccagggtctgtcctgtctctggatgagtcctgctgccttggcctcagctgaggcctcaggcccaaagctccatggcaggcctgacactattttccttataataagcccccgtcctctttcctgttgggcacccgtgtccccaggggcgggtcacaagatgacaacttgggacctggcggcttactgttctgtgggctgagctggctgctgggccctgtgcgaaaggcacctgtgctcccacctgaaggagcctggggcctctgctctgagggcagaacaagaccctcccggtctccctgtgggaagaaggaccgtgtcagagacgctgtccacggtggaccaaggccaagctgcgggagaggctggggacagagaaggagactggtgggtacctgcccatgctcatgtgttgggggtgtaggcagaccccagggcctaccagagcagccagtggggagcagccagttcctaggcccagcagcatctgtgcaaaggggtccagtagggtcacagtgcccgaattgtgtcacacactccagggctgcccagccctgcctgctgctgcagagcccctgatccccgaggatgaagacaccaggaaggagcaagaagtggcccctgtgccatcagtgtctgtgccgtgccacccctgcttgggggcacattggttttccacatggtgtcctttgaatggaggtgaggcgggccccagccaggccataatcttgggagacggctctacctcagggctttgctgaccccattctgagtcaggccccagccaggtcttgggagatgggacagaaagtgaggggaccccaagattgaattgtaggaaggatctgaactcactggtggaggcagagagggaagatggggatgaggctgatggaaatgcagtctgctcacaggcacaaaggccacatcggcagccctagccctgagcccaccccacagttcctgacccccaatcctcaccctctagagatgacctgtggtcaagcatgaccgattctgccccaaaaatgtgtataaatggcaacagtgacaaatgacgctgctatggtcttgcctctgactttgttacccggttcacttgccatggatgtgaaggattcactttccagtatcagagtctttctgtctacccattcatccatctatccaatcattcatccatttatccatctgtcatccgtccatccattcatctatccaatcatttatccattcattcatccatcgtgtattcattcgtctacccactcattcatccatccatctatccatccatcattgatctccattcatctacttactcatccatctacccatcccccatctacccatccatccatccaattatttatccattcattcatccatcatccatccatccatccatcattcatcatccattcatctacacactcattcatccacccaatccatccatccattcatccagtcagtgtctgcaagcaccccaggccagcgccctgctgggcactgagtatgaacaatctggtctctgtccctgaagagtctggctgggggaaaaggcagactcccagatgaaccatgacaaatgctgctaataggctgcttggcagcccttcctcattgtgccctgttgtgtttctttcagccaaaatatatttctgtgcatctttgacgccatcaacagttgataggagagtcaggcagagggggctatgggcttcagggacagtgagagggagtgtgtgtgtgacctggtagcttagagaatattcttgtgggcttaatctgcacgcccccccgacttcacccatctgggcctcttctgacctcctacaagcatttgagttgcttcctctgaccttttaaaaatcaatggactataatacatatgagtatgaaagtgtgtaatccagtggtttttggcagtgttgtgcagccatcatcaccatctagttccaaaatgttttcatcaccccagtgggaaccctgcacccagagcagtcactccccattccccttcccagctcatagtgaccactaatctactccctgtgtctttggatttgcctattctgtatacttcatagaaacccaattgataatatgtggcctttggggtctggctggagtccttctaaggattgatctaaaagctccagggccccttgtcatgggagcatcatatgcccagcgacatgaatataaaataataatactgcataattccagaataggcagcagcgtgtgtgtatgaagctcgggactgtgagacaggagggagaagtggggactgtggttaaaacagtccagagtgcctcttcctaagggaggcccctcctagttcctgcagtgagatccgtgttgacactgaagtggccttgtgccctgctgccccgccctgggatggcatatattagagggggctccgatcacctctgaactgggaaatgtggagtagtgcaggacacagcagcaggaaccacagctcccagccccaccccagagagaaaggcccatgagcagctggtgcagggactggactggagccgatgatcagatttggagttggtgtggacatggcgtgtcacctctcaggagagggggcaggaagtgaggagcctgaggccaaagggtgagaagggtctgaactcactgctggaggggcatgtgtgtccccagggttgcagcctggctggggcagccagcacagtggtgacaggacaaattagagaaaaagggatgcctttttttttttttgagatggagtctcactttgttacccaggctggagtgcagtggctcgatctcggctcactgcagcctctgcctctcgggttccagtgattctcctgcctcagcctccctagcagctgggattacaggcatgtgccaccacaccccccgaatttttttgtattttttgtagagatggggtgtcaccctgttggtcaggctggtctcgaactcctggcctcaagggatccgcccaccttggcctcccaaagtgctgggattataggcctgagccactgcgcccggccgggatgtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaagtatggaaacagacctatcaggccgccaaaggcaagccgacattgctgtatcaatctcagactcaacagacctcaagacaggagacgctgctggggaaagacaggtcaccgtttaatgagaaaaggttcatttccccaagatgataaagcagttctaaaggtagagtcacttaataaaataacctcaacatatttgacgtgaactttgttagaaatagagaaattgacaaatttatcatcatttttgagagaatccaaccatttttttccaattggtgttggatcaagtagacaaaaaacccagcacagataaggaagttctaaataacacaaataataagcttgacattgatgaattttgcatctgacaagtagaggttatttctttttctcaagcacataggaaacacttgtaacaactggtcaattaagtgcaaatctcacagaaactaaaagaatagtgtcagcaggtcttgttccctgaccatcatgcctgtgagagagaaattaatagcccccaaagcaaaaatccccattatttggaaattaaaaaaaaatacttttaaataattcatgggtcaaagaagaaataatagtggaacttcaaaaatacaactcaatgataataaaagcactaaatatcaaaacgtggatggaaatttacattagaaaagaaaaaggtctaaaaattaaagagataaatttccagtgtgagtagttagaaaaaggcaacattgatccaaagaaaatagaaggaaaaagataatacaaaataagatcagaaatcagtgagacaaggccaggtgcagcaaagtgcctataatcccagcattttgggagtctgaggcggatggatcacctgagctcaggggttcgagaccagcccgggcaaaatggtgaaaccccatctctaccaaaaaaatctaaaaattagctacacgtggtggcatgcacctgtggaaccagctacttgggaggctgaggcaggagaattgcttgagcctgggaggtagaggttgcagtgagctgagagtgcaccactgcactccagcctgggtgacaaagtcagaccctatctcaaaaaaaaaaaaaaaagaaaagaaaaagaaaaaaaaatcagtgagacagaaaacctctgagttctgatcattgttgctgttaggaagattcggggtcagtgttgccagatcctcagtttttcaagataagtcaaaaataggtaattctgcagacaatctctgcattaaaaaaaaagtgtcagtaatctgaatttggcctgtgcacgtctttcctcccagagctgcttctgcacacagcacctcctctctgggccatcttctctgtggccagcttctcctcgatggccatttgtggacaagtctttgtgtgtacatatatgttcattactcttaggtatatgcctaggagaattgctggctcacatgataacacagtgtttcactttttgaggaaacaccaagactgttttccaaaatgtcctgcacgtagtgtccctcctggagggccggggctaggtcaccatacacagaacacgcagagacaccccagaaggccaattcttgtgtctagttagcagggacctgtctctgtggggtggggggctgctggtttctgactctcatctgcagacccctcaggcactggcctcgttgtttaattcataaattggggaggtgatggagggggtctgaggcctgcttttttggtggcagagtaatttctacattgggtccttgctgaagtaggtcaccatcaggcagaaatacgattcctgagactttttggagataacaagttcaaaccctgcctggctgggtttctagcagctctgcttccagtaccgtgtggatgtcattttcacttacgctgtctcacaagggcatgggtggaaagaactctgtttctaggtaagggatggaaggctcagagatggcacaattagaaagtggaggatctgggatttgaacccaggcccgcctgatgcagaattgggctctttctgctacactagcttcaggtgccggctgagccctgggagggaggagtgagcaaatgcatgaggctttgcctttgccgaggcaggacaagctgaagaggtctttctccttccctagagtgagcaggatctctggacttctctcctgtctagtgtttcagctggggctccactggcggaagcaatgtgcgggcaggatgcgtgatgcctgtgggtggacagtgccactgtcagaagacaagccgaggctgctatgggagggcgttagagggtgacattggcctcccatcagccaggtttcgaaagttaggagcagatgtacagggtttgtcacccaactacttgctccccttcttggttaccgcatgaccaacccagtggcctcccagggccttgcgctacacaacactggacagccagaaagcaggtaatgctgcgtcacccacagagggttgcctggggcctgggctgggctggaaatggctctgagaacagaggtaaggagtagatcattgtttaatctttcctttatggtgggtttattgagctgtaattcacatatgctgtagttcagcgtttcgggcgcataattccataatttttactatattcactcagctgtgcaaccatcaccacagtcaactttagatcattttcattgctcccaaaagaaaccctgtacccacgagccatcattccccattttccctcaagaagtgttacttcttcctttgcaatgtggatgccttttatttatttatttttttcttgctgaattgctctgactagaatgtccggtactatgttgaatacaggtggtgagagcaggcttccagtcttacagttgaccatgatgagtacttttggcttttcgtaaataccctttatcatgctgaggaatttcccttctagtccttgtttcttgagtattttttgatcacaaagggtgttgggttctgtctaatgctttctctgcatcaaccaagatgactgtgtggtttattttcctccattttatgaatgtagtgtattatatggattgatttttgtgtgttgaaccactcttgcattccacggataaatcccacttggtgattgtatataagccttttaatatgctgctgaatttggtttgctagaatatcattgaggatttttgcacctatatttataagagacattagtctgtagttttcttatgatgtttttgtctggtttcggtatcagggtaatgctggcctcatagaaagatggatattaattctttaagtgataggtagaattcccagtaaagccatctggtcctaggtttttctttattgggagtttttgatgactgattcaagctctttacttgttatagatctgtacaaattttccatttctccttgagtcaattttggtagtttctgtgttgctaggaatttgtccatttcttctaggttatttaatttgttcgtatacaattgtacataatattctcttataatcatttttatttctataaggtcggtagtaatgtccccacttttgtttgtgattttagtaattggagccttctctctttttatcttggtcagtttggctaaatgtttgtcagttttgttgatctttcaaagaaccagcttttggtttcattgagtcttcttattgtttttcaattctctattttgtctaccttcactataatcttgattatttccttttttctgctagctttgagtttctgttgcttttcttctggttccttcatgtgtaaagttaggttattgatttgagatctttattatttttaatgtaggaatttgaagctataaatattcttctgggcactgcttttgtatgtcctttaagttttgggtatgttgtgtttttattttcatttgtctcaagatttattatttattatatattctaatttatcttgtaacatattacctgacctaatggttctttaagagaatattgttaaatttctacatatttgtgaatttttaaagggtttcttctgtcattgatttctagttttattccactgtggttggagaagatgctttgtatggtttcagtctctttaaggttattgagacttgttttgtgacctaacatatgacctatcctggagaatgatcatcatacatgagaagaatacacattctgccgctgttgagtggggtgctctatgtatgtctgtcaggtctagttgatttacagtgttgttcatgtcctctattttcttactgatcatgtgccggttgttttatccatttttgaaagtggaatattgaagtcttcagctattattgtaaaatggtctatttccatcttcaattctgtcagtttttgcttcatagattttgggattctgttgttaggtgtgtttatgtttataattgttatatcttcttggtggattgactctttcatcaatatataatgctgttctttgttgtaaaatttttggacttgaagtctatcttgtctgatattagtatggccatcccaggtctcttctggtttctatttgcatagcatttctttatccatcttttcattttcaaactatttgtgtattttgaatctaaatttggtcccctgtggataagcatatagttggattatatcttgggattttttaatccattctcccattctctgaattttaattgcagcatttagtccatctgtatttaaataattactgataaggagggactgaattctgctatctgctatttgttttgtatatgtcatattctttattcctcaattcctcaaatatttccttcttttgtgtttaacacattgttttttagtgtactgttttgattcatgttttcatttattttgctgtatatttaaaagctatggtcttattggttatcctgggaattacagctattatcttaaacacataacaattttgtttgaattgatatcaacttagtgtcaatagtatacaaaatgctttgctcctatacagctctgtcttccccaccctttattataatattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtctaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccatcctttcttgttattttgcatgctttgtattttttgttggaaactggacattttgaatgtggagactctggaaatcagatgccccccacttcccggggcttgttgttttttatgtgttgttgcttgtttgtttagtgatttttctaaactatttttgtaaagtctgcattgttcattatatatggccaccaaagtctctgttttgttagcttagtggtcagctagtgatttgacagagactttcttaaaagccagggtaggaagaaatactctcctcgtctttgtagattggttctgtgtttgagcacacctttgatgcttagccagactgtttacaactctgtcttagccttcacttcctacttgtacagaccctaaatgtcagccagaggtgaaaacttttgagtcttcttagaccttttctgagcatgcatctcaccctagacatgtcagtggtagaatcctagattctctggtatgcacaagagctttccaaaaaccttatttcctcaaatatctccttccctaccctcttcctccccaagcctttagatatgtttattgtgcgtcttgccccaactattgtcctgtgccccaggtgtctgcagctaatacatttacctttaaatacttttgacaaacactgtctgggaaaccacttcagtcctggggaagctccgagacagttgaaacaaaggcaagccagcagatgggttaaaacccacaaccacaattctctggatataaggtccatatttctttcttttgagttttcaaactgggagtcattgagctccttggatgtgtaggttggtatcagcaacctacaccaggaatgtggtctgccatcttcatggccactgctgagttggagaataagataatggtaagcaagtaaattaaaacaccataacccactgtcaccaaaattcagtagctgctttcttcattaagcattccctggttgttgtaggtttctggttaaattctggagttccaaaaaagtcgattctgagatttactagcttatttcctgtttttgtggaggggcagaattttggagtcctctattctgtcactttggtgatgtcctctcccttgtcgtatgcatcttatcagaatctttagatttatattaacttaattcctgtgagctatagaaacattactcttatatagctctattcttccacccccatctttggttttttttgtttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcccacccccatctttgtactgttcttgctgtgcaacttgtgttggtttttgattgctgcggtaacaaattaccacaaatttagtggcttaaataatgcaatggtattattttgcagttttggaagtcagagtctgaaatgagtctcactgagtttaaatcagggttttggcagggttttgttccttctgggtcctcctccggggaggatctgtttccttgccctttccagtttctggaggccacctgcattccttggctcatgacttctgtccttcgtcttttatgccagcaacatcaggccaagtccttcccgtgcagccatccctccagtttctctcttctgcttcccccttccccctctatggacccttgtgattacactgggcccatctggctaatccaggataatttcaatattttaaagtcatctgatttacaatgttaattttcctttacatataaccttacagatagataggttctggggattagaatgtgaacatctttggagggccacagttctgcctaccacacagctatatatgctacaaacctaacaattgttgtaattattgctttatataatttcatgcttaaagaagctgaaaaaagagaggagagtacatatatatcaacagtttgccttcctgttgaccatttctggctctcttcatttgttgcggtggattcaagttcccatctggtgtcatttttttactccagtagctgtgtttctgttcacctgctttgtgctgttagtcaaatatattacatttatatattatatgggcccaataatacaattatatacatcttcttctatattattgctttttaagccagttaagggaagaaaagagaagaaatacccatttatattgtcttttaaagttgcgtgattacctttactggtactgtatgtgtgtgggtgtgaattcaagttaccaactgaggtcacttgctttcagcttgaagaacttcctttagtatgtctgataaaatgggtctactcataattctctgtttttacttatctgggactgtctatattgcaccttaattttgaaaaatagttctgctggagaaagattcttggttgacagcttttttacattggatatgccattctgctgccttctggcttccattattaggagaagtcggctggaaatcccactgggattcccacatatgtggcaagtcatttttcttttgctgctttcagaattttctctttgtctttggctttcggcatttttactatgatgtctctgggtgtggatctcttggcatttatcccgtttgaagtttgctgagtttctcggacacgtaggttaatgttttcaccaaatttagggagctttttgccactgtttcttccatcttttctgctcctttatactcacttgcctctttctgggactcccattgtgcatatgttcatgccctttatggtttccacatttttcttaagttccgtttacttttcttcattcttttttccctgtgtccttcaaattgcataatgtctattgatctgttttcaagattctttcttctgccagttccaatctactgttaagcctctcagttatggtgcttttcaactccagaatttccatttggttcttgtttataatttctctttattgatagtctttatttgatgagatattgtcatcatcactcctttacataagcatggtttccttttttcaaagacatatttccaatggctgctttgaaatctttgctgcaaaatctgacagctgttacatctgacatctgggctttcttaccagcagtgtctgttgccgcctttttttctgtgaatgagtcatttgtgtttctgttgtgtgaaactggacattttgggtcatgtggcagctctgcatactgattcccctcccccatctctgaggctgtttgcagttgtttgtgtatttatttgtttcctgatttggttagactgttttcacaaagtctgtattcttcacagtgggaagcctcagctgttggagggcacagccttgagcgtgtgcagggtcatcccgggatgacagtgatttcagcagggctccctatgactgtccctttctctgatctgtctgttacactctctgcttcatttggtatcacacccagctactaggcttcactaattgagggatgattgctctattattttcaacaatgtcctgagacataaattgtcacatagtttgatccaattaaatttgggtagggatgattttgaggccagtctttgaaattcattctccccctggaagagatcctcataacgatctgttctcctgattttttttttttttttccagtaaataagctggtctgtggttcaggttgttgttctcatagagctgtcagcctcctcttaaattcttgccgccagaatcttcactgaagccaccactccaggtattgggcaggaggtagcctctgatcttcttggtttgcctccccctagcatggaatatttttctagcaagcaggctggacttagggtgattaggagcccagcactctcgccctgctgcacctgagacggagctcctgccctgagttagggctgggtggaggaaggtgctccggcctttcggtcacactcagcagggagttaccctctgtcactgggagttggagatgatgagaaacgctggtggcccatctatcctggtgaaatactgtattccttgactgggatctgagggaagagggagccctgtgttcttggccacacacccccagagtggaactccccataagctgaactggaaggactagaagcggggaagagagagcaagtgatggctcaggtgccaccgattcttgctgttcttactgggatttttcttcccaagatttggttgattttcttgaatagatgatgttgcttagtttgttgtgtgctcttaggataatttctagagactttaaattgttgttgatggtgacttttcaatacttttcaccagttatggttgttctgaggggaatgtgtccatggggctcctctcaccaccattccagaagtggaattctcatggcagatgattcctaatctttttttaaagggccacagcaataaggaaggtagaagacactggatatgtcagggtcattcaaggtataattagagatccaaatccaattaagccaagaaaaggaaatttgctggcacacgcgagcaagacagcaggcaccgctggcccacacgaggctgccaaggctcagcgtctctcctcctcctaggacttggctctcttctgcagagacttccttctcagattggctcttcacatacgcagccccaggcctacgctgtgagcttactgagccaggaagggaatatttttttctcccaatgttcagatctcatggaagacccatgattagtctcactccagtcatgtgttcaccccctggaccaatcactgtgctgagggcattgagtaccaggtgtgggctatgtgcccccccaccacagccactggggagtagcatgggcatgaattacccatccaccagagacacattgggtggggcaaggcccttcccgctggcggaaaggggctactggtgtgaaaaatcaacaagatggtcccccacttgccccttttaaaaaatgcgtagagataggtacacacactattttgcctatagtttattttaatgcactgtaaatctcttcgacatactcagaacttaaaaagaaacttcatgtgcattatctcttttgactacacttttcctgcaaaaatggtcacttcctgaaaaagtgaaataaattcaaattgcacaagtaaaagaaagaggaaacttgaattctgcccaaaggaaacttcttcaagaaggctgtgctcttttgattttaatacactgaaattacagaatggcctttgacatggcaattttcatgtcgttttgaacgtcaaattgattttgactctgtttggaaggcagtgaggcccaaagccctgactcatgaaagagcagaataacaacccgaactcgcctcgttttgctggacgtggaagcccggctgggttgatctgctgtctcctcgttttccaccagcgtgaggtcatctctggcagtgtgtgcctcacagaggctggctggggcagcaggtactggccactggtgcagggtcccattgcctgcgatgagggacacagctaacgttcccgaggagcttccaggcaccttgcactctgtccctggcaacacagtgacaaggctttgttcctccacccgaaacaaggcagtggcatggcctccggttctcgaaggttcactcctatcttccgctcacacttcagtttctttgtagtcttgaatcattgttctccagcatattctacagagggccttggtctacctcacccatgcagctaaacccatctattagggaaaccaacactcaagctcactcctgccattaaactctcctgagatttgagtttcctcctctttcacaaaaccggaaatcccttgtaagttaagccaagctcattaacgttgtcttctgcggcatccatagagttctgccaggagagttgaaccctgttcctcttccctttaccggacaaaacctctgggagaggtgggctcaagctctgaatctggtgacgtttatggtttccgcagcagtgtgtctattggcatcgcgtatcagggtcgagggtggcaaggcatggggtctgcagagtttctgccctcccccaaacagcaagatccacacgcactgacacgcgtcacgggaactcatttgacacaggatcaagtttgcaaaatttcccatgaggtcgaccatgaccacagctgtcaaggtttccaaaaaggactccccactggatttggccttggtcataccttaaaccttcttttgccagcggcccctatacctgcataatccgttgcagtgttgcattctgatgaccttctattttcccggttcccttttgctccgacctgtgctccagcaaacctgcaggccattgatgctgccgccttgtcacggtctctcacaccactgatccttccctccaccccttacccagcctccttctcttaaactgcaggttccctcattggagtcactcttgctttgtaacatctactgaacaatgccctagtcctggtaaaatgaaactttctacctacttcatgctggcacgggtacccctgaacaaagctcagccctgcttctgctcttgcttacgatgatgttcaccagcaaggtgccgctagcagccagactgctcccctcagtctgtttgcctccttccagatgacttttcatatcttccgtcctctgaacacctccaacatctgctccctatccgcattcacacctgacggcttccctcgtctgtcacctactctcccagctttttgctctctcagcagcaccccctaggtggagacgccatcttcgattcctctcctctcactgtgtcttaaccccacttggaccaggcctctgtgtgtgccactctgccagaggcaccctccccgaggtcatcatgctgctgcatctccctgccaatcctcagtcgccatccctagcacgtggcaggctagtccctcctgctcccttggtgtggcttaccggacacccactttcttggtctaatcacagcactcacagttcatccccgtttcctttgctgatccttcctcttcccgcaccctctggggttgatgcgcccagggctctgtcctggacgctccttggtctccctctgcacccctctgtgggcgatctcattcctcttgttgctttatgtaccatgaaatggctcccagatttgcgtctccagcccagatctctctcctgcacccaagactcatattccaactgcccctccaccttccatgctctctgtattgcccacgctcctgactccagcagaatctgcacctcatctgtctctgcactcttcaaatccaagttccaaggcatttctctacttgccaacctcaatttggaagtaccacctcagcacgcccctcactgaactcgcgctcaccctctccgcactccaccctcggccttccccagctctgtgcacggctgatccttccttccatttgcacagccaaagctctgcagttagggttgacccctctcttcctctcacactgatgagaaacctgttgagaaatctttttaggttttctttcaaaatccaccccgaccctgatcacttctcaccatctccacggttgtcacttgcgtcaagcctttgtcctcttctgatgactttgggagcccccagcagacctccctgcctccccacccccatgtgtcctcaacacagcagcagggattcttttctctaacagctttattgagatataattcacatactatacaggtcacccatttaaagtgtacgattcaatggtttttattatattcacaacatcttctccctccccaaagaccccacaccccttagctgtcgtccttcctcccccaccaccttccaggcaaccattcatccacttcctgcctctctagatctgcctactggggcatttcctgtaagaggaatcctgcactatggtggaagggtcctggggcggtccgtggtcagggatcctttgatgccttctgctggatcatgtctgtcttctgctggaaatcccacagtggctcctgcttcgttcagctcagaagtcagcacccagcacccgggccacctaccagaccccacacgacccagcgcctcgccctgggaccccgtggcctccattttccttctcactcacttgattcctgccatcctgggcctccttgcccttcttttcaaaaccccacatggggtcctccttccgcctggatgccctttctagacaccctcagctcaccctcccacctcattcgagtctttgcttgcatgttcccttccagtgggacctaccctggcgctctaaggctttgtagacagctccccccgcaccacctgccctggcactcgcagaccctgtgccctccagccccttcccgcagcactcactgccctccggcatactcagagcactggcaccctctgttccttctgctagcgtggccgctccacagagcagggagctgcggtgactcccacggtctcccaggagcagtccctgaggggagctggcccctacacagtagctgggggtgaatccgtggacacccagcaggtgaaaaccgggactcagctccctggagagacgtctgcggttccacctgctgcatgttccagagaactagagcagctccaagttccgctgtggcttccttcaagctcaggaggaatatctgtgagcccagagtggatggaactgcttgtttcttccaagccacagaacagcttggctgtttccagagtgcacagcctccccaaagtctctccaagaacatggcttcggtgtgtgtttattgtaggatgttcaaggcctccgtggggcggggcagggggaccccaagttctggttaagtaactgtcctttaacaccgccgttctcaggagccacagctacactgcggcgtgcgtgtcgggagcgatggctgcctgggactcttcagcttgtgggtttgctcttcctttctcaagcaccttgcagtacaagaagcactgggtttttgtgtcctggtgaatccagggatcaaggaaaaccagaggacacagatgctccaagatgcctccttcctttcaccattttccagacaaagcagacagggacacagagaggcccagagcccctcatcaggccccgtctcctttaattccgtcctcattaaaccctgctagactttccaacatgctgaccttgagaatcacacatcgcctcatctcccccagcctcccagagctgggcagcaccgcttaactgacgcgactggatccaggtgacgaagcctttcttgagagtagctgaagtgacactgtcttagtcagtagaggctgctaccacaaaaagcacccccaacaccaggtggcttacatagtgtttatttctttctcatggttctggaggctgggaagtccaagatcaaagtgctggcagattttgtgtctgctgagggcctaccttctggttcacacatggcaccttcttgcactttgtcttcatgcattgcaaggggcaagagagctctctggggcctcttttatgttatttctacatttttaatttaaaaaaatgtttagagacagagtctcactcatcacctaggctggagtgcagtggcacgatcctagctcactgtgtccttgaactcctgggatcaagcgatcctcctgcctcagcctctcacgtagctggggctagagatgtgagccaccacatgcaacatatttttttttatttttagtttttgtagtgatgagggcttgctgtgttaaccaagctggtcttgtacttctgtgctcaagctatcctcccgtctcaaccccccaaagtgctgagattactggtgtaagccactgcacctggccatggggcttctttgataagggcactaatcccattcatgaggccccaccctcatgacctaattaccccccaaaggccccacctcctaaaatcatccctctggggattaggtttcaacatatgaattttgggggtacaaatattcagtccatagcatacatcgaagggggaaattcttttttctgaaaccaggtcttgctttgtcacccaggctgaagtgcagcagcatggactcggcttactgcagcctcaacctctcagggtcagtcagtcctcccacctcagcctcccgagtagctgggactgcaggtgcaccccattacgtttggctaattttttttatgtgtatggagacagggttttaccatattgcccaggctgctcttgaattcttgacctcaagtgatcctaccgcctcagacttccaaagggctgggattacaggcatgagccgcagcaaagaaagtctttttaaacgattctttatcagaggcctctgacagctcattcttgttccccaccttaagcacctctggctttcattgatattgcttgcttgggtcttagggcctcagtcagggcctggaggttgggatttcctggtgaatttgatggttagtctcctggttcacccttacgggagtggctggaacaattggcgtccctcttccccaagcacctgaagacaagtcctgccctttgtgtgctcagagaggagggagggaaagtgatttctgggcccaaagtccaagacttggagggagggaagaccccaaacacagcacagagggacgatgcccatcattgctcccaaggcagctcttccccctgcctgggagcggagctgacctcatggcagagggctaggcagagtgtggttaatatctcacaaggcacaggacatctggaagctgagatgtgccaagaggctttgaggctgagcatatttcagggctgggatgggagggagattctcatctgtttagtggcagctagaccaggagggcacctgggaccaggaccaggctaggtggacatgagtggtcacaggaggctgaggctgcagggtgtctgggaaggcacttggccagatgcagagggcaacccatgccctgagggtgggggcactgttggagcaatcccagtgcagggagacccccaggatctagcaggagctctgtgcagggctcacatggttcatgggggcccagcaacagagaggaccctattggcaaccatcagcactggattctgcctttggtctgagcagaggtggtccaccccgcttcccctctccttcctctctgcccttcctctccagggcaaggcctggcctaccagcactttcgttggccctgctcagatgcttgggactaggtgggaacaaggccctctcctatgagagttcctggcagcaccaacccctaggacctgagacaaaggggccaggtgagtttctttaagggcccctcgctcattcgatttggggtccctctgatttccatgcagcctgggacttggtaggacttggacacacataggctggcacctggctccattggtgtgaaggcgtcagttctgtcccacacaccctgagcatttcatgctattctgaggcatgaggatgagctcgtattcttgctccttgtctattccttcatcccattgtgccaaaccttcatgagcctcctctcagccaaggcaggtgacccagagatgaatctgatgcatgattttacccctggagctcatggtctggttaggggacttggaaactggtgagcttatacttctgcatgatcagtggtttaaaagaaggaagcacagggtgcttgagtctaggagagagagtaacttgctctctttgcgggcctaacgagctgggagctgggttttgaagactgaataggagtctgccagaaagggcagggcaggcattctgggcagagtgagcagtgttttctcggacccatggctgtaagggcgttgcgggaacatgagcaggtccctgggagggttggcaggcaggtcaggcccatcaggaggccctagccagtgtgctcgcactcccgcacgggtctgctaggcttgggaagagggaggtacagaggattttaatgggggcaagctcaggtgaggactcgagctacagggagtgaagggcagggagcagcagcggatggggccaggtctgggaggaggctgctgcatccaggtagagggaggggctgagctcatcatggacggggagatggggaaggtgccaggatgcggtgactccttggatgtggagatgagatgggcacagcagcaatggctgatgggttggggtagggaaaggtgacaggtttgtttgggacttgttggcatgaaggtgccttgtgacaccccaggggcagttgcaggcagcagggggcggggtctggagcctggggaggtgcaggctggaggtgggtcggggggcacctgtcagcaggtccatggtcatggaggtcaaagcagcaggtgtggagcaggcagagaggagagcgagggtgaagccctgcacacggaagcccagtcctagtggatgagcagcgtccagggcacggtggactgggccccacttcctgtgggggtgcagcctccacttctctctgagatgcatggtgaggccttctccatgcagagctggagaagtcacctgaggactgcccacctgggtgaattcaggcagagcagcaggaatcccccacagagcaggggttaagcctcgagggctggtgatatctctggcatctgatggggagggcgcctgtggcaggagagggtctcttctggcagagagcttgcatgaagtccagctgccctgagccaggaagagttactgggaggacattaggaaacctgcagagtccacggggagtcgggctgtggaagggcctggcagtcggggtcctggacacaggagggtcttaaccattgtgaccaggtgtttagtgacaccactaccttttcctcttctggctcctgcggctcaaatcccacactctgtgagggagaggatgtttggcttggggagggctgtgtgcatgcagggttccaggaattccaggaaataacactgggctgctgctctgagaaaggggagaatggatgctgggccacccccagaccttggtgcctggtccttggggacctggagatggctgctcagcggcttgagggcttcagtgtagtcagtgtagtgtgtgtttctgtttttttgtttttgtttgttttgtttgtttgttcattttgttttgttttgaaacggagtctcactctatcactcaggctggagtgcaatggtacaatctcctctcaccgcaacctctccctccgggttcaagcgattctcctgcctccagcctcccgagtagctgggattacaggtgcctgccaacacgcctggctaatttttgtattttttagaggagacagggttttgccatgttggccaggctggtcttgaactcctgacctcgtgatccaccctcccccaccctcagcctttcaaagtgctgggattacaggcgtgagccaccatgcccgggctgtttttgtttttaatgtgacacattttaacaagcatagcatttaacaaagcagataatatgatacaacacatacacacaagatacactgtcacagtcatgggagatggcactgatgatgttcagtcagtatttaggcaggattggaaagaaaaatgtctctgctgtgttttgcacacttgtacacagacacagaagttttttattccaaaatgtggagttatctgcaactctgcaaattatacttgatatttacttttcttgatatatttgctgaaaaacgattctcccagtaaacagtggtgatttctcagaacagtagttatttgtcagcagcctttaactacggcaaacctttttcacttgagtttgaagggtgaacgccttcccgcctcccgacacagatgctcatggtcgtgcataatttcatgtgcttccattctccagacttgttggaaatgccatattttatgcttgtaattagtcagatgagccaaaggatttgaaatttaaacatttgaaccctaagagaatcttgaaactttaaccaaagaaacagaagaagaatgtatacaaacatgggaattgcagttcaacagccctttattaaaaaaaaaaaggtattgtgctggcagtggaatcaaagacaaaaatatgatcatcacagtctacaaggcactttaccgatctactcatcctcatcctgatacagacacgcgtgggaatcgtctgagtggcaggacctgcagccattgtcacccgactttacagatgaagcagctaagaaatgactcaataaacttatagtgatttgcttgacatgtcagagttaaaatgtaacagccccagaaggagtggcctagcacagcgttcaagagcacagactcttggtagccatgccagggttcatatcctggttctgacacttccgagcagtgtgaaattgggatagcctttctcagtttccccatctgcagaatgaagataagcatcacagctaactcacacagctgctgcgaagaatcagtgggcaactatagacgaggtgcttggaacagtgcctgagccaccttaagagcagtatggatgtttctgtctgtcagggatcccgtgtggcttccatggcgccgcacttgggcatagtcggagatttgataaaacattggtgcaatgtaacagccgcacacaggtgcactggcttagcaaactggagtttggattaatttaatcaaaaccaagtgtcgagagggcaccaaagtccaggataaacgtggaatatcttcctggagcatcgattttactttaaaaagatgcactctatttcataatgtaaaattgacactttttaaaagacagaatgcggaggcaactgtggagttctcatttttggcaaaagctgatacgggttctgccttcactctctgggatattggctaatttcctctttttttttctttttcttttttctttttttttttcctagagacagggtctcgctctgtggccccagctggagtgcagtggcacaatcatggctcactgcagcctctaactctggtactcaagtgatcctaccccctcggcctcctaaagtgctgagactgcaggggtgagccactgcctctgctgacttcactattcactgcaccgagaagactctcatgtgtatttataacaatttggataaaaattttggacattgatccatgtcagctgcgagacagggaacgacttgttatatgcaccaatttgtcctttaattacttgttaagctttgatttgtcctattatcagaattctcatcctcttctctgcaagtttatgctcgccatggtaggcgactgtagaggtcaccggccccttacagttcagcaagtgtggatttgtgcagacaccgggacgccatcagcacatcgaggcggtagacactcgtcttctcccacggtttccttctgtcccttcatttctgttgctgttgttgtttgcttttgtggaaagaacacttaacgtgagctcagacctctcagagaatttcgaagtgcacagtgccacatggtcagctacaggcacaacgttgtacagcagacctctagtacttactcgtccagcatcactaaaactttacacccattgaacagcaactccccatttcccgctcccccagctctggcagcctctatggtgtcatctgctttcatgcgtttgattacagatcctcatgtgagtggacgagtgccgtatttgtccttctgggcctggcttatttcagaatgcgtgtgcatgcggggagggggtctgcgtaccattacactgtcactgatgtggatgtgcaatacaggcctgggtccctctcatcttttggtagcccccccggctttttttttttgagactgagtttcgctctgtcgcccaggctggagtgcagtggcacgatctcggctcactgcaacctccgcctcccgggttcaagccattctcctgcctcagcctcctgagtagctgcaattacaggcgcccaccaccatgcccggctaatttttgtatttttagtagaaatggggtttcaccatgttggccagcctggtctcgaactcctgacctcaggcaatccgcctgcctcggcctcccaaagtgctgggattagaagcatgagccactgcgcaggccttgataaccctattgttttacaaaatgaaagagtgcctgacagtacatgaatggtggtatgttttaggtacatgcgtgaaatggaggaagtctgtatagacgcagacacaccgcagtgcagtggtgccagccaaatccacgctcccagaagtgagacccaaggtgacagtaactggacccaagtatccccaagtctcaccgtctctgtgtgcctgtgtgcacagccctcccgggcataacgtcaagcgtatgtatttgatgtgtgtttgaggctgggtcttgccctggcatcagcagaagcaggccctggagcgcataagtgaccaccagacctgcacaccctctgcacagctgagcatctcggcatcaatgccctgtgagtgcccagggccaggtaggcactcaggaagcctgcaggccctgggatgtccagaccgcactttctggtaatcccacattgcccatcctctgcctctgcgcatcccctccccccttgcccccgagggcaccctgcctgcccacctcacgcccagccctgcccagcctgccctgccctcctcccgccgggaccacctctgctaaatcacttaatccggtgatatgtttcctctggcaggccaagcccatccctcctgactctcagggatttgattatagtgttttctaacaaagtcaaaaacagatttccatgagaggcttatagctcagtaattctatggtgctttggtgcagtgtgccaaggcgcagggatgtacggggtcaggatgtcgagagaaaaggtcacaaaattaaattagaaccaaggagggtaagccttggcaagagaggcctgtccggccagctgacaggggcatgcgccctggagaaccccgagaaaggggagttgtgaaaatgagccatttcacgcctaattacgatttcccataaggtacttaggagggatgatgtgcgctggacttggacaattaacgtaattaaacattcatgctgcctgcggcccatttcctgcctggggatatctttggaagctgaagcatttcttttttcttggaggtgatttcaagaatggctgcagaggaagggcttcctgcggggctgggccttgggggatgtacctctgcaccccagtggggcaggacccctacaaagagtgtttcttggtggcagctgggggcctgggggccggggaaggctggatgccactgacctggaattacctctccgtcgggaatgggcagcggggtctcatgtttgtggagtgggcagcggggtctcgtgtttgtggaattacctctccgtcgggagtgggcagcggggtctcgtgtttgtggaattacctctccgtcgggagtgggcagcggggtctcgtgtttgtggagtgggcagcagggtctcgtgtttgtggaattacctctccgtcgggagtgggcagcggggtctcgtgtttgtgactctgcctgtgttttgatcacggccaagtcacttaagcccagattctctggcgtcccctcctttcctccgattctctgacagaagcctgtaaggacttccttggcttctctgggcctcaggttttctatgtgtcttacttgtggacactgatcaggacactgagggtctgacggagagagggtggcctgaccgaggtgcacagctggaggtgcctgaccgaggtgcacagctggaggtagctttgctgggaccagaacccagggcacttgctcacgtgctggctgtcacctctcaagcacaggccgggggaggagctcaggatccagccagactgactgagctgttctcaggtgaccgcacaccacagacttcagtgcagactggcagagcttcggctccctcctctgggaaggagcaccgggcttcctagctccagagttgtggatgctggatgaggaggccgtggtgaaggcaccgccccgggtctggagccccacaggagccttccccagatgctccgcaggcagtggatgtccgctggctttggttagtgttctgcctgccttaagggcaggcacagtcggcccagccgcgcatggtgggttctggggctgggggcacctccaggtctcagggcacctgccttgctgccgagagactgcatcaggcaggaggcaaggcagtggccggcataagagctgggccttgctgcggagtctccttccgcttcacacccacactggttttgggctatggcaggtggagcagggaggagccagggccccggaggtcttcaggctggggcaagtccacccccaattctgccctgctggctggagaggagaagaaaacaggctggtgcccagactgggttctggtggagtgagctgagtcaggaacagccctgtccgtgcacctggcccgttcctgtcacctctgtgggcctcaggttttctatgtgtcttacttgtgggctgtggccagcatcgttatgcctacttttcagatcaggacactgatctgtgtgcgccactgcggtgctctgcagctgattcatcctggaggccgcccacacctggggcctccggcccaccctctctctgtgctccagaccactcctgcctgagtgtctcatgggtgtctgtccttgtgtccccacagaaatctcagcccaacacgccccacacggccttctcctcctcccacgcggctcctcccgagggtcccttgcagggaaggcttcccagggtgaccggttgcccaggtcagaaacccggaatcctccctggccccactttctgcacccaagctgtgactccccctctcagtctttgtccacacgctgcctcccctgccttccaccctccttcctggctccctctccagccccaagccagggctgccctgccccctctagtctctctgcacttctgccctcctcccggcctcggccatctctcctctcctggccctccctccttggcacagcaggggcttccctcactcccaggccctctgcactgctggtcctgtgggccgtggtcaggaacacccttccccctctgcctgcctctcagccctccccatgagcgtcaggttccctctctgtgtctgggccctgcagtcctagagggcatctggggttgaggggatgctggtcctgctcactctgtggtcccagcccagcaggctcatcatcactcaaagggccccagctgggggccctgcagcccaccagatactgccgtgccagcacccagagccaggccaagcagatcggtgccagaccagttccaccccagatcacagctgggccttgactgtcagggtggcccccttcagctgccaagtgtagagtcgtcagggagcaggccaggctgggggctccctctgcccctgacccctgggggagctgctgggagagtcctggcctctcctgcatgtgcgtggcttgctttttggctggactaaggattgcagccatatgaaatgctcattgctgtcctcatccccctcccattggctgtcctggaagtcagctcctttctgcagggcagccactgcacacctttcttctgtgtcctttcaggatgtcctgtgcacacacaagtatatatatatacacatatgtgtacacacacatatataaatcctaggattagaatctctggctcaagggattttgtgtcctgtagatactgtgttttcgtttttctgactttttcctgcacactgtagactacaccgtgtgctaccctgcatttgcgattatcagggaacatgtcttggacgtcgtccacagcagcccctccagacctgcccattcctcctgctcaggcattccatcctgtgaatcacttgcttaaccagaccttgactgatggggacgttacttcttttcaccgtttcttataatgcagccgtggatatccttacacttatttccttggctacttgtatgaggacatttgtaggattaaatttgataactagaattgtggattcaaaaggtttgtgcattttcaactttgataaggatgaccacaaccctaggatggttggctggatccgtttctctcagcatgtacccctgatccgtacatttttatttggacaatctgatgcaggttgtttctttaattaagggtgaggtcgagcgtcttctcatacactgaaaagctgctcggtggctcatacccgtaataccaacactgtgggaggccagggtggatggatcacctgaggtcaggagtttgaaaccagcctggctaacatggtgaaatcctgtctctactaaacatacaaaaaaaaaaaaaattaaccaggtatgatagcaggcacctgtaatcccagctgcttggaaggctgaggcaggaaaactgcttgaatccgggaggcggtggttgcagtgagctgagatcacgccactgtactccagcctgggtgacagagactctgtctcaaaaaaaaaaaagaaagaaggaaagaagaaagagaagaaagaaagaaaggaaggaaggaaggaaagaaggaagggaaagaaagaaagagataaagaagaaaagaaaagctgctgtcttttcttttctgacaattgtcccctcatattgaaatgagagaagttctcttgtcctcctcgcagggcgtgctatgggggtgtggcttccttcttcagtgtccctctgctcaaacctctgggggagaatacagacgggcaggctgtggggctccgaccccacagcagtgtctaggggtgaatgtttgcagcccctgaagccccagtgggcgtgtgctgcatgtgctcttttactttagctgtctgtaggcggcttgtgttaaccagctcagttagaccctctaccttgtcgcaaggacagagggctttctgtatctcgggttcttccttgatgtcctggaagaatcagatcacacgtgggcttggagaatgagtgcgaggttttattgagtggaagtagctctcagcagatgggggaagccagaaggaggatggggtgcaaagggctttccctggagtcgggccgctaagcagcctgggctctcctctgactgccccggccaaactccgtgtcgttctgcttctgccggtcggtggcctgcagcgtgctggtgctcgttggtgcgttcctctcgacgtccagccgcctgtgtgttcctcccctcatgcgctcctctcgacgtccagccgcctgtgtctgcctgttagggtctcgggtttttataggcacaggatggggacatggtggaccagggtggtcttgggaaatgtgacatttgggcacaaaggcaagagtgcctgtcctcacataggtccgtgagggtggagcccttagccagggaccatgcacttccctgcttccatatcatttaaagggagcatgcccttctctacccagcacttttgtatcaataccgtttgtccatttcccttttggattgctggattgtttcttgttgatttgtaagagcgctttatgtattaaggaaattagtcctttgtctgaagcgcacatgatgtgggtgagcccttggctgtgtggggctgaattgagagtccatgagagggaggaggagcctggtgcgtgctgagtgttagttgccgtgtggataaccagggagtgttcctcaggcccctgcgtgaggattccaccataaaacacatccatcaggagctgtccttcaaggtgggaaagggatgtggagaaacaagtggggcgtgaactgcggcccgggaagcttcagccactgtgaggcagaggcaggtggactcactctggttggccagaacctactgtgctcaaaacctctccaggccagacggaggaggatacagggaaacggttgctcagggcgtggagccgaggtggcagacagacctgaggacacagctttggtctgggcgtggagctgaggtggcagacagacctggggacccagctttggttcatttcacaagcagcacagcacctacattattcttaaattgctttttgccagtatttagagatcagagacttcacatgcaaatccagatttctcacttccttacaaaaataagacccagcaacatggacctgcaccctcctagtcaccactggccaccttgggctggaggcagtgtgccctctcatccccctgcccacatggcttttctcatgggagcaaaatatttctcagtgaagagggaataagcaaaagacaagccaagagggccgcatgctccaaggaaaattgggagagtatatttctttctggaaatgcggaccgtttctctctgttcaacatgtgaacaaaatatgtctaggtcagagagatggggcatcgggaaacacgcccagcctagcagggacccacaggtcgagggtcagggaggcccgagtgagaattgctgtggtgtgaggcctgcggccggcagcgtgttgtcaggatggcgcctacggatgtcaggatgtgccgggagccatggcgacagctcccaagaaaaagaggagaagacggtggtagcgtgcacccaccgcatggctgcagtaagcgcacagcatccacctgccccgctgacctcacgccgccctcatgctctccctgtaaatgacggccaggaaggaaaccgatgtagactccacggccaactgctcccaccaaggagatacagacaatccgcccgcatccacgctgcgcctcgtcctaccctgtcctgtctccacctgctcagaagtagcataaggataactaagttttccatttatccaataggcgtttttggcccgtttatttattcattttgccaagccccatgtgggtacctggggacttagagaggggtcaagggccacctcagtcttccaggagttcactgtagagcctgtgtgtgcatgtgcacgtttgtgtgtgtgcatgtgtgtgcctgagtgtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtgtgtgtgtgcattcatgtgagtgtgcatgtgagtatgcgagtgcattcacacgtgagtgcatgcgtgtgcgagtgcattcgcgtgtgtgagtgcattcgtgtgagtgtgagtgcattcgtgtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcgtgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagctggttgggagcacaggccagagggccacccacccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccctggttggggaggaaaggccctgtgaggctgccttggggattaaattttcaggactcagcactcactctgatttctgatttcctcccttctcgaaatagggctgatcaaattaagccttgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggtttccctgccccctcaggaggcgcaggggcatgggagcgtcctggaggatgggacatcagggcatgggagcatcaagaggccccaggcctcaccacccttccacccccagcatgggggagggctggggtggtccccggggttgtcctcggtcactcctgctccttgagcaggtcctggtcagacatggactgtgcttggtgccacgactgaaagtggggggtctttgtgcccaagggtcatggtgggtgatggcagcaaggtcctcagctgggccagggccctggtactttcagctccctcttggctgctggaccaggtgcaatcaccaccatgggccattggaagctcgggatgcgggggacagagccagatgctggggtcacgcaggggtgcctgttgcctgggcccagggcttgttccctcatttgcgtaagagaggtcccgtgcccactccaccggctaccatgaagaagaaacaggaggtgtgtgaagtccctggtgcctgggcatctgaggaactcttcctcctaggaaggcagcttggtggcacagtgtggcccaccgtgcagggctgccccaggtcccacaatcagctaggaagagcctgtgcttggctgcagcaccccagcactgctgtgtgcctggactcctgacctagaggggtcaggaaggaggagggagcagaggcaggtgctgagtccctgcacgtggctcatggccgggtaggagagggcctcatttgcacagggtcgggcagcatctgagacctcccgcttgtgttggctgcaagctcttcccaggggaccaggacctcacccctgcagggcccacgcccaccctgcatgaacgcagggctcaacatcaaaggacgtgaaggccacaacaagggaaactgaggttggcaggtaaagaaatgccttggaacttggatttgaagagtgcagagatgggggaggcgcagatgctgctggagtcaggagcgtgggcagtacagagggcatagagcgtggaggggtaggttccagagaccctgaggagtgaggagggagctgcctttgagggagggggagaggcaggttctgctcctggcatggacctggctgcatgcgggccccactccctaggtggacgatgcagctggcagtgcagccggaggtgcacgtgcgggcagaggaggcagcaggccctggaccttctgagtgtgaggtacctgaggccttccggggagcaatgccaggcttccagatgatgtccaaatcaggggctctggagcatgtaccagactggtgacagggattttccgcctgtcatctgctgagccactggccaagcctccggccacatgggtcccgtggcactggctgtcagcaccccacttgccggcccccacctcctctgcgttcagaacacaacccctgggaattctcccttcctttgggacccgtggggatcttcgttttgttctgaagttcacagtgaatattttcaataaaagacctgccggcctctccatcggcccccaccacttggctgccgcgtgctgcggtgcccccgtgacattacccaggccagctccccttccctgggccaactgcccagcagagggaaggcttggagccctgggggctgtggtgagtcctggggaccctccctggcttaagcagatgctaggcaggggcagggcttgctggctcttgtcacccgccccagcctctgaaggccccgagacccccgtgaatccttggaggtgagtgggctgcagaggccgctggagagtggcacggggcaggtgcagaggagcctcggtagttcggcgggtgctggggggacgaaggggaagttgtgtttgggaacctctgtgggggctgtagacaggaggccccagccctggggtgaagagggggaagttgtgtttgggaacctctgtgagggctgtagacaggaagccccagccctgctgcaggacacctcagaggggctcgcacagctgctggtcactcagcatggccctgctggcttgggctcaacctcagcagcctcacacctctgctgggcaccatttcccaaggacacgtatctgggagccggaccagagcctggccccttttctggtcatagaccttaaatactgcagaccttctcctcgccccacactgggaggtgcaggcacagggcagaagagagtggcctggtctgatgcctcaatcgttcaagagagctgtggctgcaaagccaaaccatggtgtctctctcaggccagcacatttggctgtgtctgtgtttgtaagggcacacaggactctcgtggttgcaagagacagagagctaaatgaattgacctgaagaattaggatgtccaggggtgcatcaccttcagccatagctggatttggggacctgaacagtgtcagcagcacacggggctgccctcatctctcgcctctgctgctcctgggggaaggaggtacttagcagtcccagagtcacattttcccagcagagaggaaagcacgggagtcttcctgtgcacaccaacacacagcatcaggttccagtggcctaacaggaccccttgggcactcctggagctggggtgcagtgggattggctccccatgagccatatggggtgcaaataggggagggtggtttactagcagaaaaggtgtaatggccagacagggcaggccaccgtgctgtgcaaccccaggtggctctgtgagggtgtgcaggtgctgggcaggccaggaccttctgtgtccaccactgaggggtgtcctttgtcctctgctgtgcgggggtatgttctgaggactggcccggagaggccttctctcctttagtgcttcctttttctccctgaagcacggctgaggctgagcaggcctgggctggagcgtccatctgtccgcggggcagcccatcccgtgggagtttagagaactgtcaggactgcccctgagattcggcacagcggttcctgatgcgctcctgatggccaggccggccccaggagcccctccccaccctccgatccacctcaggtcataaaaatggcattggatgagctgtgtctgttgaagttgcaaaaattaattcaaagtcagtaataaagttataaagggctgggatgtaataatcctaatgagcatcttttaataaagtacaccagtggggctctgtgctgatggcccccgtggggctgagcctgccttctgcttcccagagcctccaaagagcctgcctgcttccaagcagggctttctgctgtgtcctgattacacttccacataaacatatttcatcttaatgattatctttaggggaatacacagccacagagcgactctctcttggttagtaagaaatggaggggatgaccttgttcccgttgacctcccctgggtggggctcctcatgttggaggagaggctgctggtgctccaggctttggtcctcctgagcctggtggtggcccctgcaggccctggcagtgcttgtgtgcaggaactgggctggcattctggcctggccatttgccaacatcatggccttagtctaattccctgagcctccctctcctcttctgggcagtgtggcagttctggctctgcagggcggtcattaggacttacgttttggggactcctaagcactggaaaaaggatgacttgttcccatccacatggttggcaggttgaggcagtagcacagcacctctgtctgtgtgcaggtgcctcagtgagtgtgccgtctgccctcaggccatcccctacctagtgagtgtgccgtctgccctcaggccatcccctacctagtgagtgtgcctgtctgccctcaggccatcccctagtgagtgtgcccatcccccccttgcgccatcccctagtgagtgtgcccatcccccctcacaccatcccctagcaagtgtgccatctgcccttgcattcagccagcagagtccagcagagtgggaaactgctcacaggggatggggcagctaaggagagggctgggaaagagccctaggcttggaacccaaagcccgcccaacagcaagatgataaaaaggtgcctcgctacattttcttctagcacttccatgacttccttttgatcatctcatccacttggaatctgtttttgcttaaggcatgaggtcaaaatttgaccttttcctccctctaaccagttgtcctaacatcattaaaacaaagaaagaaacaaaagccatttatctccccagcctgctctcttccttctgattttctcctgcagtgagcaaccatttcaggtgatcaaaccgtatcctttccttagtgtacatttttgcaacatgagtgttgctgtcttgcgtctgtgtatccataatttatgtaagtcgctctgaattgtgtctcattctgtttcttaccttttgcacttggcactctgtttttaagatccatccatctatgtagatatcaaacttctaaccttggtagcactttgtgggatgcccccaccacatttgcttctcctctcacccactgatgacccccgtgttgtttccagctcccctcactccacccaagcaatgctgcaaggggcagctccccattgcctccttacagacctgtgcaagtttgcccatctgcaagccagtccatggggccgaacaatggcccatgggccaagggtcagtccaaggagggcactgggctatccgatagacatcctgtatctttaggatatgagccgcatggtgctcttcctcatgatcccctcagtagtgccagactgccaggttgtcccctcctgctccacctccgccgtttcctagcaccgtttgctacctgtatcatttactaattttattcactgtattgctacttgagcaactatttataattacatgcaaatgaatatcaaagacgattaatattaaagcggagagctggcacacgctggcagtgtaaggagagggcggcactgcccccgctggatggaggctcccggaggtgagcagatcagtctccaggtcgtggtctgacttctgcttctccgggaactgacaaggcccctcctggggaagtcgtgagcaaggtctcgaggaagtctgggctcagcacagtcaggcacctggtagggcccaggtggggaccacgcgctggacctgcagcggaaatacggtcagagggagggggctgacctgtacgtcctgcttctaagctcgccacggcctgcctccagctctcggtggggggaaagctggaaacttctgtgaatgttgtgcgtcctcagcagaggaggggagcgcccctcatcggcacatggccaagccaagtactgccaagaacctaggccaggctctcctgggcattttgtccccgggctacagatggcctgatggaggtggggtcttggtgaagacagttcaccccgtgggtcacgctgctcagtatggctcagtcgctctccacatctggtgcagagccatcacctcagggtcacttctcgccaccctccatgggcctcccaggccatgtcttctgtgttgggctcccgttttctctatctgtgttgggcttccgttttctatatctgtgtcttactctttctttgttgccttttttgtttttgatggtgcacacctttcagtagcttcttgagaggagtgcttgtcacataaatcttttgagaactgacatgtctagaaatgtccttattccactttcatacttgatggggaatgtgtctggatgcagaattccagttggacaatcattttccttcagaattctgaaggctttcctccactgttttcctgcatcgaatgctgcttttgagaactctgagtcattctgattccaattctttgtctatgacctctcctgtaacctgattttcccccttcttattctccgggagactttgtagaatgtggctgtcttcatggccagcctgggattcagctttcttgatgtaccaagtctgttaccacttgcccatctgtttccagcctcccacagttcccttgttgtttcttcccctcctgctctgcctatccttggaggcttgtgactttaaattttttttaaatttctttactgaacttttaatgggattctagaaaggagccaaatcagatatctgtgttcaatccgccattttaacctggaaaccccacatattcttggatctgtttttggaagtttttttgttttgttttgtgtttttgagacggagtttcactcttgttgctcaggctggagtgcaatggcgtgatctcagcttaccacagcctccgcctccccggttcaagcgattctcctgcctcagcctcccgagtagctgggattacaggcatgcaccaccatgcccagctaattttgtatttttagtagagatagggtttctccatattggtcaggctggtctcaaactcccaacctcaggtgatccacccgcctcggcctcccaaagtactggaattacaggcgtgagccactgcacccagcctgtttttggaagttttattcagctccattgatctgtttctttcatgacattgacacaactacgttttcattaatattattttataatacactgcattaatttgaaaaaaatatgcctcctcattgtcattctttttcattatttttctgtctggtgtggtcttccggatgaatgttggaatcactttgttgggttttaacaattatttgatggagattatttggcggagaataattttaacaattattttaacaattattcgacggagattatttgacagagaataattttaacaattattcgacggagattatttgacggagaataattttaacaattattttaacaattatttgatggagattatgccaaatttcttgattcatttggaggaggaccaacttccagtccaggattatgtccatgtagcttcatttactgaggtcttcttttgtgtttttggagaccttagactatattatactactttttgtgtagtcgttgaacattcattagtttttgtttgttcttagatacttgggagttttgctgttatagctgataagctcttttttccactctgctttcttgcgggttattcctatgttcaagaagtcttgatctttgcattattttatgtgagatgaggagtatctgttccttgtggatttggttaaactcttctatggaagcatttctttgactgctctttcaatttcttctgaggttattggtttcttcaggttttctacttgagccatgagtggaatgtatattttctatttagtctaggcctattagaatggtgcttttaatttcagatgtttagggtttagggttttattgttatctctgattttgtctcagtaatggtgattgtgggcacggcttttgagttgtgtcctaatgtgtctcagtaatggtgactgtgggcacgatttttgagttgtgtcctaatgtgtctcagtaatggtgactgtgagcacgatttttgagttgtgtcctaatgtgtctcagtaatggtgactgtgggcacggcttttgagttgtgtcctaatgtgtctcagtaatggtgactgtgggcacggcttttgagtttttgagttgtgtcctaatgtggtaaaatgtggaacttctcccgtgtgtgcttgacaaggtcacgtgttctggctgttgggtttgaacgttaggttttcctattaattcaaatagtttctatccctacctaatgctgtatcagacttgtctggaataaatgtattacagtgctcctatcactgtggccttgtctctccttccttgcaccaggttgaagctttaggagcataaagtttcgtatcttttgtatttttttccatgagttgtttgttttatcagtttatctccttaaatgccttggttggcaattacatggtacgtttctttgccccacttgttttaactcctcctggtcatttggacttggttatgccatatgcaagtaatttgtagctggattttgttccatctcatgcttctccaactgccaccacacttttgctcctgttctcggctccccacccccagtgtggcccctccggccctgctgcacctgcctctccttctatcccagttcccaactccccagaggcccccagctcgcctctgctgggccctctgttcccagagcacctctctgccatggctccaggcccctcacagccctgcggttacctgtggggcactggggacactgaggcacaccagaccccatggtctccatcccccagggttctctatctgagagggaaagtcagttaatgcccaggcaaattcacaaatgagacaagacctgcctgcagtggagtgtcacaggaaggaagagcacggggtgctgtcgggagaaatcaggggagggctgatttcaatttgggatgaaataaggaaagttctcccttaggagctgacatttcagcagacacctgaaggaagagagcaatgagggggcggccatcccatggagaggggacagcagtcggccgtgtcactgaacagtgtggtcctcaggttttaagcatccctgccccggcccctgtccctgtcgtcccctagtggcacgcagtgtggctgtgcaggaggcagatgggggcagaacatgctcctgtctttcaagagctctgagtcccatgggaggcagcgggctcccttccttctgggtctttcagggggcctaaatttggccagcacagcggcagcagcaaaaagggcatcgcaggtgaagaggccagcccagaaaaggcataggactgagcttcgcacaggggacagcgaacacccagccacccttagcactgcaaagcccctgcctgacctcagagcccacacctgcccactgcacttgccctcagcccacacctgcccactgcacccgccctcaggcccacacctgcccactgcacccgccctcagggcccacacctgcccactgcacccgccctcagggcccacacctgcccactgcacccgccctcagggcccacacctgcccactgcacccgccctcagggcccacacctgcccactgaacccaccctcagggcccacgcctgcccactgcacctgccctcaggacccacgcctgctcactgcacctgccttcggagcccacacctgcccacaaagcccgtgcctgcccactgcacccgccctcagggcccacacgtgcccactgaacccaccctcagggcccacgcctgcccactgcacctgccttcagagcccacacctgcccacagagcctgtgcctgcccactgcacctgcccacagagcccacacctgcccactgtacccaccctcagagcccgcaccatcccacgatgctcccgaggttgcagactcagtcccaggttttctcttctctagtctaatcatacttgtttctacaattctcattctcgcaaatcacccctcagtgctggtgaagtacagaagggctccgggcatgtggacaacgttggactcagaggcctgggcgcgtgcccactcctcctctctggtggtgtggcttgtccaagtcatgtaattttcctgctccttggtttgtttccctgatgctgaaataggacgatatgctgatggtgacacgcctccaccttggcgaggggattggatggctgctgggggtatggagctgccactgtgaagggctgtgcacacacccctgcctggagactcggggtgtgcctaggatgctggcagttgcagcccttgcccacgtgccctgtgcactgtggcactgtggatgagcccgtggctactgtgacccacccgttcccctgatggaattccctggacagaactgctgcctcccctcattccatcctctccctgtttattgattgactcttcgatagagtctttttgttccattctagagactctaaaacaggatggctctggagtgcttcccacagtgtcattatttggccacgatgtgagcaaagagatctccagctgccatccaaaaggggccctgagcacagggaatgccaggaactcgaaagctctgtgttacctatttaaaagatgggatcctgccacagacacctcccttcagggtagctgcagcccacctgggtatgacttctggggcttggtcaatcagcacccccagggggcccagtgccttcttgtggggaaggctgcacacagaggaaaggaaggccaagggcagtgtcatcctcctgcctctgcaggagatgggtgcgctgatcactcatccaggcggggtgagtgccgagggatacagcagaggctgtgtgagctcccagtcaccacagctcagcagggctgggctacacagggagctcccaggggaggaggggagagcagcaaatagccctcttctgccttggagggaccaagtggaacaggggctgttagaccaggtaggcaaccagtgcaggtgggcaggcccaaggccaaggttgacttcaaagggatcactaggaagacgactcaggaccacgccaggcccactggccagagctccctatagcaaggctctatttggggaacaggtctgcaagggccagcatgtggtcagagtctcttcatggcctgggttaagcccaatgtgggaaaaactgaggtggcactcgtgattgacagggtcagggtcaatcttattgtggggaaaactgaggtggcactcgtgattgacaagctggggcttcagcctgactgccgggtcttgttgggacagaggaggacaggaggggggctgggccagagctcctgttgccccaggtctgagggcattgcagatccccctgctcttagggcttctccccttgtcctgtccagcctgagcaccactgaggcttccaggggccagacgcagggcgtggctgtcacctgccaggtggcccaggcccctgtcttcctctcctcacccactttgcctttgggccttgggccgtctctctaggcactggtcctgggtggagggatgctctagaacataatttccaaatttcaccccaaaattatcacgattaaaataatgatggcaacaataataattccatttcaggtgaaattcagattctaaatctttagaaacctttgctgtttttaatgggcttgcaacacacagtttagttaaaaactctgcctgctcggcagaagcagcctcaagacgtgccccagcccagctctgtcccgatgcggcacccatgccctcctacggggaatgtctggaggggtccctgcatggggactctggggttagggccaggaggacatactgtgataccttctggtgccagaatgacattgacagtggcaggcaggtggcctggtgagccaagccctgtgtgttttgtctccaggtgtggcccctcaattcacagacccgggctacccctggggtggccccatctcttaattcctcaagagaagctggatgttctagatttttaaaacatgaaatctcccagttttcaaatactatcaaccagatggcaccacgtgacctcaacgagtgcctctgtggtctggttttgccgagggcaccgcccgtgtgtgacccctagtttgacaagggcagagggtaacgcccggcctgttccccagggaggaagagttttcctatggaaattgccatcactctccttcccaaggtgattctgaaggtgagctgtctctgttcgttggaaatgcaaagaaataaatgtacaaaaatagagtggcgattcctcaacccccctgtcaggcttgagttgctggcgcttcctctgggaacggcatggatggccctgagtcatccaggcagctaagtggactgctcggctccccacagccctgcccgcaggcctgccggccccacccctgtccctggagtggccctggaaagtccttgctgtgtacatgcatgtgtgtgtgcctgtgtgtgtacatgtgtgtgcatgtgtgtgcttgtgtgtgtgtacatgtgtgtgcatgtgtgtgtgtgtgcatgtgtgtgtgcgccgaggggacacagaactgtggagctgggggtggcacaaggacccccgaaggtactggaaccccagcagctgctcagccctggccccacttactcctcttctctttcccagccctcaccctccgcctcgcacctccactgtctgtcttggtcttgcccacagccgggctgcaggtttgtgcctgaaacttcatgttcagtctgtcttgtctgagccaggctgcagggtgcaaggagagagcttctggccgagagtcggccatgctgggatgccatgggtctccccatctgtaaaacggaaatggccatgtccaccgagtggcctgctgtcagcactgggtgaggaagcgtgtgccgggatgagggcctggtaccaggctgcctcactgtccgagtggccgtgccgcctgcaggggccttgttctgcctccagggcctgtcctgggccaccctcacagggagggagtgcctgtccctgcctggaagaggcagcaggagagaggcgttgggggtgaaaagtgttgttctggaagactctttgtagagaggtggtgcagcagggacgctggtctccctcagctgcaggggcctcggggcctggccaccgccctgtgggtcagtgatgtcacgatgacctgcagccctgggtctgtcccgggccaggagtctctgaggacctgcctggggaatgccatggagaccctggggctgggacctggcttagacacagagaccagtgcaagggaaagggggcttccaggacactggggcttggggggcggtgggcagtgtggtctggggctgccatcgatgctgcaggtcagcctggccagccttgctgtggccttcagacgggcagtggagggctgggaactgaagcctggtccagggtggtctccaggcccgcaggacacagaacacagcagagacagcactgcacagaaggcagggacgatatccggggcagactccccaggatggcagccccaagtggccaggggcacaccctgggggcaggaggtcagtgcctgcccagggccgactgcagcggagctgccacagaggggttcatcttggtctctgcacaattcaatcaggccagaggcggtaccgttcacctggggagggggcccgggacctggcccagagatgtggggcctcgcttcagtggaggacttagcagaaagttctgggaggggcccaaggagacactggggaacatgcacagcccaggatgggcctcggtttccccagtcataacagctggcgatgacacctgggacaccagtcctttggcacctggcagcccttcgggggagaagaggtggaagggctctacccactccagcgtcgggcagtgcgggcaagggtggctctgcccactccagcgtcaggcagtgcgggctgaggttcccgacctctccatggctgaatgccagccctgggctccataaggcagacggtgatgctgggctgggtctctcacagtctcagcaggtctgatccatcgtgtggaggccactgtggcccctgctgtggctggggttgccaccaggggctggggaacgagcggtcctggaagtcacagaggtgcctgtctgggccctgctgtgtctgagacagcttggcaagtctctgccatcttcctctgcacctcgctttcctctgtaaaatggaataataccctcggttcagggtgctatgagttttaaatgagaggatggccaagctggcgcctggtaggtttgtgtccgggtgggtttgccctgccgctgaagacggtgtcctctccttgcaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtgagtggggtggctgagggggcagggtggggcggggagggtcaaccaggggctgggcaggccagagaggcccagctgggccaggtcccctgaggctctgccgatttccttgttagccggaggtgagtgacacagtctcagggaggcttgctgggtccccaggtgagacaagttgaccatccctgacctcagttctctcgtctgcacatcgtgggtgatggtaacttggtgaggctcttcacaggctaaggcgggtttgtgcaaactccagtcgtttgaatgacaatgtcattcaatgtcccgtcatttgaaaaatatgttttcttgatgtttgccacttttaaaactaaaatcatttaaaaaggcaaccttattttacctgaaaagctaatataatagtaagacataaagtgacgttattcagccccagctggatagccctgccttcttctcgctccaaacagaagccccttttctgtttaaagtagagattcacgtgcattagagcgagggccagacaccaacccagggcccctccttaaagctcgcagtgggaggaattggggagggaattcctttctccctgtgagtctgggctattgaaaggggtgtctatgtgccaccttcgtcttctgggcacctgcccatggtctgcctaacactaagagattaaagaaccacctccccctcattccatacccccaacaacctaagcaggaggtgccaggatgctgaaccgtgtgtgggtggaggctgtgcagacctttcctctctctgcctcatgtggtcagagccactgtggggatgaggggcgtccagtcttcaaaatgcaggctcccaggggagcagactggcttggctgagtcctgcagggaaaagaagggggtgagaaggaggaccagggcacggcctggaatgtgagatgctgccagtggggccctaggggcaggggggtatttgtgggaggaagccggggcttagggagggctggaggtggtgtggaagccgggcaggtgggaagttctagaaccccgtgctgcgtgtccacacctgtggatgaatgaggtcctctggggccgggctagaggcaggcagcagggtgtgcaggtctgctcaggatctgctgcccagctctgcttttcggaccaggggtgagcccctccaggagccaagctgacacatgggtcagagtccccagggccctggtgaaaagatacctcaggggcaggaggggatgtgagtgagctgaacactggacagagacaccaccttcatgctcactttcctcttgaccggtcttgggtgagtcagctagccctctggagcccagccttatccgtacagggggccgaagtccgctgcatcggcagaattcgttttatttgggagagcgttgtcacacttaccctcatcttatttttgaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagcccctactatgtgactgtgccgggcccatgctgggcacttgccatgctaaattatcttgggaagtcctcatgctaggtctgtgagactggcaggtataaaatcttggctgccttcacaatatgagttcttcccctagcattatgtcgccttccaacccagcggggaaaggactgggcttggaattacagtccgatggcgactccaggcctcgccttttccaggcgcgtcgttgggaacgctgctcccgtcctctgagccttagttttctcatctgtaaaatgggccagtgttttcatcgtgggggttgatgtgattacatgagataatgtcagtgaatgtgcttttcagtctctcagtagggtgaacacgttttcagtttccacataaaatgtggttttgttatcatgacagtggcactgtttagtgacagtccaggaggggtcacttctgatagcccaccaagggcgctgaccaaatgtggggcccgtggtgagtccttcatgaggctggcagaggcagatcaacctttctcctggtgcccagggtctctctgtcacaacagctggttggaggatgtctagaacgttctctcacttttgccgtccaactttattcaaaccctagtgatccagccgtaccccctattttgaataatgggaaggttcgtttctagaaaagcatgagaaatttaaaaattcttaaattgagatgagttttatcacaacagagaaaccgttttaggagacaagtctcagaagttgagaaagtatttgggccgtgtctgttgtcccctgttgcacagaagtgagcactgattcattcagcaaacgtgttgacagtgtgcttgtcatgggcacagtgggggtgtcctgcagaggcggcggggcgtggcagagagtcccggggcgtgggagaccggcggcggagggtcagcggggggtctctgcctctgatctgagccccagctcccactgcaagagcgcagcgtgggcgagggagataaggcgcggccgtgcctggagcatggcattgccctgacgatgaatgccctgcgtcctcactgagagcctctgcatgcccggagagtcctgaggacagatctaagctatgtcggaccctttggtggtcttggggaggaggggcattgagcaagtgggagcttctgagaaagggtgaccttccagagccctgctgtgcgacagagcttcccgcggtgctggggagatgctcgtctcgccctttctggggcagtagccaccggggctctggagcacttgaagtgtggctggtgtccttgaagaactgaatttttaatttaacttcttatttgttccaagagaattttaatttaaaaaattttaattgcggtgaaatatacagaacataagtcaccgtcttcaccatttttaagcgtgcgattcggtggcgtaagcacattcatgtggctgggccaccatcgccaccaccgtccacagaactcttcatcttgtaaaattgaaactgtgcccattgagtttcagccctttcctcccctccccccgactcctggcacccaccactccactttctgtttctgagaatttgactactctgggtacctcgcataagtggatcaaacaataattgtccttttgtgtctggcttatttcacttagcatgacatcctcggggccatccacattgcagcatgtgtaagaatgtccttccttttcagggaggaccagtatcccgtgtgtgggtggatcggccacattttgtttatccagccatccatgggcactccggtggccccctcatgggctactgtgaatagtgctgccgtgaacgtgggtgttccagactctgttttccgttctcttgactatatgcccataagtagaattgcgggacacagggtaattctttctttaattttttgaggagtttccacgctgtttcccacagtggctgtgccattttgccccccaccaacagtgtacagggattctagtctctccaaattgtcaccaactcttgtcttttttttcttttttacggtagccaccccgaagagtactttgtttggattaattttcacctggatggaagccgcagtgtggctggcagctgctgtgctgaacagggcagggttgggcctgtgcacagaggatctgcctaccgtgccctgtctctgaacttgggtgctatgggggcctcgaaccacaaccccaagtggccctctaaggcctggccagtggcttgtcacactcctcttgtaagtcccagctggtcacagggctccccgtggctggagcgaaagcaaaagcatggaaggacagacgtggcagcagccggctgggactgggctcccagtgaggtgtttgtctggagctgtagagcaggtggggctgggcaacggcacatccagagcccggggtctgggggccagccctgggcaatgagctgcccactgaactggatgcagagaatggtggcacagcctgtgccctgggaaaggccgtcgagccctgggaggaggagctggtgggggccctgatggtggggacccagggaatgcaggctctgaggaggaggtgaggtggtggcaggctgagtgcaggcacagctccaccctggcagccctgcactgcctcagtttccctcatcatttggggtgacttctgcctgcagagctccctttgggatctctttgtggcagagcctgggctgggatatggggtccaggggtggcacaggcagttcagcctcatcgatcacccctgtgctcccctccccagtctcccttgtagctggtgtggagctgcatggccagttttgcctagtggcctgtgtgaaaggaagtgacctgggtcacctgtggaccaaggctggtaagagcttggagtcccctccatctctgtctcccctgccacggaaaccttggaagccatgtgtcccagtaggtacagctgcaacataggctcgggccctcccgacccaccccgcgccatggtgtgagtaaggaaacacggtgtgcggtgtattgtgttcagctgctgagatggggtggattctcggcatagccatcctcctctgtctggtgcccctggctgccgttcatacgggggccggtgtttatggggcgtctattatatgtcaggcaaggggtgcagctgtgagcatgacaggacgtaaccctgctaccttgcattctgggaagggaggcacagacgatactgaagtgaaaaacaaacaggatcatttcaaataatgacaaatgcaatgaaagaaataaaatagttaggagatggagaaggaagaagggtaggggaaggcaggccactttctacagctcaggggctggtgcactggagatatcacgggagcagaggctcacgacaacggaaggatgtgggaagaggtaggatagggatcgcctgttccaggtttgggggagggggcaggcggcgccaaggccctgaggcaggaatggggccggctggaagaatggaggcagcctggcctgtcaagcagggggcacaggtaggggaagtcggggccggcaaggccggccgccgcagtcttccagaggtggaggggagccgcctgtggctccgggagcagtggaaatcactggaggggctgcttcctgtctatgttaaagacaagacgtgatattcccttttctatgggaaagatgaagctgcccttttcatctcagacttgccagaagggaagcggcttggaaatggagcacttcatgaggccacctgggcacagaaaggggctctttggtttaggcaaccacccacctgcccactccagcagcccctgctgggtccagttttcttatcttcctccttacatctagaaaagcatgttttttggtttattgaaatagtccatatttaacacagatgatttattttatttatttatttattgtgagacagagtctcactctgtcgcccaggctggagtacagtggtgtgatcttggctcactgcaacctcttcctcccgagttcaaacgattctcctgcctcagcctcctgagtagctgggattacaggcatgcaccaccacggccgtctaatttttttttttttttttttttgtatttttagtaaagacagtggtttcaccatgttggccaggctggtcttgaactcctgacctcaggtgaccacccaccttggccttccaaagtgctgggattacaggcgtgagccaccgtgccgggacattttttttgctatgtaaaattagcataaattcctgtaggtatgtgaatgtcttctcccagcagttaattgtctactacgttgttttaatgattgcataacatcgcaccatatgactgtcacacactttttacctaacttattatttatatgacatattcacatagcaaaacttatttctccattagaggtcagacatgccactaactgtatcacgttcatagagttgaatctatcgctcgtgcttacttatttccttaagctgagttgctgaaagcgaagtctctggccaacagatatgcccattttttaagctttctacactggaatgttctctgttatggtttcatctattcccgcttcattgagcaaatgactgtctccccacctcctcacaccactgagtccttttgagcagtggtaatttaattacaacggagataagtttttttgttgtaagttgttatttccttgatgttaatgagcctgcatttaaaaatatacgtgtatttgtaaacagagattattttatttttttgcttggcctattcatgcccttgattctgctgggatttgggggtgttttattcatctgaagagtctgtgtacttaagtagataaactttttgtctgtcacatgtgtgggaaatatttcccccagtcctgttgttgaccttttgttttattccgcctgggatagtttttgatgtcctacatttttgtgtgtgtgaccacagggaaagatcctgcagtctttcccttcccaggggaaaagcttctcccttgggtgatgtgtttgatgcctcctgccctccccagaagttaatcttctgagtttctgccctacttggcagctgtacttcccaagctccagttcctcaccaaccgctgactgttcttgggtttagccatagcagccctccacctgaatttctcccaaagtaagaggaaagataggcttagtgcagtggctcacacctgtaatcctaggactttgggaggccaaggcgggcggatcacttgaggtcaagagttcgagacgagcctggccaacatgacaaaacctcatctctactaaaaatacaaaaataagccgagtgtggtggcacgtgcctgtaatcccagctactcgggaggctgaggcaggagaatggcttgaacctgggaggcggaggttgcggtgagctgaggtgacgccactgcactccagtctgggcgacagagtgagattctctctcaaaaaaaaaaaaaaaaaaaaaaggaaagaaaggtgtggcggggagatagagaattcaaaggagccaatgtattacatgcaatgcattcttatttcccctcaatatctggctgctgcaaaactcgtcaggatattaccagtggggaacactggcctaaaggcagagccagtagtaactcccaggccccaacgcacaatgaaaatgtgggatcgcttgttcaaagagcagaggaaggtgccatacaaagggactattaagccacttcctttcttccttagtctctgtctctctgtctctcaactcgctgttctttttatttgctttttaatattgttctaagtgaacaaaaattggaaccttgaattattagcatgaatttcttattcatctttaaattgtgcgatggctattttaaatgcaaatattagagcatttagcttctatgtggggtcactgaaattaaacaaatgtgtattttgtggctgatccctgatgggtgcctcaggctgaccagaagtttatgacaggcacagccagactcagggaggctgggaggaagaagagaggatttcacagagtggaatcctgccgaggggaggctcctcaggtacggggtcctagcagagtgagtgcacccccagcaggaagggcacacccactggggtctgagagcttcctgccacccctggaagaacacattggctgtgccctggccagggcgtctggggaagtagagccaggcacgcccccttcctactggtgcactgctccagcccagagcgtatggccacggccaatcccatctctatgcaggtgtcactcacgggaggctcacctctgccgaaacacgggctctggccagccatccaccagacatgcccctttcctgccagccgtgggcgggatggccaccaccacgcctgccctgagatgccgtggggaatacatgcctgatcctgcccctgctgggggcagctgaaagcctgtcctggggagatgggaccatgctgcattgccccaggagccttcacttacaaaacacacatgcaagggtgagatgacgaagaacttcaagacagagctgcagagggtcaagccccaaggtcggggccttctgaggataggccctggtcatctatgaagtcagcctgtccctagggcgagcccagaaacctgagccctgcgctcagaccccatagcctgagggaacacctgctgccctgcatgtgccccctggatgccacctcagactcccgttctctgtggcctttccccagcctctgcttgggcatgtccacacacctctgaggcccaggcgaagccagccgtgctaagagggcactgggtgtgtgctgagcctgtggcaggcagggggcgggcccttgtccacagaggctctctgcagtgagttttgtttttttttttttttccttgagatagagtcttgctctgtcgcccgggctggagtgcaatggcatgatctcggctcactgcaaccgccacctctcaggttcaagcaattctcctgcctcagcctcccaagtacctgggactactggcacgtgccgccatgcctggctaatttttatatttttagtagagacggggtttcaccatgttggccaggctggtctagaactcttgacctcaggtgatccacccgcctcagcctcccaaagtgctgggatcacaggcatgagccactgctcccggcctacactggagtttgagcacacgcagctgtagccctcctggctgctggcaaccctgggatgagtctggtctcctgaggctcagcggcccttagcctggtcagagatgctgaggccccttggggatgcccacattcccccgtctaagggcagaggggtctcccttccaagcactgtgaggctaggaggatggagtgagagccgtgggcagatgtgtggcccatccagctttgctggccccccagccccgtcactggcagagtgacttctattccctctgccttcattctgctcctgctcctcccagctttctactctggctcagcctgcagcctccaccttgcgttgctgcctcccctgggcccagccgggaggataaggggctctcctctgcccaggcccgccccccgcccccgagggcattgggagaccactgtcatgtttgacctttcctgcttgggaaacatactccctgaagtactgggtgctgccaggctgggacacaggtgacattgctgaacatgcctgatactgaccctggggctttggtatttctcacattttcaaaaacttgctctgccagcgcctgggctagtctctgctcacaaaccagatgctgtggccatgtgtgtgggcctgggcacccctaaagagtgggcttgggcctgacaggcgaggctgccatgctaggaggcagctcagatgtgtgtggcacctcaagtttcgtccccaggtacagacagggactcttctgcaggctcaggtaaatgggaggcagggatgaatgccttggaagatcagagccgttgtggaagtaatatgtttatatatgcatttttttcttttttgagacagggtctcactcagtcacccaggctggagcgtagtgctgcaatcatagctcactgcagcctcaaacttcagcctcccaagcagctgggactacaggcacacaccaccatgcctgactcattttttaaagatttgttttagagacaggttcatgctatgctgcatggtggactcaatcacctgggcttaagtgatcctgctgtctcagcttcctgagtagctgggatcacaggcacgagccaccacgcctggctacagatacatttttaaaagtaaaatctatctgtgccaagacttcaagaaatataaagcttgggcccaaggctgaagcttcctttgtggcttcaagcatttcactaaagcgctaatttcaatcctactcttcccgagaagcctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagccacgcctattgatttatgaattgcctgtggccatttttgtgctacaacagtgggttgggtagttgcaacagaaaccatatggcccacaaagctgagaacattcactatgaggtgctaaaggaatttttgctaccaggctgtgcagaaatgtacttgcttagtgcctgccttgagctgtgatggccccaggcctccaaagtgagcatgtgcctttcactacatcagtgcacgtgggtgtacgtattagggaagtactgagcacagtgggctgctcagaccccagcccacccccacactagccttatcagctcaaaggaccggtgaggctacttcggggattctttttaaaggatagaatgaactgctcttaaccgctgtagaacggcagagcaggaggagcaggtttccgggcatgcagaatagtctctcccagctgtgttaactgcttatgttctgggagaatgcctgagcccccaaagcatctcttctgctgagggcagacacgctcctaggcctatggagaacgtggaatccaaggatcttctgcgccttcagtcgcggctataacctttgacccctcccagcacgagaacattctctgtacagtatgttctacgaccgttttttttgaatgaatgatttctctctatgccaggattcagatatttttcctcttttcatttctaatttaatccagaaattggcctggacttaccagagccttgccagggtttgcaaacaatccgaaggcatatgggctcaatttctcaccaactttcacgagtgctgagaccgcatggtggcggtggggaaggcagtggtcggacaggagtgttttcagctggtcgtggtggaaatctcgtaaactggccgcagagatgcaaaccagccaggcggaaggcgtcgccccaagtcatagttcacgagtcgctggctctggttcctgggaaagagaagaacatctctgaaactggacacgaaacacgggtcccttaagtggggggaggcaagcggggttcagggtctgctagtggtgctgtggccctgggggtgttgctggcactgtttctgttcctcacgcttgtcccgctggccttacagcctggccctgtgtgccaccaggagacacagccatgagggccagtggtgtgtgcgaggctgcacgcaaggctcagaagagggcagtgccctcacgtgctcacagtagccaggcccgaggggcccaggtggctgaaggctgttgggagtggtggggactcgggcgaccggagaggccacgcccccctgcagagctcctcgtggttccactcgcttgtgtttctgtaggaataagcagaccactgctgccagctcgctcttccatgagaagctggaaatctactttttttgggaaatctaattatttttcaatgtgggccacagattgaaattaagaagccacactgcacaggtgaagcagaacacggctgcaggacaagtctggtgtgtgggtggcctgagtgttctttccagcctagaaggaaggaggcgactgcctgtcctgctgcgccctgtgctggtcagtgccaactcccggggctgttgggagcaccactcgagttgaacaccaggaaagtgctcagtagagcacgggtgtgggaggagcatgctgggattgggagctgtcctcagtcatgttcggcactccctggactcctggcctccgcatccctgcactgggggagctcagagcacaggagtatggggagcgggatcaggacacgtgattacaccttggttcatcagggaagggtgcctggggcggctggtcagggaaggctcctcggacaagggccaccgcagttgcctctaatgaggactcctggtggtggcacagcgcgcgcaaaggcctggccgcatcgtgaatcgcagtgcgcagattgggccctgctggagcttgtggggcttggagagcgggagcgaggttgatttgtggtctacaaagatagactcctctctcttaggaggtttggggcttatgctttctatccttggaaacacccctccccacctgaggaggggaactcacatttgctggttttgcacgtgctggccctgtgcaaggaggcacacctgtgacctcactaccttgccccagtggccctgtgaggttcccttgcctgcatcaggtcactgagactgagagagacatggccagagcacggcagatggagtcacatacctgtgggaaggtggcccctgtgctggtcctcccctactgtctggcctgaagatcgagagctcccaaatcccctagcatgctccgcgggttctcatctcaggcctcactgacctccccacagcatttggagtcccctggccacacccgcctctccccgcaggccatccgctctgcctcttgctttgccttggcttctgcatagatctactgtgtcctcctgttctgaggcccacccgcctgcccactcactcccttagtgcacccggatagagcagccctaggtgctggggatgtcgtggtgagcacgggatccagaccgcagggagcacatgttccagcagggctggggaggccgacagaccagtgatggtgagcaggtggggaacactcgaacaggggtcttgtgggtggatctcacctctgcttcctcctgaaatgtgcagcaccctccccaccagtggacatctccccacctcctccctcctccctcctccgcagacctcctgatagctgatgtggaagcctcccagcatcctgtccttggcctcccgcggggaactgatggttgtcagaatgggagttagagtccctgtggacgaggagggccagccatccacacacccggatgacagcttgaggcagcctcggagcttgtcttgtgcaggctccagcaaggaggtgacagctgaaccacaagaacagaggcgatgatgtgccacgccgggctgtcgggctgacctggcgtgggctctcactccctgaggcccctcccaggctgcccctggagctgagttgcagtcaagcaatcctgggtcttcctccccagtccaggggtctccttggtggtgtgtctcagcagggttagggactcccacaaaggtgactttgtatcggacccagagagggtctgcccacctgatttttcactgagtacctggaaaaggcctggcacgtagtaggtgctcagtaaatctcttttgaatgaataagtgactaaatgaattcccataaagcgactgtgatctcagagactcccataaaaatgaactctatctgtgggtgtggaactcctcgtggctgggtgtccttatgccttcgcttctatgacagaggctgtgtctccatcgtccatgctgacgtctgaatggccaggtcccgggatacagtttctagttgcagcaggtttgccaaattgctcctcagagcctctgtactgactcccatgcccacttatgtgagcctctcaatctctctgtgcctcggcttcctcactggcacagcggggataacactcactcgcagggtgtgggaagggaaagatatcgcacgcggggaagtactcggcgtaggcggagaagatcagagccgaccagcgaggcgagcagttgttcactcggcccatgatgtctgggaagagccccagccagctcccgtcctggacaagcttttttctcatgggggccacctgcttgccttggcacagcgaggacagggccttggcagccaaaggagacggtcagctgtctccacctggtagtggagatagtcacagtggggtgatccttgagctggttttggtcacagagttggtgtctcccaagtggaaagtgggagggcatcattccacacagaggagccccttgtgcaaaagaggtgccagccctcggccaccctgggagcccgctggggtgggagaaggcgcgtgcggctgagcttggccttggtcctgaagcctggggaaacacgggagtactgagcacccaggttgcatcagcaagaatgcagaacagtccctgcctagtggagacggacagacagctaacaaacgaaggcgactggagatcacgatggtgccaggaagttaccaggatgggacagcacccgaggcagcatagggtgccccgtgggaatgttcacagagtgaggaaacttcagagcaagggaaacttccctgcagccagacaggaggaaggaaacctggctgcagcctgcaagacctcccacccgcgcctggcagggagcctggcctgggggctgcccatgctggcccttctgatcctgagcagaagtgatcacggacccttgtgcttccaataattcggcccctcttcctttggttctgggtttcctgtgtagcggtgggcaggatttcatctatctttccatctgccagagtctggcaagggagctaagccacataaacagactctggtggtgcagggggattgtgacctgctgcacagaagggcaaagccgtttcccgccaagcccaagaggcgctggaacatctgctctgggtgttggaaagcaccctgcatgactgcgctttcagggagggatacgctggcagcagacgacccttgccgtgagcttgtaatgcaggacccttcttgcagccttcaccttactcttgccctgcgctctgagtgccttgggggcccctgcccaggtcgaggggcacagtgcaaggtgatggcctgcagccctctgtcatgccttctcagtctctgaggggttcatacctgctctgccagggcctctcccttcttcctcatcatgcatggatgcctggggagtagggaggctggcctgagtcctcctcagctttgctctgaggtggtcgggtctgacgcctgggccacttaggcatgctggacccctgcccagtccaagccctatgccttgatgggtgtccactctacagcctctgccagccagtgccagctacccacgccctggccctcaccagcaggagctgctgcatcccacacacccccttctggagcgaggggcatccatgtgctgcctgaggcccattcattaacatgagatccctctccattctaaccacctgcttggccaccatgtgggttggcctccaccctcagcagagggtctcatctcagtgggaagtggagcccagaaccccggggactatctgcatctcaccctaaggcgggggcagcggtagggatagggctccggctccaagcctggtgtgggctcagcagcccgccccccaccccggcagctgcttgctgccccctcccccacaccgttcctgtcccctgatgccacagctctctcctcccatagcggcattttccttccctctttccttaggtcacactggtgacagagcagcggcagaatatgatgtgtgggggaataaaaatgcattgttctcaaattacatggtggtgctcaaacggacccaggtgaccgagctcagtcacgggatgggccgggccacacagcctctgagacgggcgtgtggggggatgccagggccgggggtggcacgagccctggccacttagggcccctctttgaaaggaaactcctcactgagccccccagggctctgtggccagggacagccgacaagctcagcagagttccagggaggcagggccgtcctgcagccactgctagcaagaatcagaatccctgacttttctcggcctttccctgtcagtggctcgcagtggccgagaggcccctgggggacactgggctctggcctgaggcctcggccgtgtccttctgcgtcctgcagcctcagcagcactggtccttccccgttctgcagcatttccctttctgatgaggcatccggtcagcgggtgggaaggtcagtccctaagtggtggcatggctgttgtttccccaaaggcgacgcagccagcggggagagctccagggctgggtcacactcgcggacgtgcctgggcacagcagcccctccagctctggaaaacacaggggcatgtgcaagctgttcactcagacctctcccaatggtgatggccaggaggagagccagggtgggtgtaagggcgaagcccaggtggaccattctgtgcatggggtcccagggaaacagcttgggctgttggaccctcctgtaatttgatgacagtttcattcagcctgtactaggtgctggggatttcacttttgtcacgcatgtccgtgtgaagagaccaccaccaggctttgtgtgagcaataaagcttttgaatcacctaggtgttgtttttacctaaatcagtctggcctggtgtatgacaacataaactcaaggatagagcccaaaaactcgccaaccaagcaaataattatgctgaacccccttgggcactctctaattggatgtcctgggtcctcccaattcttagtcctttaatacctgtttttctccttttattcggacgctgtgtcttccgtttagtttctcaattcataccaaactgcatccaggccatcaccaatcattctatacgacaaatgctccttctaacaaccccataatatcacctgttaccccaaaatcttccttcagcttaatctctcccactctaggtttccatgctgcccctaatcctgctcgaagcagccctgagaagcatcacccattatctctccatatcacccccaaaaattttcaccaccccaacacttcaccactatttcattttgtttttcttattaatataagaagacaggaatgtcaggcctctgagcccaagctaagccatcatatcccctgtgacctgcacatatacatccagatggcctgaaacaactgaagatccacaaaagaagtgaaaatagatagttcctgccttaactgatggcattccaccattgtgatctgttcctgccccaccctagctgatcaatcaattgaatttgtgaacaatacaccctctccgcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcctctactaaaaaaaaaaaaaaaaaaaaaaaaaaaaaccaggcgcactggcgggcgcctgtagccccagctactcgggaggctgaggcaagagaatggcatgaacctgggaggtggagctggcagtgagctgagatcatgccactgcactccaacctgggcaacagagagagactccgtctcaaaaaaaaaaaaaaattgctcctaactccaccgtctatcccaaacctataccaacgaatggtagtcccaccaccctttgctgactctctttttggactcagcccacctgcacccaggtgattaaaaagctttattgctcacacaaagcctgtttggtgatctcttcacatggacgcacgtgataattttcattgttgcttcaacctgaaacaaccctgagacacagggactattattatctccattttatagataaagaaactgaggcccagacaggttaagtaactggccccaagtcacgcagcaggattgtggcagagcccatgctggcacccatgaaatctgacctcagagtgggaatatcccccccacactctgctaaccccccaaattcaggagagggggaggggcagcctcttgccgtcgttagtacaaacccgggaaggtttgtaatgcgacctgtcttctcaacgtgcctgctggagtgccacactgaggggtgcagcacatctcttgagaccctgctgggctctgtgcattgatgagctggcctggaagtggaggagccccgtccccaccctgaggcatctgcagaggtatcagcagagtgtggacaggcacaggagacgtcgcctgaggagtgagggggtggccttgggcagagtgttcctgcgctgggtattgaaggaggggactctgaccacctcactttttgatgtatgaactgagcctagtaattctgatcctggccatttccgtttcatggtagtttgatattttgagcaagagtcacgtttcttctagcattccctctgaagcatctgctgaggagccgagggtgaagaagatctgcaatgggaacgttgattctcatgataagcccaggctctggcagccccgtttaggcaccatgcaatgcctaaactcttcctccacggaggccagcagacctctgtcccctgctcctggctgcactctcttctctgcctccatcctggtggtccaagcctggcctccgaaggggcacagagagaacagccttctcctcacttatttcagggggtcccagagaagccacagagcagcaggcccccctcccccaggcctctgacagacttttcaggcctggcttgctcctggacatggttttgccaggtgggccacaggctgcctctggtggcccaaagctcagctgagcgaaggacatgggaactttcctgaaggttggggtggctgctgttccagggcccctgcctgtctcctctgtggctggcgggccagtaggcctccccagtagggagcctgcaccggttcccccctttctgcacccctcccccaccttggcagaggacaaagtcacctctgcccagcagccgcaggccacctcccagggctcaccatcccctgggtggaactctgccaccagtgaggcaaactttacattgccatgcagagccgctccttcctcattgtctattccagaacagaaacttggctgcatctttgcataagcaaaaggcgcattacaatgtgtttccccaaacaagagagcccttggcctctctccgcacagagatggctgcggctttgaacatttccccccaaggtttaaagattccaggatcaatttctcagacagtactcaaggacattgtccctgggcttcccctccccctgcaacctgggaaaggagagctgcttctccccagcacacgcaggccttgggtagggtggatgcggaggaggcccccagggctgctggggggaggggaggggaggcccttagctgggggcctcccccatgagaggggtcacaggcctacgctgggtcatacattttgcccatttcctgttattccatatcttcaaagtgattcactccattcattcagcaaatgtttactgagcacctactatgggctagacactgctgggagcagttgcacggcaagtccaaagttcctgaggtggagacaggctgcctgtgcaaggagcagccgggctagccgctggagcacagggagcagggccagggcagcccgagaagactcagcagggccagaccctcctggcctggaggtcacgccaggaactgcggtctcatgccttggggtaggaagggtttaagcaaggaggtcactgcctctttcctttgagatatattttttaggatgagtcttttttttcaaatgctcctgagatatctaaagaattgaggggctgcacagggagagtgaggattccaggcctgaaccaaagcacaggcagcaggagagggcagccggctctggggaaggctggctgggctgtcaggagcaagggtgccatgtggggaggtatctgaagtgacgcatggagaagccagccagggccagcgtggagagggctccgaatgccaggcgaggggctgggccctgcttccgaaggcactggagagccgttgagggttttagacagtggaaggggaaggtgagatctattccgcttggtgatcgtagtgaagaatggtgtgtgtgggtgggggggtggggaggacacgagggggaccgttggggagccctaccgcctgtctcctgtctggcagagaaagtgggtggggccgggggaggagggggatgtgcaggaggcaggcatgtggaggtcgccttctgtcttcagttgctctttttgccacatcagtcgactctctgctctgcagaaatgttgccgctgtgtccttactgaggacgccagtgttttgtcgggaattacactgattactcccagtggttcccatgcccaggtgggccctgcaggcctctggccagggctgggcaggaaattttggcaattttgcagcctcctgaaaagcaggtagagccctgggatggtagagggggcaggacggggctcactcctcaggcccacggaggacaaggacactgtggagcacccctgcctctcacatgccccacaaaccctgcctgccccccatgtctgttcctgatgtatcatattaacctacggggactgagaggctggacagcagaaggagcccggccccggactgtgggttggactttgccatagcacacgcaggggcaggagaaccacccaggccagtggtcagtggtctctgggccacagtgccccatggggttcctgactgctgggaggggctgctgagacctggcctgggagggggccaagttgagggctccggagcaggatcccaagcccagcagccacccagaggagccaggaggccatcgcaagccccaccacggccttgctcaggcctgcctcccagagagtgggcatgcctggggaactatgtgctgtgctggtgtggaagggaggaagggacagaggtttcctggggagaggatcagggagagcgcaccacagttgaaggctaccagggagggagggctgagggggccttggctgcggcctggcctccttctccctggctacctgctgggagcatttgcaggcatgccctctctagctcctcagcagccagggagccccagttaatctccgaaccatctgaggcttccagaggccagggtcagggcacccagcgcaggaggtgggagctggctgctggcggacagcccacagtggagctccccagccaggggcccacgcctagcagcctgacaccccagggctcagctgcctcgaccccacctccaagcagaatgtgaggctgacggtctatcccagggagttccatgcccagcgacggggcttttggagtggttggtcacctcctgtcccaaatcagggagcaggattagatctgctcaatgttcagaaggacacaagattccttcttgagatgagagctgccaccttcggccccaggggtagggctaggagagtgggaagatcttgcgtcctgaggggcagggcctggccaggagccaggagagggccagccccgcatctcctccctccgccctgtgggagctgccggaatgcccttccagagccccagcctctccctgctcaggcggggcagatgacccctattccaatccacatcatccctcacatccgtcccttctctgcactcatccccaaagctgaaccccacattcccacatcttgaccccttccatctactttccgtaaggcacctggagtaagcttcttaaatgccccgccatcatccttcctccatgtcctcccactgctcttagagaggatttggaatccttctcctgacttcgtggtctggcctcagtgctcccctcccacctcctctgctggggcatcccttccacatcccctctgtgcttggaaggtgcctcgctgcttccaaccctgggaggtttgcatgggctgcctcctctgccaggagcgccatccctgctttgctgagctaccctgttctgtttctcaggtctcatgacatgccacgtccttccaggccccagtgggcagattcccactaatatatcctctggttccctgcctttccctcgaggccggtgatcctggagctggtctcgtagcatctgagtgtccctctccgcctcctggcaggagggctggctctgatctactcagagccacaattcatggtgaggcagtggttctgctgggtctgctgggtgccagcctcagcccagtggggaaggagagaccaggtcaggctcgcccaggccattctgggtcccagggtgtggtgggctgcacaagaggccagggtcagtttagtttgagaagtcccattgagagcctgtgaggggcccgtggctgtgctgagggtctgtgtggacggtgaggtcaacatttacacgcttaggctcaaacgtggggaaaaatgcaactttctttcattcttttttttttttttttttttttagacagagtcttgctctgtctcccaggctggagtgcaatgacgcgatctcggctcactgcaacctccgcctcctgggttcaagtgattctcctgcctcagcctcctgagcagctgggattacaagcgctcgccaccatgcctggctaattttgtatttttagtagagagagggtttcaccgtgttggccaggctggtcttgaacttctgacttcaggtgatccaccgccttggcctcccaaagtgctgggattgcaggcgtgagccactgcgcctggccagggctttctttcgttcctatatctggtgctgccctcatctcgggcactcagccccaggatagaaggaaggctgcagtctggcctgtgggaggtggctcagtctcttccccataaagcctttgtctcattccgcttgggctggtataacaaaatgccatagacccaggggtttaaatcacaggaattcatttcccacagttctgaagactgggaatttcaagatcatgttgccagctgggtcattccccagtgaggattctcttcctggtttgcagacagccgccttcttgctgggtcctcccacggcagagagagaggatgcaggctctctggtgtctgttcctataggacactaaccctatcatgagggtcccacccccatgaactcatctacccctaattacctcccaaaagccccatttgcaggcagaggcctggtggggggcagtagggatgagtcccctctgcagtagccttgcaagcaggcctgccctcctctcctgtaggccagtgcccccctgggcttgccctgaagcctggtggtgccccctagagccaggtaaacctgcaagccagtccccaactatcttgcccatgtgtctctggggtgcaggggaccctggcatctgctacacacagctgggagctgggccaccctctcaggcctgagcaggctgggccaccagttgggccctggaagccactcctactgctaggaacctgtcccctctcaggtcccaggcagcagccaggatcaagctcttttgcatttccttccttctcagatgtcaggactgttctgtatgacctgtgaggttggggttgaggatgaggagaagcctggcccctcatccctggcctttctcctctctcctattctgctcccttcagctgcagtgggaccttccctcggtcagactccatgagccaagctggccaagctttgtcgtgatagagaaagcaatactgtggacaattacagaaaccccttctctcttaagaaaaactggcttttaaggctactgtgccagcgtggactaaacaatctagtctgaccctcaaagctgggcaaggacttctgtggtttaggggtgcataccctacccccaggacctcacagggagctgcagggcactatggtttaccagcaatgaaaaaccgtttcattgtttgcacaagcaccattccattgcacctgcatgacggtttcatccccacaacagctttgtgatggggggactgcaatcctcattttacagaggaaacggagggcgatgaccaaatggcaaggcttcctggggacctgggtgccctcctcggagctccatcttgtcagccacaggggcgagatgggtcactgggggtctagaggataaccctcagcgcctacaggggttgctgacccaccctccccagacgcctacagcccggagccacggtgaccagccacgctcccgtgggtctgatgagttgtcccttgcctataggaaagagaggtgggagttgtggggagcccatttacaatcagatgtagatttgctgggcagcagttgccaagaggagctgcgtttgggctggatggtaccctcagcagggtccacatgtcatgaactctgccccacgatcggtgccatctttgttcccagcaccgatgccagcgggcctcgggatccttgtcttgcacgccctgtatgcctgtccacccatccatcatgatgtcattctccttgtgaaccctcgggtttcctgaggtgccttcccactgttttgaggtagcaatcactgttgctcagatgcaggctctacagattggagtgcagggagtgtgtgctggcctgacgtggcagcaggctccgggaagtatgtcttggccatgtccggagctgtcagcagcccctgggctcggtctgcacacagccagtccctgtttctccacttcttgatggtgccaatggcttcagcctttcagcgggtatccctgagtgcctgccaggtgctgcttagcctggctctgggcgtgcaagcagggaggatgcaggtggctgcccagcccacaggggcacacagagggctccagaaataacacaccttgtgcttgatgaggggcggctcaggcctgcggggggccttccagggggaagtgactgctgagctggcctcgaggaggagtggggtttggttaaccaacaaaggaggtgacaggaagggggctgcgctagggagggccctgggtgtgtgcggtgggaagctggagggtgggggctcagtgcgaaggaagcccctgacagcctcgagcccgggataacctgacctatgtttctggagggtcttgctggctgtgttctgtagaaggggagttcacccccctgtttttgtgccacgggtccctttgatatctgctgaagcccattggcacctgctcagaataatggttttaaatgtgaagaatgaaacacgtgtaagaatatgattgtgataaatacagagacggcgactgcaggagctccagccatcaaaacagaacagggagagcacattggggatgcagtaatatgagctttttattaacacgttaaaacattatacctggtggtgggcctagaaccgcccccatttccaagtagcgatgcaggtaggtaatccccacacccaccagctatagcttggagtgacttctgccagggccggtcccagccctgcctgtgccgcgggggtccatcacccacgttcactgttgaagggaaggttgtgtttcagctggaggctacagcaagcgtagggctgctttccctgcccacgttccatgttcaggccccaggtgaggaaaccctgggctggtgggtggggttgctcaggaaggggctacagtgatcccagcaggtggtggtggcagcctggagaggcagagggcagggggcaatgagggaggggtcacaaggtggctcctagttgatggtgacgcctgggtggaaagcatgggaagaagaaggagcaggtgggggtcatcccattggcagagccagagccagtcctagggcctgtggttcccgctgatgcctccctgtttctttcaggtcaatgaaatctaccatgacgagtccttgggtgcccacatcaacgtggtcctggtgcggatcatcctcctgagctatggaaaggtgagtgcactgtggccagccgggcctgcctccaccccctcggagtgaggggcctgggagtgaggcatgggcctccttggagagtgtgtgcgtttgccagaaccaccctgcctctccctggctcccctgaggttcctataagaaacaagatccctgctccctttcaccccttgttttaaaatgtggccattactattgttcactgaaaagagtctgttactcccagatcccaagaggaagagacataccaggccacgggggccacacagggaggcaccaggggtggtcaggaggcagagggaattgggtaaacagcagcctgagtccatgttgtttctgcaggaaggaccgatggggacagggtgagctggcttaaggttggccagtttgaataattccagtgggctctggggagtggagcggtcctgagttagttttctgggtaatgagggcagggggatagtggctcagagtgtgaagtctgataaaggaggtggctggggacatgggcgctggattggttggtttgtatctgaaaaatgtgctcatggatgagttgtttcctgtctctaaagattggttaccacttagcggggcagtccctccagagtcagcaaggctcggatgtcaaagcatcagaaacacgtggttaacacgaccctcccttggacttctgcccccgtattaaatctgtggcctcctctcctctggcctcggctgctgtcccagctgggctctcttgcccgtcccacttcctcttgcagccaaacctgggacgtcctttcctggcggtgtgcatgggtgtgtagccgccagggacagtgacctgggatggcaacacgggatgctgtgcagacagaggaagagaggagccccacggtacggcccgtgtagactgcaaagtgcctgtaccagccgtgtgggaagcactttgtatggatgaatgcccttaatctacagggcagatggaggggtgcacactgtgactctgcccatttcacagataagaacaccgaggcttaatgtgacttagtgacatgcccaggtaagcagccagggccatccagcacccgaggagtcaggcttcttacccagacagcagaattcgagcctgtggtctggctgtgcatagaaaatcaaatcataataggatcaaatacatcagataattatataaaagttgaactctgttcaaagagaatctcagtctcaaaaaataaaatcaaactgcatacaacttataaggcacacgatgtaaaaatgatgacgaaggactccggtggcagaagggatcccaggaatactaagtagatttggggccacttccctacacccaccaagcacctcattccacagtgaccgaaggcacccacagggcggatgccagttgcaggccttcgtgtaccccaagagaacacaaaacatcccaaaacaaatccttggaacaaaggggaaattggcaaaaacctaactatgagagtctctaatacacttttaaaagcctttcacagattagatgctaataaggcatagaatttttgaatgacacaatgagtaaagctaaattagtagttatatcactgtttcccttgccctacagaaaaaaagaaagatgaaccttcttttcgaggaatcatagaacacttaaaaattacagaagtgttttgggtcataaagaaaatattgtgaattttatacagctaaaacgattttgtccatgttcgctgatgaaatgcctaaaagtaggggtgggggcagcagaatttataaacctaaaaaaatccaattcatttgaaaacattaaaaaaaaaaaaaacctactaggggccaggcatggtcgctcacacctgtaatcctagcactttgggaggccaaggtgggtagatcacttgaggtcaggagtttgagaccagcctagctaacgtggtgaaaccctgtctctaccaaaaaaatacaaaaattagccgggtgtggtggcatgtgcctgtagtcccaactacttgggaggctgaggtgggcgaattgcttgaacccgggaggcagaggttgcagtgagctgagatcacaccactgcgctccagcctgggtaacagagcaaggaaagagaatattaggactgcagtacagactatttggaacactaataaaaacaagagcactactgtcaaatcttttggaatgtggttaaagctgtattcagaggcaaattcacagatgttttccaaaagcttcttccttgggtgatatgttcgacacacattagccctgccttcaactcagtacatttgaatgaatttcaacagcaacaaaaccaaaaacttaaggaaagcaaaaataaggaaatagttcagaaaaagcagaaatcaataaattagaaaatggaagaaacacatagaatcaatgaagaagagagctttggaaaaagcaaccctctgacctatttaatctagaaaaaaagagagaaggcacaaactaaaagatcagaaagagtatatgtaatgtgactacaaaaagatacttctcctggcagaaaggaaagcatgcagggccatctgcccactaggaagctgttgggaggctctctgcagccggccacttcggaggtccagggatgatcagtggaggagggatgtgcagggcatcctctgccagtgaatgctggctaggagggcagagagaggctcgctgagccctctatcccaggtttgtggcagggggctttggacagatgcagagcctgggggtgggccccagcccagcaatccggttccagctctccattcacaggcggggaggtggggggggatctttggactatcccatgtggctggctgcctgcctccagtggagttccctgttccggccttccccaagccgggtctttccagcctgtcccttcctggccaggatcctctggtgttttaggaattctcaagcctttggcatgagagatggacagagttatatcctcttttggaagtttccaaaaatgggaaactcctggtcctggggctagaaaggggagaaaagattatcccattgattggtctgggtgccaggtggcggcttgcattttcccccaggttgctcctacattgtttaaaaagaagaattttgtaattgactagggttaattgcttaccagtgctggcaaagctttggatcttatttggcctgaaaagtgtctgctctttcccagtcttgagtacttgatggaataaagcctcctttattaattactccttagcaggctctatgctaaattatcccgaccctaagccttttctttttctttttctttttttttccttaactgcctcaggtaggtagaaggagtatgtgatcacagtcagaacatttgcagaagagagtcaaaccctgaaggtgagaatttgaggatctctatgccagggacacggagatcctggggaaattgaggatttcctgggatgtgaatatttcaaagctgactccaaaaaatggagaatatgccataagtcccataaccatggagggaactcaagttcttcaccttttccaaagttttgccagtgcattcatactcatttgcaagcatttatcaggcaagactaatacaataccctgtaaactcatgtattctgaaatctacccaatgtgtctttcgtagtcaatgggacccttatacccaaagatgccaaaggtagcccgtcaggacaaagtacagacctgtctcacttctaaaaatagaagtaaaaatcccaaggcattaagagtttaattgaataatgtataaagagaaacttctaccgtgatcatctagggcttatcctaggaatgtggagattgtttaatatcaggaaatctattcatacagttcatcacatcagtttccaaatgacaaaactcatcctctaacaaatactgtttgaagggcttctgtgtgggaagtgctgtgctgggaatattcactggcatagtctctgtcctcaggggaccgcttccagaaggcagatctagacaaggaaacaattgtaccagggctcagggctggatggaggagacgcgggtcaggcagtctttccttacaaggtcaggaaaagcaacgggaggaagtgaccgttccacccacacctgaagatggtccagtgaagtcaccagcatagagatgctctgagttcataggctgggaggggagggagggcagctgaacccagagggacgagcacagggacaggaacagcagacccaatgccaaagacgtcggaaggagccgatcgcaaggagcagagcagacctgcgtctcccgccaaggggtttggcttgcccatgagggcagctttaagcagtgacacgatcccatgtgcatttctaagaagatcactggctcctgtgtgcagaaggggcaggtgggagcagtggcttaggagacagtcactgccatcaaatgggggatgctggcagctggactgggaccaggcctgggtccagggatacagacaggaggacagaggaggccacttcgagaggatgtggcactaggtgggtgaaggcggagagactctcagctgggtagatgatggtatcaacccctgagattggggagcacaggagggaagctgaagaggtcagctgagatgtgcagttagaggtacctggtgccatcccagcggaggaggccaagaagatgtggatgtgggtctggagccctgcggggtctggagctgggggtagcagaagcaactgcaggcatgaggagcttgctgcctagggggagcctgggagagaggcctcagggctccagtgttgaagcctctggcagggcaagggcgtgacggccccgtagcccctcacagggcactcctccttttccagatccccagaaaactagtaacagagggcaacaggacaaccaagattgtatttaaaggcggaaaaagaagcacatttccctaaaagtgttctgcacagcgaattcttaggatatgagtagatgttacagaggactatagaggggtcccaaggtcaaagaagtctggaaaatgctggtcaaacaaaggaaaatgggcattcctgggggtgaaatttcccggagactttcctgtggagctgtgcatggtgtacctccgagagtccgagcagtacaggtggtctctgaaaactttctccacggaagcttcttgctcagcagatccgcagcctgctgaacctgctctggggagcactgccctggagatagtcttggaaacaaacaaacaaaaaagacccataaactagttactgtggttctgaaaatcctagatacttgtatgtgacatgaaactagtattggaaaagagcagagacaaattctcattgtttgctgttaatcatgtgtcgggaaaacctaaaagaatccacggtacaacttgtagagttaggagaggagtctggtgatgtggccaaatatcagaccattgtttaaaaaatcagtagcttctgtgtgaaccaaaaacaacagccttggtagtggggaaaacagggagagaaaatttccattatggtagtaaccaaaaatgtagaatacctggaatagtcctgacaagacaatggacccattggaaggaaattgtacctgattaatgataggaagaaagtgatcacaaatgaagacacaaatgctgtcctcatgggaagctgggtataatcgagaggttggcctttcccagattcatagttggaaatgttatgaagtgattctaagcaccatctaggaacacgaacggtcaagaatggctgagacagctgcggaacccaagcaaggaagagacatcctccaaaggaacatgaacggtcaagcatggctgagacagctgcggaacccaagcaaggaagagacttcctccaaagcaacatggacggtcaagaatggctgagacagctgcggaacccaagcaaggaagagacttcctccaaaggaacatgaacagtcaagaatggctgagacagctgcggaacccaagcaaggaagagacttcctccaaaggaacatgaacggtcaagaatggctgagacagctgcggaacccaagcaaggaagagacttcctccaaaggaacatgaacggtcaagaatggctgagacagctgcggagcccaagcaaggaagagacttcctccaaaggaacatgaatggtcaagaatggctgagacagctgcggaacccaagcaaggaagagacttcctccaaaggaacatgaacggtcaagaatggccgagacagctgtgggacccaagcaagtaagagacttcctccaaacatcttgtaaagtgaagataattaaaatagtgccatatgtgcataaactttcatagacagttcagttgaataaaatagttgaaaatacccctcttacaaataacctaccgtgataaacacagaatgcttattgtgttataaataaatatataacataaatttaataaataggaaattaaattatcatatgacaaatataagccaatacaacattcaactatttaaatcacacaaatcaagaagaaaatattggttgtcaagagctttctaagcataaatccaattgaaggaattgtaaaggggaatatggatatatttggataagtataataccaaacttctgtcaaaaaacacaatgaaaaggcaaatgacaagcaggaaaaacatttgcaatgtgataaatatatcttaatatataaaacctcctctaaatcataaggaaacaaaattgtcaatggaaggaaacaaagaaaaaaatccaagtggctaagagaaagcccatatggaaaaatatctaactctactgttaaagaaataaataatacaccatttataaagcatcaaccctgttaagatgaagagggatttatggctgggtgaatgaagcaggcacactttgagtatgagtacagatattctaaggaaatgtagcaatatttatcactgcccttaaaaatgttctttttttctttctttttttttttttttttgagatggagtcttgctctgttgcccaggctggagtgcagtggcgcgacctcagctcactgcaacctctgccacctgggttcaagtgattctcctgcctcagcctcccaagtagctgggattacaggcacctgccaccacacccagctaattttttgtatttttagtagagatggggtttcaccaggttggccaggctggtcttgaactcctgacctcaggtgatccgcctcggcctcccaaagtgctggggttatggggcgcgagccaccgcatttggcctttaaaatgttcttgatgtttgcccccagacattcatttctgtgaccccagacattcatttctacaactctgttccaaagcagtgatcccagctgtgggccaagttttaggaacaagacaagggtcatggcattatctctcatgtgaacaacagcaaacaacctatattgtccaataatagtggtctagttaagtaatgataaacctatgtggtagagtattaggctgccacaaaattgcattttcgaaacatgtttaatggcattgggaaatggttacagtctaaagctgtttgttgtttgaaaagcaggatctcagttttccgtatgatctcaatttggtgtacaaatatatttaccaaaaagactggaaggaacacatcaaatgtgaacaggatttctctgtgggcagtaggctaattaattttcattttcttctttgtactttactgaattttttaaattcaatatgatgagcatggtttttattattattattattattattattattattattaagagatggggtctagctctgttgcccagactagagtggagtggtgtgatcataactcactgcagcctccatctcttgggctcaagggatcctctcatctcggcctcccaagtagcttggactacaggcacgcaccaccacactcgactaatttttttttctttttttttttgtagagacagggtctcactctgttgcccaggctggtcttgaactcccaggctcaaatgattctcctgcctctgcctcccatagcactgggattacaggtgtgagcagctgagcctggaccagcatgtttcttttataaacaaaacactgcattttaaatttgtgaaatttaaattttttaaatgattttttaaaaaatcatttaaaaatggtaggatccaaatgatgccgtttgactgaattcagcactctggagaaaggtctccggtggcatgccacagggctctgtcacgctcagtcctttatttctgatttcaatgaagacatcaaagagaattcatgctttcccttggcacgtcatctctgcagtgggctggggaggagtaatgaggtttctgtgttccaccctatgggcgctagctcacgcttcctgtggctggggcagggggtccacctgcagcgggtccacctgaaggaaatgggaaatcttggagtgaggacgcaggctgccataggtacgtggtctcccctgcatgagaagcccacgcccctgggttagcaggcaccaccctcctggccagggcctccttggcccctgcccctcatgcgccttgcctgcagaagttctgctttgctgggacccccacccctcatgcacctgcagaagctctgcttcactggggccatgctggggccccacttccacttttggcagagttgggaatggggcagtgggcaggggaccggttgtcaggtgcagcctgctcttcccagggacaacatggggacatgtgcaggccctgggggtgctgagatccatagccagcaaaccagggcagctcatgcctgtggtgggcaccgggcaacttctgcgacccaggtacaaagagaacagagaggacataggtgaactgaggctggccttgcttccgcctcctgctgggaaggggcttgagaactgatggtggtgagggattggaagacagaaccggaagctggacgcacgcttccagagctaactccagatggaaccagcttacccccggccccgagggctcagtggacccgcagctgaggaggcaggggagaggcagtgctgggttgtgaggggtgtgggacccaggacaccccagtgcctgttcccaggcccctcagcctagcttggaggacaacacacagccggtccctctgtcagaccccgggaattcagggatgattggcctcctggaatgttctggaacattccagcattctgggcctttttttctgctcctaactcatgcctgcccagagtggggctcagcaaagctcaccccatactctgcccacctttttctgcctggccctaccccgccttcctcctagaagcctcccagatcaagcacaggaggcagtgatgggggtaggggacgccagtgcccatggggtccgctccatcccggggatctcctgagttgatcagctgagtgtagactgccagaagagccgggcctgcccgctgctgtgcccttctctggggggttctgggctgtgagaggggaagtgagccgaggctatgagtcctcgttgctttaggttggacctactgcaaaagtgcaggaaatagtagagcagaggaggtggcactgctaggggctgggctgaaggcttggggtagagggcacagcggctaggaaaatgggttctggtcatgggccctggctgacttagcgaatgtgctgtgggccacagggcttgggagcagcgtctgtgggaccggaggagccatctgccatccccaggtggccaggggagaggccatcctgggagcagcagtacacagtgcacctcaatgccaaagacctggctgttttctttttcctatttcaaacccatcacagaccaatacttccgtaccatacgttataaatgaattactgggaaaagcaaatgtgacaaaaaccgaggtatccaaaaactctaggtctggatttttattattaaattctgtggacataaactcaacccgtccaattgctataaaagtttctagtttctgtacttatctcactgtggactggaacagtttgtgtccaccaggcacagacttcactttgcatagcactgggggaggccctgttttcaggtctctgaggtgtctgatgaacgtgggaggagatgtatccttgtgcccccaaagcatccggccagcccagagcctctggcttcccgagcagctgctgtttaatcccagggaggtgcatgaacgaggaggggagaggagccctgtgtccaggcagtagcagcagacaagacagcgacagagtggtgagcaccggcaaggaatacagcagggtggcaggcaataggggaccatggatggagcagccaggatggggacttcccagccaagatctgggggcaaaaggcctagctcctgtgtccaagggaacagaccccttttgctcacagagaagcacagccagggattctcgatggggctctggggacaaagtttggcacatggtggggatgaattctgatgagctgctcttcaaggaaccacaggcttcccgtcaaggaatgaggcccccgtctctagaagaattttagcatggcaaaaccaaggcgatggcagtcaggagggggctgagctgtcccccccacggtggggacagactctgggggatgtgagaccatgacccagacttgggcagaaagtggcccagatactcggttcctgttattcatcccaaattgtgacagaaatagaccagctccccacctgccgctcccccattgcctgtcccccaggcctcaccaggctccagtggggataaaattggtagcacttgtttgagtgacatgtttgtcttctagcttatgagaagcctctgagttatctcaagtttttcctaaaacaacatttttctccatttcttaaaaaaaagcagaagaaaagagatgatcttattttatacaatataccaccagccagggagcagagcatcggcaacacttgaggttgcatagcaactggcttttcaattgattttttgagaaggtaccaaagctactcaactgttctcattttaaatatttcctaggatgatgaaaatcaaagcaaatggaaatcagagacttggggagcatcagagaaggacataaagtgtcttgttataaaaaaccaggtcaagacaaagtgtggaatgcttgctggaatttttcagcattggaggtgaaaggtctgagaaattctgcatgtgagtctcttagtggaaagcacgagaagagaggtgctgggggtgggggcttggtgtgcccacccacccacctatagggtagaggatttagagtggcccagccatggtgcaggaaggccaggaagtgaaggtctggggaggatatatcaagggccctggggatctgggacaggggatgaggtgggaaacacaccccatgcctcaccccagggacagccccctgtcctcctgagcatctgggtcccaacccccaacctgataggggtgcaaggcatgatggcccacccacatcatcctccatccacctcctcacccagacctacctgggtccagagaactaggaggcactaaggctggacactgcccttgggaggtgccttagtctgtttgggctgcaataacagaaataccttagactgagtaatttataaccaatggaattgtgttactcactgttctgggggctgggaagtccaagagcaggacgccagcagaactgatgtgtcgtaaggacccattcctcctagagggcaccttctagctgtgccctcgcatgatggaagggtgaacaggctccctcaggcttcttttgtaagggtgctaatctcatttatggagactccaccctcatgacctaatgacctctcaaagaccacacttcctaataccataacattggttctcagctttcaacctttcaaatgtgggggacacaacattcagattctagcaggaggcccctcttctgcctccccacaggcctgcactggctcatgcctgggaaggctcaagttgagaatcctgttctggcagcttggctctctctgggaatagcttcccaggctttggggaagatggctggaaacaaaatgctggaacgatatgggagttctggcagagaaatgaggtgcacgcctcctgccccagctctcgtggttctctgtcgtgatgagatttgatctgtaagccctgcctggaacaagagacctccagccttgggggagcccactttgcactcagctggggggcacggtagaacatgtgctcacagagcagggatggtgggaccttgtccctgccattcattctggctttgtccatactcgtgggacctttggtgagcaatttaacatcatggggccttagtttcccccataagaggaggtctgtgaaaccccagcacacaacaggaatgacgacaatcataaaggcgttcgtgcaagtgactgtttgtagagcttcttctgggacaggcaccgtctgaagccctttatgtgactttatgccctcacccccatagcaaccctgtggagtagacgctgtgatcatccccatttgacagtgaggaccctggctccagggggcgagcggcctgcccggggccacacgctggtggagccactctgctctgggaggaggggctggactctgtgatcccggctggtcaggagcaccagcttcaggctccttgtcctggtcccctgagggtcagttgctcccaaccaagagtgactttgccacccctccccccacccgggggacatttggcagtgtctggagagacttttggttgtcacgactagggggagggttccactgggttctggcaaggagtgcccaggggtgtgctcaacatcctgccatgaacagggtgcccgcctcacccaacaggaattatctggccccaaatatctggagtgctgaggttgagaaatgtggtctgctcaccagaacccaacctccctgctgtcctatcctgcacctgtttaggaggctggtctgaggcaggagggcccctctgggatggggacggttgagaagctttgctgaagccgcatccccttgggggcatgagccagccccagcgggtaggccagtccccagggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggcccagaggctgtcttggggccgctggggccccgggagcccgggtgcggccgcggagtctgggcgccgggtgcgtccccggcccgggccgctgttctcgcggcagcagcgccacctggtggccgctcgggcccggcccttcctctgcccgccccgcgcggggggcagcaccccgacctctttccggctgtgggactcaggcgagtcctttcagttgtctgagacgcagttcgtcatccggaaggtaggaaaatgaagtggaagcgaggtgtcgtgtgccaagcctgagcctagcggggcgctccttgcggacggtgacttcctgctggggtcagcatctgccggggcggccctttgggctcacttccccaggcctcccgagaacgtccccgcagccggcgcctccctccctgcccagcctggctcctgagggtgctcgtgttcattccttcatcactgagcgcccagcagccggggtcctctggccgcgttcgctgcctcatcctggcatggagagcagaagccgggattgctccgtgaagggaggagtggggctactgagggcaggcgtgggccagggctggggcacagactcgggcccagcaaccacccggccctcaaggagcttaggctttagtgactcagaggccagcgacagcaacaggcacatccccagtaggtgccccatctggcaggtgaccgatcgcacgcaggaggagggacccggcgggcagctcagagccagggtcccgcggccaggatggggctgggacttggagctggacgcagcctactcgtccacccaaggcccacgggccccctaagctcctggctgttccctgaggcccgtggggttacccagacccctgcaggctgggcctgaggttcaggggcccgcagtgtttcctcacccttgccctggccaagcctcctgacagccctggggagcattcagcaaagtgaccttctgacccaaggtgagggccatcaagctcttgcctccctaaggccctcagatctgccctctccacctcatggtgggatccctgggtctttcaggcatgtcctcagaccctttccagcccgggccaggggagccaaacaggctgaacccggaggaaacaccatccttcttgggaccaggctcccggtgctgctgtgggagggccccaggggcctggacgagtgtctgcctcctgcatctgggcagctctgtgaaccagcatagcaaggagggtctccatgtggacataggtgggcactcatgatggccaaggaggaccctgcactctggaagagccagcctggtccagggccccagagcactcgggcagtggagcccagttgggagcccatgtctgcagtggtcgatgtcacctccaaacaggggtggcagagccctccatgaggggtgacgactgtcctggggcccctgtagaggatccgatcagcctcttggaagctcatctgttcccgtgctctgagctagggtcagcccactcaggactcctcctgcatcctgggctggatgggcccctggacttcatccacagccctactgcaggcttctcccgcctggctcttctggggccctaggctggacctgggagttctgggagctgctgccgctgtgaagagtctgccctcagaggccctgcctcactcaggaggtggaccctgcagctaccatgcagccccagggcctcgaaatgtccatccccggtcatacagcaccatctaccgccccctgctctggaggctgggtgcccgcggctgcccctgggagggactggctgccctgtaaagtccctggctggtcctgcagccaccccctttgcagagcccagggtgctacggctcactcctggtccccccctcagcacagctaggaacaggtggagtcacacagacagactttcctagaggagccgtgcagagccgagcaggcagctggaagtcaggtgcattcaggactgggagggacgtagatgaccagggcgagctggtgaaagactcctcagtggaaacaagcagtgcagcctccctcacttctggaggagatccatatatgagaaatgtgtcttcttctcgctcaggggaagcacagttcccaggcttgatacatagcaagggcacaggatggtgggggctggggtgccccaggcagcagggacccatctggcctcctgcatgcaggccaggtggcagaggagcaaaggaggtcgcatcccagcaggtggtcccgctggagcccaagtgacccacaggggagttcactgcatgtcaggacagtatccttggctggaggtctcagcggagagacctgagcttggctcttcccttgggttccgactgcctccagtagcgagggccttgccctgtccacggccagcccagacttccctcctgggccgcagacctgtccagctgccccgatgtctctgcctggacatcagtttctttctgtgaggagtccttagaggcatgcagaacccaaggctgcctgtagctctcatggagtgggaggagtgggtggaggaaagggggctctggggtgcatgagcctgagtttgcggatggttgttttgggtgctgccaccaggcaaacccacttcagccagttttcagtcctttcgaacctgtgctccatgggcctaacatgggtcccagctacggcttgggactgatcacccacaagggctgcacccccagaagtgggagagctcccaaagcaaaacagcccagctcttcccaacgagcaagctggccaggaaagacattgccgtgaccatgtttcctgcactgcggaccccacgctcttcctctggcacttgccgtccccttcccgcgccgcctcttctgccttgctaccaatccccaaagccagacactggtgccgtctctgcctcattgctcccgccctgcagccctgatgcctctcagctcctgccaccaggtcctgaccctcctgacgtggcaccagccacacctgcatgcatctcagtgccacactgtccccttctatccccactccttcctcactgacccaaagggctgttttaagaatgcacacagaccttgccctggcctctgggcacaaggtcaatgtctgggcctcatgggtaccccatagcccttgaatgctccagacccagcaaggacaagatctctgcccctgggctcctctgtgcccgtcagagataggctgggaccttggagatgttgggacgttggcagagagagagaggaagcacaagcagctctgtggcttgtcagttaagctcccagtggcaggttgagtcctggggtgcccggacactgaggtaaccctctcctctacttcttggggtaccccctgctgggacccaggctcccagggtctagcacactctcatgtctcctgaagtcctgcctcccagggctcccctggccccagtgcagcttcccctccctgtgcccatgcaccccagccctcccctctgccccctcctcagggagtctcctcagaaccccaaagccagaagggggtcatagacccctttagctctggaccctgcagcacaacctccttggggttggagaacgaaagtggcaggctgccttcttggactgggccgagaacaaagcgaggcaagaacaaaaacacaaatcaatatttcaataaattgtcttgccgcagcagcaagatcactttggctgctaagacgggctgggaacccaggctgaaccacagaagccagcatctgggaggagagaggtgatcggccagagtggatccagtctgcaggacgtggagaaggggctgcccactgcagggctcttattccagggttctggaataaagtggtgacggggaggatgcgttgttttgtctgcataactgatttcaatttgagccagtgtttactattaggtaggtgtctgtagaatccagatttcacgattgacctgagaaatctgatccagcagctctgggcctctgttcctgccagcactgggcggatgttgctcccttcagctgtgcctgggcacctgggtttgccacagtcctcgccactccttatcaccgacccccactctattctaatagggaaatattcctctgtaccctttctccttcaaaactgggaaaacacaagatggacttacttttcgtgcaaccagcctgcctcattgacttgtcacctgccttgctcctgtaggcgcttgggtttctagcatcctcccggtactccccacaagcccacacactaggatagcggacctccctgcacacccccagcctgcctcagcctggctcctcccgcagctctgtcctacacactagcctcattcctgcctctggtcctgatattggggcatgtctttctggctggactcttgactcctcctcaaagacttggccagggcccttctcccactgagaagcatataaactgcccccagaacatatcagctgcccccagatcagacgccatctttcatgggccagcgagtgtcctgactggggtccctgtggtcccccaaaggaggaagcacgtggctcagattctcttcgctgcaagtgacaagagcacaactcagaattggctttcacaaggagaggaacttcttcaggcataaatgacacccgtcagtggcaggcagccttcgtgatggccgccagtgacccagtctcttaatgtccatgccctgcggtaggcgggactgagattctatcaaaagcagactgtggcttctgtaggggaggtgccttctcttgttgtctcttgggtccctcgagcaggggcgaccgtgtggggtaaagctgacatgggtgacggccccaggaggggcccatacggtatggtgtgcaacagctcagctggggcccgccgtgaccacctgaatgagcctgggagctgacccgcctccggtacagccttcagatgagactgcagccccagtcttagctcgacagtggtctcatcctcctttaatccttggtggggggtctcctgtagtgcaggggggctccagccgctgcaggccccccacctcacaccttgcctactccttggcccgctttggttgtatgttcaccctgatccttcatggtggccaggaaggcgtggtgctgggattggccaggcctgcctgcccctgaagcctggggtctgactcagattaaaggaggggaagtttcacgaaagggaaacaagggcaggcagaagtcaccgcaacccaccagggcatcggaagggaccgtcccactacatggggcttaggaccctgagggcaggtgagttcatcttggacaggactcccttgacactgatgctgggagacgtgccctggaggaagcaaggcccctttccctggagcccagcaaggctaccgagctgtgctgggtgtcctggatggagacactcacactgcagcaggggccctgccaccaccctagcaaaagcgcttattagtgacctttgtgctgaccctctgatttggatttggactggcaatttttaaaaaatgtatgttaaaaagtcattcttgtttggtttttgattttgctcttactgttatttttaattggcatgtaataattgtacatatttctggggtagggtgtgatatttagacacgtgtatgcaatgtgtaatgattacatcagggtaattagcatatctgtcacctcaaacattatcatttctttgtgttgggaacattcaaagtccactcttctagctatttgaaaatgcacaatacattcttacggattccaggcgctttccggcactatagggcactaacgcttattcccccatcttgccgcacttttggatatgttaaccagccttggcaatccccagcccgctgccccccactctccaggaactactctctatttctgtgacatcaactgttttagcttccacgtatgagtgagagcgtgcagtatttgtctttctgagcctggcttatttcatttagcataaggtcccccaggctcatccatatctgggctgccaatcttaagttcagcgagtacaaccaaccacaaggcccacgctctagcaccgaatcacatccaccccgagtttcccttccttcttgtgccatcccaagctcaccccctagctggagacagtgagaagggacattctttcgcccgattcctccttcagaactgtgacctctcaaggctacccagaggcggatactacctggcagggactcgagatgagctgcaggggtcaggcttggatgtgatgcagatacccactcccttcctcctgtatcaattatagtaggtgaggttatgctacagaaacaaacacactttgcatcccagtggcttaaaacgaccaagatttcctgctcacgctgtatgttcaatgtgggttggcggaggattcgggtctcatcgtcactcaggtcctaggtgacagagcagccactgtctttatgttgccagatctcgtgccagaaaggagagctctctgaagggtctcaatgggaaattagatgctccaaccgaaaagagacatgccccacttttgctcacagctcattggccagagctagtcacatgctcttcctggtcatgatgggaacaggaagtgcacctccccttgccctcctccagcttcctctggtctgtccacttctatgccaatgtcccacaagtcttagtcacaggacatcacactctgatttatgacttatttcatcgggactcatggaaaccttgttagaatgagttatcttatctcccaggagcaggaaataaagtctttacaattaactctgtgcttgggacttgggaattggtctgccatcttgtcagtcattgactgggacccctgggaacgacttgtcttacctagccttgaattgtgctcccttcttctggaactaactggcttgctaacaataccctttgttgtttgttttgttttgttttgagacggagtctcactctgtcgcctaggctggagtgcagtggcgtgatctcagctcactgcaacctccacctcccgggttcaagcgattctccttcctcagcctcccaggttgctgggattacgccaccaagccagactaagttttgcatttttaatagagacagggtttcaccatgttggccaggctggtctcaaactcctgacctcaggtgatccacctgcctcagcctcccaaagtgctgggattacaggtgtgagccaccgcgcacggccaactttttgttatttatagacacaaagagaaatacgtggctctactttgtggatacatttatgcaagagaaaaaacacctgcatacgtagcttccaaggaatgcacatctctattttatggccagataaatccttaaaggggaaaagaacatgcccaggactcagaggggctctcggttctcttggagggaactacttcggtgtttggagtctatggtgagaacagaaaccaaaatgcctgctgtgaggattgtggaggaaaaaaggaagggtgccgctcacagaagccttgcttttgaaatgatattgtgtatgtcttatttaaggaggaagtttagggcagtgagttgaatctagattttggtttcagccttcttgggatccgatctcaattctcctacttcctagtttcatgacctgggcaagcttcttaacttctctgagtctcagtttcctgtccaagacaggcttcttagtcctgaagtctaaatgggagtgcctgctgatgtcatggtgcagagagagtgtgcaagacgagcggtcccgaggccaccctagctgtcaggtgtgcgtcatgatacaaaatggaatgggatggttcccgggggcttcccatgcatagttcctgtgggaatcatctgtgtatgcccttgttcttgatatggctgtttttctattaggttgatgccaaagtctttgccattacttttcatggcaatactgcgattacttttgcacccaccaaatatgtcagttgctgtttcttttcctccattgtgttggtttctgcaagtaccttcacacggggggaacgtataaggtgatctgcttcctctggccttgcacaccacactggaatttccgcctcccctgccacggaccctcccaaaactgtgagctctttggggtgaggtccacatgacatttgccttctgtggaggccttgcacggaacaggtgcctcatagaacaaacacagggacttctggaaatggggtagacggtgggactatgcgaggccttagatgacgtagagcttggcttctgcatctcacctgaaaactgcggtgactttgtgtggaaactcacgcaggtgagtgtgactggggaaacttttcttccctgtcaaagactggagcccagtgggagcaggtcctgagagtgaccgggcagggcctttgtaccacctggaacagattcccagtggatggggtctgtcaacactacagcctgctcggccccccactgggccaccaggcgccaacctctctcttccatttctctccatccccctgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggtgagcctcacccatgcagggccacagaggcgtgaagctggaaatgagcccctggccatgcaaggggccccgggagccttggcccagcccagggaagagtgtcagggcagggaaggccgtggccaccttagctgggtgagggtgtggggcagtgcactgatggacaaatacatcattagaagagaatccagtgtcctgaattggacctatgtgtatagggacgctaatgtgtcacaaaagtgacatttcagagaagaggaggaaaacagcctaacaaatggtgtggggccaatttggaaagaaaggaggcctgtcacctccactcactctatagacagagagcatctcacatggattttaggtctaaataagaaacgcaaaataatgaaagaagataacgtaggtggatggctccatgttcttggagtaagagatgttttctttaaaaagagacaaaaggccgggcgcggtggttcacacctgtaatcccagcactttgggagtcggaggcaggtagatcacgaggtcaggagatcgagaccatcttggctaacatggtgaaaccccgtctctaataaaaatacaaaaaaattagcagggcatggtggcgggcgcctgtagtcccagctacccgggaggctgaggcaggagaatggtgtgaacccgggaggcggagtttgcaatgagtcgagatcgcaccactttgctccagcctgggagacagtgcgagactctgtctcaaaaaaaaaagagacaaaaaaaaccaaacaaaccatgaactcaatggaaaaaactgataaatagtagcacatttcaaaagtttgtgcattaaaggcacgctaatccactgggggaaatatttataaaaaaggatttatatctgaagtatgtgaagaacgcctacaaatcataataaggataataaagacaatccagtcagataatgggcaggagactcttatcaggctcttgacaaaatatgaatgagcaataaacatatgaaaaggcactcaacctcactagacattggaaaaatgcaattaaaacaatgaggctgggcatggtggtggatgcctgtagtcccagccactcgggaacctgaggtgggaggattgtttgagcccaggaagtgagctatgatcacaccactgcactccagcctgggtgacagagcgaggccttgtcttacaaaaaaaaaaaaaaaggaaaatttaaaaacacaatgaaatatcaagacgcacctaatagcatagctaggttaaaaagactgaaactaccatgtctgggtgaggagtggatagctcccctcaaacacagcgcagccaggtgttgccctgaccatgtgatgagagtgctgttggctgttttgtcttggggagggcactaatggggagcagagctatcccctaggaggggaaaccgacacagcttttatattaagtgacctgatccctcatttaaaaatgtgaaattggctgggtgtggtggctcactcctgtaatcccagcactttgggaggccaaggcgggcggatcacttgaggtcaggagttcgtgaccagcctggccaacatctctactaaaaacacaaaaattagccagtgtagtggcaggtgcctgtaatcccagctactcaggaggctgaggcaggaaaatcactagaaccccggaggcagaggttgcagtgagccgagattgtgccactgcactccagcctgggcaacagagcaagactctgtctcaaaaaaaaaaaaaaaaaaaagaaaaaatgaaaggacagccaagggttaccagatattttaaaaaaaccaaaacacaagaaatccttacagcatgaaaaagatggaccaagatgtaaaacaaaacaaaaagtttgaaaactggctctaagagaaaatagagataatttagagacaagaaaagcatgtttttaaaagtagtattcccagaatgtttgagaaaatacatccataaaccctaagagttttctatgaaaaattagagaacaacaaaccatttgtataaaattatggataggatgggggaagtaaaaaattcgaaaggtagacggggcgcggtggctcacgcctgtaatcccagcactgtgggaggccgaggcgggcaggtcacgaggtcaggagatggagaccatcctggctaacatggtgaaatcccgtctctagtaaaaatacaaaaattagctgagcatggtggcgggtgcctgtagtcccagctactcaggaggctgaggcagtagaatggactgaacccaggaggcggaggttgcagtgagccgagatcacaccactgcactccagcctggacggcagagtgagactccatctcaaaaaaaaaaaaaaaaaatcgaaagctgaaataaaaagtcaaggccatctcccaatgggagcaaaagacaaaaagattaacatgagagaaaagttaggagacagaccctccatcgaggaggcacactctatctaataagattccggagagagaaaacagccacaaagtaaaataagagggaagaaaacaaagaaaaacataaagatgcgctttcagatctcgcaggctcctgtaatgctgagtaggatgaatggaaagcctcccacggaggcagatgcatctgcaagcctggcatacaaagggcaaagaggagatggcaacgttccactcaggcacacagactccacgctcgtctcaaaatctgcagagcaaaaaatgcagattttcctgtttattacaacgggaaaagacaagggttagatcacgatgcttctatttttaggcgcgtacaccgccagctcacccggggtcccagtggccctccttcccttctctgtggaacgcgtggcctcagggtctctcagtggggcatggcaggagtgagggcaggttggggttctgaaagtcagggctccatgcttggcaggcctctaggaagactcccaggggtacaagcagagacctcgtgtggcacccatagccctgtaggcacttccctatctttccaagccgcctccctctgctgagacaggagctggggaagtgaataggtctcattatccatcttcctcagtttgacgtggggtctctgcgtcatgaacttctgccaccctccccctggccctgggctgtcgtaggccactggcctcatcttctacggcggctctgacctcccagtccgcaccagccagccccctgctgggatattctgcagggtagtgtggcccatcggctgaacagctttgcagccttctgcggcattatggaaacaggtctagctagggtctcaaggaccccagagaaacacggggagacccaagaaacgccccccagaggaggtgggcttggagggtgtgataccaggcagacgaggggcaggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggctgtggatggtcagccgcgctgaaggctgctcgcggcaccgtgtgtcccccacagctcctatgactgcctgctggatgaccccttcgcccacgactggccggcgctgccccagctcccgggactgcactactccatgaacgagcaatgccgctttgacttcggcctgggctacatgatgtgcacggcggtgagtgtgcagccctgcagccgggaccctcccaggtctggggggaggcgtgctggtgtaggggcagctcccgggacagtgtgaggaccggcccagtgtggggagggcagagcggccctccagagtggcagcctgtccctctgcacccaccactccccaccccctaggcaccctgagcccacctggcaggcccagacgtggtcctaggcaggaagcacacgggggacaggactgtgaccagggtgtcagccaggggcagtgagagcctgcagaggtcaggagggctcccaaggaagaagggaggcctgcaggctaagcggaaggagagggcattcaggaagggagggccacggacgcagaggccacggacgcagaggcctggaggagagcgcggcaggcacaggagcactcgctgctctccagggccaagtgccagggctgagccgtcagaggaaccggccatcggcatggaggccacactgtgggagcttcagtgtctatgagcgtcttaatgctcgcctctgctgcatgaaggaaagaagcaaagtagtcccattttacagatgaggaaacagagacccggagaggctaggtaacctgcctgagcccacaaagcgagcaagtggtagagtcgagtaccaacgcaggagggccacctccttccaagactccctaaggagcacagtggactcgattctcatggcgatgggggctctggaaaggcttgagtaggggaggctcagggccacgtctgagtttcagctgatccctcagggacgtcctgcaggaagtgctatcaggacaggaagcagaaaggccagggaacaggactgtgaagtccaggggaggccgaggctgcagagagggcaggcctgtgggggtgggggtagggcttcgccagggtttaggagggaaatccacggcaaagggtcagcaggtgcccacctagcctcaggctggcacttagggcccagctgcccgccaggctccctgaggtgtgcagcctccaaagactggaggcagagaggcccagccgcgtccagggatgctgcagcctccacaccgtatgggcaaggtcttcaccaccccagaatcacaacacccaccagcctcacgggcccatcatgggccagtcccactggggcatctcaggttccagaacccgggggtgggtggcatccctgggaggtccctgaggtgggagggacctggcaagctatggtgctgtcttccagttccggacctttgacccctgcaagcagctgtggtgcagccatcctgacaacccctacttttgcaagaccaagaaggggccccccttggacgggactatgtgtgcacctggcaaggtgaggcagcatcaagggctcttggagggcagcagggcagaggacaggaatcttaggtgcccgggtcaccagggacaggccctgaagtgggggtgggggccctctcaggggacctctgctgccctctcctttcccccttctaattacccctcacacgctgtacgccggagctgcctccaccctgtgcttctgatgctggagcacacctggcatctgagagttcctcatggtgcttcatgccccccactcaggaatccccctttaaggagcaatttctggggtcctggcagccttcggtcacccctgggcactgtgggtcacctcacctggaggccagcattggagtcctcgggcccagcatgaggcttaacctttccatccccaggacctcagtgtttgtcccttgttgggcacactgtccttcgaggtcccttgatggctgccccaggcccacttcccaccctctggtgactcttgaaagaaggacttcttccctgttgtcctcccagaactccagacctgattctcatttgttcagatgaaatcacacacccactcctcagccagttacttgctagggggctggcatatgcagatgagctaagcctggatccccacccaggaaggctcagccccactgagaccaccttggccctgcagtgggggcagggagtagggagtggacaccggtgcacatcccagccaggcctaggacgcccccaaactgtatggacctgtggctccttgatggaagtctttggctcgggactgggccagctgcctaattttagtctctggcggagcttctgaaagaaacaaattcccaggcccatccttgaagacttttgtttggggtaggatccaataattgtttttggtgttcttttttaaactatggtaaaaattctcacaaaattcactatctgaaccactttacacagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttcccgcaaggaccctgagtggtcatgcccagcttccatttccaggttaggcaccgtcttgcccagttgggacaggaggaccactgcgtggctccttccatcctcctggctcctggttcctgcggccaccagtgacttagagtctgccccggccgcagccttccacggtgccaggacagctcacactccatcttcctcagcttcggctgctctaacagaaataccgcagactgggtggcttacacaacagagccttgttcttcgcagtcctggaggctgggaagcccaaggtcagggtgccagcaaggttggcttctgggaggaccctcttcctggcttgccatcttcctgtggtctcctcacatggcagggagagagggcatctctctcaggtctcttctcatgaggacatcagtcccactcatgagggccatcacctaacgcttcccgaaggcccccacactgggggttagggcttcaccatatgaatttgaggggacacacgc

SEQ ID NO: 12882 - DNA, 2458 bp, Human
gcattaccaaccagagtccagcaattgacgctcaggttctatgacaaaatgattgttaatgttgttagatgcattgacagttctgtggttagtacaacggcatcattttttaaaaaatgcgtcaaatatgttgaaagcttaaatgtcagaattgacccacttcgaacattccaacgaacagtaggaaagggcagaatgttagcaatggctgagtctgggtggtgggtataaagagggcttgtttttttagtctggttttccgcatattagacgtttttcataatctctttggaaaagctttccagcgcctggggctgagtatctctgggacgggccctgggggatgggtctcgtggggcctggtatcagttcccagctggcggtcgagttctctaggggaacaggggctgcatgtagcagtatttttattattttcaaccgcagtcgcttcttcctgttgccttctgggtactgggaggcacccgggaagagctgggattctggggtcccccagtatggtttacctgctctggggcaacagggacaatttgggtttctaagcaacattctggccgggtgccgtggctcatgcctgtaatcccagcactttgggaggccgaggtgggcagatcacctgaggtcaggagttcgagaccagcctggccaacatgatgaaaccccatctctactaaaaatacaaaaattaggtgggtgcggtggtggaccctggtcatcccagctacttgggaggctgaggcaggagaattgcttgaacctgggaggtggaggttgcagtgagccgagatcgcgccattgcactccagcctgggcgacagagtaagactccatctcaaaaaaaaaaaaaaaaaattctttgtttctgctgtttatttgctgacagtgcatgcgtttcttttccttactgtgtgtgggggagtctgtgccatgttcttaagtcctctcccttgctgtttttatttaaccccttctgggtcccaactctacctggcggtgctggtggactgacccttctcactactagcccgtgtgtgagcctttatggggcatctcctctccctctggaggacatggtctctctcgctgcctcctgtgtcccctgcctttacgtgatgcccagcacataggcactcaagtgtgccgaacagtgactcttacaggtctggtctactcccacggagcctagctcagggaggttaattaacccatccaaagcagccgagctgtggtctgaacttcggagccggtgctgtccaacatccaaatacagacaatggaggtagaacacaagccctgtgtgcgattctaaggttttcattgttcatgttttaaaacgagaaatggtaacattaatattaatatgctttaaacctaatatagccaaaatactatttctacatggaatttctatttcacaattattttggggcaacatggaagagatcatcgtggtgatggaacacttctgtatcttcagcatagatggaatagttgtgttttgtagtgatggtcacacgactctactaccctcgtggggaaatgacagaattggacacacacactgattgcatcaatgtctctttcccagtttggattaggtgagttagaaccacagggaaacttggtgcagggtatattggacctctgtgcactgtctttgcaactttctgttgaatctataattatttctaaatagtagtttatttttttgagatggagtctcactctgttgcccaggctagagtgcagtggtgcagtctcggctcactgcaacctcaacctcttgggctcaagcgattctcctgcctcagcctccagagtagctgggaccacagatgcccaccaccactcttggctaatttttgtatttttagtagagacaggatttcgccatgttggccaggctggtctcgaactcctgaccttgggtgatctgcctgcgttggcctcccaaagtgctgggattataggcttgagccactgctcctggccataaaatagtagtttaaaatgtgagattttaaaatttaaaaaaatcaaccaagtctttgaacactgctgcgtctttcacgcttatagcacatctaggtttggacccgagacattcaagcagcgggtgtggcccgaggccacagtgtcagacagccatgtcccttgctccctgccccagcacagccttcttgagctgggattgcaggaggcctgcactgtctctgccatggaccggttgcctggtagagaagctactgtcctgcttggagcctcagtttgtgtatctgttaagtgggaagaatgacagtgcctatcccagagtgctggctgccagggttaagtgggatgctgcgtgttcggcacttagcatgggcctggcccatgggcgggtgattgtgagcctggaccacatctactggtattaatcatgtttacaatcccaaacggc

SEQ ID NO: 12883 - DNA, 51629 bp, Human
  misc_feature (1)...(51629): n = A,T,C or G
gcagccatacctaaaaccgttgtgaagaaagctacacaaagggtgatctgaaataacctttgcgtggcttcttaagcctgcagacatgaggtagtcactgaaatagtgacacatgtctgcacttacgagattccaatgacctttcatttgcctggggactgtccagagaaatctcttgatacttaacccagctctctccctactgcccaatcctccgtccagacttttgtatggacaccccagtcccttctctctctatacctccctccccaagccaccttctaaggcaaggtgatactcacctaatcagtctccttagggaggaactttgacattctttttcttctcagagtttctgtgctattgaaaccctgtagttagagttctgaggctcaataagctttacatgtattcatcagacctaaataaaaacaaagattgtcttctagttatataggtcaaaattacagatacacacacacagctttatacatacatacgtgtaattttaaactgatgaattttaatgatcgtttggcaaaacatgccattatgcaaaggggcttttactcgtataactttatatgtttatttagacattttaattaatacgtctatatggagtacaggtgtattatcagtgtaattaaactctgatatgatattagaaagctacagtacactgcagacaatttacaagggtcatctctggcctggtgttctcaaaggcctccggatttgccgttcatcaggtaagatgaacagctttgcgttgctaccttcaaaaattctttttttttttttttgagagagagtctcgctctgtctccaggctggagtgcaacctccacctcccgggttcaagcgattctcctgcctcagcctcccgagtagctaggaccacaggcgcgcccagctaatttctgtatttttagtagagacagggtttcatcatgttggccgggatggtctcaatctcctgacctcgttatccgcccgcctcggcctcccaaagtgctgggattacaggggtgaaccaccgcgcctggcctcagaaaccatctccatctcccttaccacctgaggggtcactggtgaccacacccatggaatcggctggatctcctgcggggctggacaatttgaccctcctcctccccaggccccgccccttcccccctgagtctttcggcctgggtggaggacgcggctgcttcaagtccttggctctgatccaggccacagattccaggttagtgagcaagtttattttctggccagctaccgctgtccccacttgtctggagagtttgacccgctctgcaggtcgggttgggggtggttcacgggtgaaagaagaatgagggagacttctgcattttcaagtgaactcaagtttgggaagggagcacagaagaggcacctttgcagctgggaataggccgtgtaaagagagttaaacctctattccagcagctgtggaaactgctttagggaatcactgcaaaccattttgtcaggcgtggattcagagtcagcatcccttccccccttcccccgttctccccttccccnnnnnnnnnnnnnnnnnnnntaatcaggccaagagcataatataatactagttataactgcacagcttgcctccgttgtgtaaaaaaatcactgagacttaactgtgtccaacttttaaaatgtgaatagaagtacaactaaagctatattttggttaatatttgcattgcatgcttttccattatttagtttcaacatatgtgaaatataaatataaattataaaaactttaagagagcccatccccccttcccccttcccctcccccatctccagcctggccgctccaggaagtgagcaccgtttatcccccaccccaggcggcccgactcctcccagaaggagttgggagatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggtatgtctaccgttctgttgactggctcttattgtcacttctggcagaggtgacagggcagtgaaagagataaggtcctttccctttcggaactcattatatctttatttctttttctttctcactgcaaatgaccccactgaggttagagacattttaatcagtcagtcaatagagacagaaatgtgtggttaggagcatagatgccgcagccagactgcatgtgttcaaatcctgactctgacagacactggctgtgtgcccgaagactgctaacttaacttctttgagctttagtttcttccatctataagatggacggagtaatatgtatatcttagagttttggtgaggattaagtgagacagatttaaacacgtaggaggctgcctgacacaaattatggtcattattactggcaaactccatgcctagctttaaaaaaatgcacaatcaaaacaatttttaaattataggtttctgaaatgcagggggtagaaattcttttgaagtggaaattaaattttttgttttgaaactgattatgttccaattcaaatatttattgagtcctgttagataatcaattgcagataataggttaaatataaccctacacaaagataaaaaaaaatgttattcctaaagtgcaagaactcatgcccaactcacttataaatgcaactgccacctattttattccactttcactagggctcccagctggtggacgggcctgctctgtcattgctaactctgaacccccagcctacaccagccccagtatcccctgctgagtcactgatttttattctgaaagccattttgatatcgatgcaagcttccattctaaaagatgcttcatatctaaatagcaggccattctctgtccccctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattccaggaaagactgagattctgcataaagaactccaagtgcttgcagtgttgctagttagcagacctttttcaggcgtctggttctgatttaattggtcccacctggttgtgaatttgggctctttcttctgctaatttgatgcactgggctctgggactgcaggctcttctcgtctgcactcctcacagtcagaatgccttctctcagcccgtccacactgctctggagacttggcctcagttggaaactggcagcctcccatatctcccttgggctgcacttagctgcagtgggcagtcagggcttgctggtgtgtgggcaagggtcacctatgctaactgtatgctcccctccttcacaatttctttcccaagcctcagctttgacaagagacctcaactcttacaaatcttttttctgctcaagaatttttctctgtctaaagagagtattagatgaatatctacagcgcatattagataggaaaaagacatataatgaactagaaatagaatgaagccacatatgtaatgttacatactcaagtagcctcattaaaaataagcgggtgaaattaattttaatacatttcatttaacccaatacatgcaaaatacaattaggacatgtgatcaacataaaaaaattaataagatcctttaacttttttaaactaaatcttcaaaatccaatgtgtattttgtacctaaagcaacccatttctgagtagccacacttcaaatgctcaagagccatatctggctacatgtttgacaacacagttccattatgcttagaagatcagaaaccaagcttttaatttttcttgtatttttttgtttctgtcagtttattgagttctatctagtaagttacaaattgtaagcatacagttctgtgaattttcacagttgcagtcagctgtgtaaccaccaccatgatcatgatacataaagggcatttccctttatgtattcacccttcaaatttccttatgccctttgcagttcaaacttttctcccactcctgggccctggcttccactgatgtactttcaaataccatagctttctcttttctaggatttcacataaatagcatcatacaataacttaaatttgatgtttgggttctttcactttgcatgcttttgagatttatcttgttgtatatattaacagtttaattgtttggtaatatgccactgtatggatacaccacagtttgttcatttaccagttagtgatgtcatggattcttttcagtttgggactattactacattgcatttatgaggcagtagttctccttcaagagaattgggtacgctaaatacagttttgcctgaaatgaaagtgtgcatgtgtttgttggggaggatgaattggaattggactttcaattaaaatataataccaacacaattattatatttatttatttatttatttatttatttatttatttattttgagacggagtctcgctctgtcgcccaggctggagtgcagtggcacgatctcgactcactgcaagctccaccttccgggttcacaccattctcctgcctcagcctcccgagtagctgggactacaggcatccgccactacacccagctaaatttttgtatttttagtagagacagggtttcaccgtgttagccaggatggtctcgatctcctgaccttgtgatccgcctgcctcagcctcccaaagtgctgggattacaggcttgggccaccgcgcccggccaacacaattattttttaacagtaacactttgataagatagcacatttatttctatactctagtgccaacatcaaggccaactataagctcagcagtaagctataattttcaatccattataaagttaattgatcatttcctgtgttagctgcagtgctaaggtctggggcacctggaagataaatagagcctctattgcctctagagcctctattgcctctattatcaaaggcaatagagccttatagtgcagtgtgctaagtgagatgatgtgggtatggtaggagatattaacaaaggaaataatagtgcagttcccacaggtgtgattaatttggttaaacagactctcagatgataggtaaatacgtctgtaacaccaattagtactaccagttagatgcacagagttcattaatttgttaattatattttgcaccctttatggagatgaggaatataagggagtaataagagctccagctctgcagcctgcgtatctgcattcaacaccggccccgccacttgaaggatctactaaataccagtttatacaactatgagatgagatttaagggacattcataatgttgttatgtggaattattgagttattatgtacaaaataattaaattcttgctgaatacctaatgggctttctgtagatatttgctgtgagcatcgctgctgctaagcatggcaaagctgaagagccaggctagtacttgcagaagcaccacagaacactagatggcagcgccaagaacctgttttcggctcgctagatcccccagcagggccgctaggaggcttatgcttacgtcccatgactttttcttacccttatctgagacactttctcaggccctttcttctaaggggagtgttgttattgggaggcagtttgatatactttttaaatccaccaggtcctcaagatgggggtaaattggtacaatttacagggccttgtgttgaggcccacacggactatgttttttacatcagtgtacatttacttttgctgggaaaccagccaaagacaagttagagaattctgcctgctccctacgcactgtggcctgttcagaacagcgaggtcacgcctggaaccagggccagagcttcacataggcagtgttagctggctcttctttggtggcccaaacacaactccaggtagacaagcagaacaaatggctcccagtgaaaataactcagtgctggaaacagttttaaaaattttctaaagcgtattctcagtgtgattttaaacaatggtaacgtaatttatcaacaactcttccaagaaaaatagacaataaaggtcatatttctcaatgaagatataaggtctcaactgccttaccggccacctctccttacatatggacccccttaggatcctgctgaagtttaagacaggccctggcaaaatcccatcatcaaataggatctctctcatttccatacttcgaaagcacttggtccatgcctgactttcacagcctttaccactgactgtctttggtcaaagttatgagtttgaggacgaagctttgaactagcaccctggaaaggttaggttatgccaattctacaacttacaaggtgcatgattgtgtaaagtcacttaatgtctcttcttattaaagaatggagaatactcttatttatgcagagttgtccatgagggataaagaaagcaagagaatgtgatttctaaatcacagctggttacagaatcatgagttgtaaaaatattacctccccaggctgggcgcagtggctcacgcttgtaatcccagcactttgggaggccaaggcaggcagatcacttgaggtcaggagttcgagaccagcctggccaacatggtaaaaccctgtctctactaaaaatacaaaaattagctgggcatggtggcgctcacctgtaatcccagctactcaggaggctgaggcacgagaatcgcttgaacccgggaggcagaggttgcagtgagccgagatagtgccactgccctccagcctgggcgatagagcaagactcagtttcaacaacaacaaaaaaattaccaccccttattgtggccattgctgtttctttggtttttttctgagaaggcgagcatgtggtgagagggctctatgtggagcagggccgttaagaagtggaagtgttttcacagtcttagagatcagataccagagagtgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccgaggtgggcggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagacccttctgataagggaataggtaggaagctagtaagtcatgcagatagcagagtaaagggtcatctttacatcacgaacgacaaatgcaaaaatcctgaggcagcagtgtgttttaggtgcttttaacattgaggatatgttttgggtgagaaaaggtcacacagtctccaggtgcggtggctcatgcctgtaattccagcactgtgagaggccaaggcaggagcatcacttaaggtcaggagttcaagaccaccctggctaacatggtgaaactccatctctactaaaaatacaaaaactagccaggtgttgtggcacgtgcctgtaatcccagctactcaggaggctgaggcaggagaattgcttgaacctgggaggcggagattgcagtgagctgagattgtaccactgcattccagcctgggtgacagagtgagtctccatctcaaaaaagaaaaaaaagaaaagatcacacagacagtgactcacacaggcccctcctttccagggcctcagtttgtctctattcaataggagcaagaggaaattatcactgctttaatatggggagaaattggtgccttgtatgagccgggataaagaacgtattggatatgagaatgagaagcccttgttaccccaggtgtctgacctctttatccaggactgggcagtcagtattcccttattctccctcctttcttaccctgatcctttttttgtttgttcatctacctaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggtgagaccccaggatggaatgggagacagagaaacagggtctttggcaggttttaacgttttatcatgctctgatctaatctctttgtagtctttatttacctagagaatgaacctggaaactgcctccctgattaagaatagattctttatcatttacttgctattccagattgagtagatagagctgcttggggtaaaaggggtacttggttgattgagtgtggagatatgttggcagggtaggtaaaggaatttatttactcatgtatttattttgagaaggcgtctcgctctgtcgcccaggttggagtgcagtggtgcgatcccggctcactgcaacctccgcctcccgggttcaagcagttctcgtgcctggcctcccaagtagctaggactgtaggtgtgcaccaccatgcccagctaattgtgtgtgtgtgtgcgtgtgtgtgtgtgtttagtagagatggggttttgccatgttgcccaggctgatctcaaactcctgagctcaggcaatccacccgcctcagcctcccaaagtgctgggattacaggcgtgagccacaggtgctttgtggtcaggcaccttcccaagggggatggagaatcagcctatccctgttggttttcatcccatgtatatatataaaagatttgttggccctctcaagttttcatcctaggttaggacaggcttcttttgaggttagcagaatctctgtcccattcattctatgtctgggtactgagtcaactgaaggcttgatcctgcttgacctgatttgttttcttcaaggagaagtttcaggagtctctaaagaagctgaagaacgaggagcaggaagctgagaagctaacagcttttatcagagagaagaaaacatcctggaaggcaagggagactttttctgaagatgtcctggggcaggaatcatggcaggtcataggagctgagggcaaaggagtccttgtcctgtctgtcctctgatgccatgactagaagagcttccctttgcctggtcctccactatattccttccaaacagggggaggagaggaggtaaatagcaaatatatcaaaactgaacctaggagacaatcacatagcagaggaaccatggctaggggtcgccccaattcataattctgggtcttgctctacagtttcagtctctttggcttttcccttgcattcagagtacaaatgcaagggaaaatgcaggtaaggcttgtgaagaagcccagatctgagacaggttagtcacaggccagtaatttccacctcagtactcgaaattggaagaggaggctgatgcagaggtgagggaggcttcctggaatctaaacgtcacccaggaatcacagttgatgtctagatggcctagataaagcagcccggggccaatggtctgggcagagctgaagggagaaaagaaggaaagaacaggctacaaaggctttctcctgcagcatttaccctccctctccctgggaggcttggcccaggaaagcagtcctgagcccaacttccccgcttttaatagaggagaccctcagtgtgaccgactagcagcctctttttcttccctgttcctgaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggtaaggcttgtgaaggagcccagatctgagagtcaaggaaaagagaaactaactttccttcctttctgggacatcagactaccatcgttgcagggacaagagaaaacattcctttggcgctatagtgcctatcccctattaaactgtttagaggtatggagtaaagcgtaagataattcagagtacaaatgcaagggaaagtcccatttttatttataaagggttgtctaaaagtttatttgatgctgtggagaagttctgttgtatccagtgatgttgttctttctttctcagtcttggcactatttacatttctggctggataattctttgctgcgtggggttctcctgtacattgtaggatgcttagcagcgtctctggcctctgctcactagatgtcagcagcaccaccccagatgtgacaaccccaaatttcttcagacattgccacgatagccccagggtgaacacagtgctctcccagttgagaaccactgttcattaggcacctctcgtctctgatgctgtgttgggaatttgccaagtgcttcttacccagcttagtcacaggcacacttacgccaagctaaattcttagagatgatgtattaccagcccttctttgttttcactctcttctctagagcagaatcatttaacatactgtagcaattgatatttgaactggttttgggggtctgggctctggtctgtatgtgtgtaggtcgcagattacaaggtatcaagcctagagagatttgatggagggacttgaactgaggttgaaattctagcagctattttctgcatagaatgaatagtgtggttgtgaatttgaggcatgatgtagcttgtgatattctgtaaccttcagagtgtaagatattctttatattttgtttgtcttcgtgctttcctcttgctccttctttcttggtggaataattgtttatttacatattcttgggtcttagtattagagccatgggtagctactttctgcctgttacagctttttctcattcactgcttcctgctttgcatcttcattttattcttcttgcctttttgtcctcatcattgatattattaccctgatactttctccttcaccttttgttctggctcctcaacagtcctcaaactgtaaatattttttaaatgcaaatgaatcgtcaattcatattgctagtttagacacttccacattcattagtatgactgccccacggacatttaaacttgagtagtcttttctaaaaataaactttctggaattttcccatcacagacattgttctttctcttttccatatctgtgtgaattgttgcccattaagattttatagccaaggccgagcgcggtggctcacgcctgtaatcccagcactttgggaggccgaggcaggcggatcatgaggtcaggagattgagaccatcctggctaacacggtgaaaccccgtctctactaaaaacacaaaaaaattagccgggtgcggtggtgggcgcctgtagtcccagctactcgggaggctgaggcaggagaatggcgcgaacccaggaggcggagcgtgcagtgagccgagatcgcaccactgcactccagcctgggcgacagagcaagactccatctcaaaaaaaaaaaatattttatagccaagataaaagcttcaaaatatggacataaagccaacataagagaagtagccacatgaaatagcacatcgatttgatcatttcagttcctcagtacagccacaatgtaagattgatacaatcctggatatttactgcaaattgacacacacagcacctctaccacattctatgttcaagccagtttgagttgtgcctctatgaaatgccaccataaacagccctaatacagagaaaatagttaatcctgtattatgtggaccaaacttaagcttttcttcggggtcattgagatgtatggagcacaagataaaaagaccaaatagaaaggaataggccaattccacagaaatgagactagcagtggcagtgataaaggtgaacaactggtgaccaaatgaaattgaggatgtgaagtggactgacttgggcaaagataggatgccagggtgaatatatggtagttatttcctattttgtttaaatttggtgacttaagtggttgctagtgtgattcagtaggatggaagggagacaagagttgccgaactaagttcttttaaacatcttgcatttgaggtacctgtgacatatctgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacaaccatatataaagtccatgagcctgtatcttcagcaaccagaacaggatgtaagctactcaaggatagaaattatgacttcatcatctgaggttctctaggccaggcacaatgcctgacaaataatacatgctatacatacataacattacacacacatatgcacacacacaatgttgtgaaaatcaagacactgatgagtcaattgagttattttttgatgtcttcacatgggttcttagggacagtctgccctgagttttttctctactttgtggcctccacattaggattatctttatttgtatcatatcatggggtaggggacatggaaggagaaatgtggataagggcatgacctgttactccttgacttaacctgtctttttccttcctaggatgtgagtgatgtcacagaaaggtatgtgtaaggagaacatgaggtagttcccctggactgacaaatgattcctttacccatgatcagtgggaaagggaagaagaatcagagtggggaagattcaagagagtagtcttgaatcgcgcatcacatggagttttggcatccccaaataaaggggatgaactggcctctctggtaggaaaatgtgggtgatgggaggtcagtaggtggggacagtactgttatttagaataaagagttgcagtattgcgccactgcactccagcctgggagacaaagggagactctgcctcaaacaaacaaaaaaaaatgaataaagagttgcagtatcagtgactccccaagtaccctgttagtgtacttttccataaacctctgtgcctgctttcatccctgattcttaagtttatagttacctcaaaatacacaggaattttctttgcccataaatttttttttttttttttttttgagacagagtttcactctgtcgcccaggctggagtgcagtggtgtgatctcggctcactgcaccttcctgcccgtgaattttatcagagtgacattcccatctgcattatttctcaaggtctaagaatttggtcttggcacatctgccttaagtttttctttctcccaggccttgctccctagtagattttcttttgtctcaattccagtaaaaacgtaaacccgagctctggaggataataatttagcccgggaatcaaacatgttctctatcacatactccagagtctcatccaacaaggtgacatgtcaaactgcttgcacacttggttcctccatgctcctcacagacacacgaaatgggaaccctatcgtcccttctgaaatctgtactctccgtttggaggtgaggacatcttttctccagctagtggcataacattcccagagacggcaaatcctaaaatgctgttttgaaggttttctgagaaatcccagggcctaagcccacagactcttctgaagaaaccccttcacttgatactttcaaagccccagcaataggcccctggtgttctgcctgtcaacccagacatcttcaacccctctgattttaaatattttatatctttttttagaggtagcaaaagatttccaagccattattttactgaactgcataacatctctaggacacagaaaaaggaaaattatagtattttctaaaaacaacaacagaaaaacaaaatgagactttaagaagttaaatcttggacaggcgcagtgactcacacctgtaatcccagcactttgggaggctgaggagggcagatcacgaggtcaggagatcaaaaccatcctggctaacatgatgaaaccctatctctactaaatatacaagaaaattagccaggcgtggtggcacgcgcctgtagtcccagctactcagaaggctgaggcaggagaatcgcttgaacctgggaggtggaggttgcagtgagccgagatcgtgccactgcactccagcctgggtgacagagcgagactccttctcaaaaaaaaaagttaaatcttacacaagtttatgtagatggtgagatgatagtttctagtctagctcttctggctccagtgccagggctgtttgcagaatgatgctaagtgtattcagaaaggaggattggaattcatcagtaggcttgggaggtaagggagatgggtggtggaggaacccacagtcagcagtgtgggaactcagaagtcctgtcctttctaggagtgagttctggaccctgaggaagccagaagctctccctacaaagctgagaagtatgttccgagccccagatctgaaaaggatgctgcgagtgtgtagaggtaaggagattcaggggaaagagtttggatgtgaaattactgtcgtgggaagaaataaacgggatagaggctatagtcggtatttgagcatagtggcaaagagggaggtcccagagggagggacatagtgtgctgaagaagatgcgttttgtatttaaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactggggtaagtagaagccatggcctctttgggctggcacattctgatctcctttcacatgccctccccagacatagccacacagatcctaggtgttgatgcctcccccatccccgccatatagttccagttcctccaaccacttcctgtgtttcctcttctcagcataacgagacccatgtccccgttctcatctgctgatgttgtaccttttcctacagttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtttcattttacttttttaatgtggatactagaaaccttaaaattacatatgtggcttacattgtatttctattggacaactctggagtagatcctataatgaaatttctgtccctaagtgagccctagtgtaaaagcctatggactcaggatacagaggaggtttcaaggcacatatgtttatctctacagaacctgcaccttcccagctgccctgaggcatttttatggaaggtaatgacagagaaaagaagatctcaacatatctagaagtgtagaaatttggaagatcatagaaagggctcatgaccagagaatgattctgcagactctggcccctgccgttagtcctcagtctgttgggcacttgaagctccttcatggtttgatgaaacactgatttgttatcaaggctcagcttgggtgtctatggtgagataaagtagtgcagattatagtaaaagctcactactggtttgttctaaggcaccgttttataatatttgggagatcatatctgtggaagcccagaggctggatgcaaactccttatcctggtctgcgtttcaattggaagagatataaaaggagatagggccagctgactgggacctatggggctggtggaagttcaggaaagagaaagatctgctggagtagttatccccttcccacttattttcccatataataagtaagttctaggcaaaagagttagcccagctctcttctgtaaactcattttacaagtaaatttactttccaagtgaatttactttataagtaatttttcttttttgtcaccagagttctagggatgtggtatagttatcctaatatttcccaaaatgtgagtgcttgctagagccgatatttaagtttgatgctaacttaaaaagaagattttggaagggagagggactttcttaacagctttattgtgatatttactttataagtaaattcacttggagaacccaaagtattgtccagtgaatgactttagataatagtgaaagccaaactaagtacttgctggaattctataggtaagacctggggaaggttgctcaatctgagacttggggacaattattagggtaagttcacagctctgaccttttcttgaggggttatgggggcttgacagaggccttctgttcttgacatgtgatagagtaggctcaactactatgaaaaagaactctaaaaatacataatggatcaaatactaaagaaatgtacttcttgttaatgtaaaacaatcggtcatgagtgtatgtaactggtggtgagtggcactgttccatgtgggattcatgcaccaagcttgctttcatcttgtggcacttgctgtaccccagaatggtaacagcatgaagctggcagaaaggtgaagaaaacttaggggagaaaacgtgctttttaaatccttagttcatagatgggattcgtaatatctgctcattttctattaatgagaatagccatagggctaaacctaactgtaaagattttttaaatgtctagctgtatgcaatcatgtacaatcaaatttcaaggaaaagaaaactcagattttggtggaaactgcctggaaccctaagtaatcctttttcccattatagaggactcaggatctcagcttttttctggaactatgttaattccattctatagcctaaagtttgtaaaagagaactgtattgtcactaaagttctagacatgtggtatagttatcctaatatttcccaacaagcgagtgcttgttagagctggcatgtaagtttgattctaacttaaaaataatctttttaggggaagaggactgtcttaacattattattgtgatataactgacatataatacatttcataaagtatataacttgatacattttgacttgtgaaactcatcaccatcaaggcaataaatcagatggggttcttttttgtatatatagcacttagagctatacatttccttctgtggctttaaatgcatctcacaaattttgatatattctccattctattcaagattctattttcccttttgatttcttctttgaccattgaattatttaaaattatattttttcccaaatctatgaggatgttcatatatctttttgttattggtttataatttaattttaaatggtccagatacagactttatatgacttgaatcctttttaattgtattgagacttgttttacggtaaaggatatgatctatattggtaaatgtttcatttgcacttgaaagaaatgtgtattctgtggtcctggggtacagtgttcaattaacatcatgttagttgatattattcaaatcttctgtatctttactgcttttctatgagagaggggtgttgaaatttacaactatatttgtggatttgcctatttctcctgcaattctatgagattttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttttttttttgttgttgttgttgtttgtttgtttgagatggagtctcgttctgtcatccaggctggagtgcagtggcgtgatcttggctaactgcaacctctgcctcctgggtttaagtgattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagccaccgtgcccagcccagctttcttttgattattgttttcataacatatcttttcatttttttttttttttttgagacggagtctcgctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccggctaatttttttgtatttttagtagaggcggggtttcaccgtgttggccaggatggtctcgatctcctgacctcgtgatccacccgcctcgcctcccaaagtgctgggattacaggcgtgagccaccgcgcccggcctcatctttttacttttaaactatttgtgtcttcgtactccagcctgggcaacaagagcgaaacgctgtctcaaaaaaaagaaaagtatttaagtggcatgtagttgctctaggtaaataatatagttatcttcatttttcccaacaagttactgcttgagttggcattttaacttagttttaattaaaatttaaatattttgctactttatattttgtcagaaatgatcttgattccatgggactctcagttttttaaacatttgctgtataactgctttgtgcatacagtctagcccttgccttcacagagactcagtcagttaggggataaaacaaaggcatattctgtgcaaggtttatttcaaccatcttttagaagataaatttggggttttagggttccaagatttgaaacattacatttgattggtgaagggctagttctcaggttctcatggggttgatgtttgaggccgagaataaccttttttttttttttccttgagatggagtctccctcctgttgcccatgctggagtgcagtggcacgatctcggctcactgcaacctctgcctcctgggttcaagcgattctcctgcctcagcctcccaagtacctgggatgaaaggtgcctgccaccttcggctaatttttgtatttttagtagagacagtgtttcactatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacatactagtatttgaagggcaaataattaaaatatgaaaaacaattagggaaatggagtctattttggaatctttgaaaaagcagaggagaaatgttaggagagaaatcaagatagaactgcaagtttaaggcattattgcctatctcagctaagcattggcctttatttcaagagatcgaaggaaaccctcacatttttgaactgaaagtcaacacatacatttgaatcacacacatttccacctgaccactgagggtacttgtatgaagacagcaactgagttttctatatcgcttcctctgtgtcaatcacgtttctatacattatatatatggactcaatctttttttttttttttttttcaggcagagttttgctcttgttgcccaggctggagtgcaatggcacgatctcggctcactgcaaccttcgcctcccaggttcaagcgattcaccagcctcggcctcccgagtagctgggattacaggcatcaaccaccacgcctgtctaatttttgtgttttttagtagagacggggtttcgccatgttagccaggctggtctcaaactcctgacctcaggtgatccacctgcctcagcctcccaaagtgctggaattacaggcttgggccaccgcgcatggcctgggctcaatctttatagtggtcctatgaaaataggtactgtcattatcctttttttaaaaaaaatgagaaaatggaggtacagtgagatgaaagaatttgctcaaagttggacacatatgaagtggcagaattgacctacaaaacagggcagcaaaattcagaggcaacatttttattcatttctgtctgttagaaatctgaaaaggtcagtgtgtgagtcaaatcctactttgatacctatttttgtaaatgtactttattggaatatcaccatgcttatttatgtatcatctgtgactgctttcaagttacaacagcagtgttgactggttgcaacagagactgcttgacctgcaaatcctaaaatatttactgtttgaccagcctgaccaacatggtgaaaccccatctctactaaaaatacaaaaattagccgggcatggtggcccgcgcctgtaattccagctacttgggaggctgaggcaggggaatcgcttgaacccaggaggcaaaggttgcagtgagccgagatcacaccactgcactccagcctgggcaacagagtgagactccatctcaaaaacaaacaaacaaacaaacaaatagtcaaagtaatgtataatgctcaaaatgtaatcttaggcctaatgaaggaatagactcctatattactcataaatgatataagtaatattaaacttggggtctagcttacgtgaccaagataatgatgaaaactttaagttgaaagcttatgttgaaaaacaaaataaaatcatttcatatgcaaattttaacaccacagtcaggaatgtcaatggatatacagggtaaaagaagagagaaaattaacctagatgataaactgtatacattgcatattgattaatctactataaaacaatggcacaagtacatgattgttttgattcttgaaccttgattgattatagatagcatcaaatgtagtatactctgggggagaaaagattggactatgagaggaaattctattttaagctttgtacaattataagacataaggaggacacaaatctcattaagggcagatttgggagagaaacagtgacaaagctaaaaccgtgacttatttgggaaacatcagtgtagcatgataaggacaagccattttatatcactcacatgagcaggcttcatgtcattgggtaaaaattcacagtaatcctggagaaaatgaagaatgtgtgaatcaatgtattgtgtgcaaacggtgatatgagggtagcctgagtcatatgaactccctgggaaaaacgaccagctttgtgtatgtagcaagtggacttggtactcctattacctaaaaagagcctctgcaagtacttattgacaaaagttgacatctactctgcatatggaatagctgtccctgcctctcaggcattttgtaccataaaggccaacagattgccattatcaatattttgatgtcctcaaaacagtttcagtggtaaccacatgatcgtacaagaatacgcctccttcattctgttgccagagaagtacaggaatcttcagttctttgtcttatttggagaaagcattctgctttccagtcttttccagtggagagtaggcctttgttatgggggatgctctgaacatatttcagaatggttcttttactctctctctgccagaaaagaaaggatctttttcttggctttccactatgggaactcactttggtttttggaggtaaattccaagcaagtggggcgggggcggggccctaagtctaggtgctaggagtttctctctctcaagctagtccataatcagcctccggcaatttgtcagaactactatttaagtgttcctaccagtatatgactcaggcaactcctgttttaaattttttttttttttttttttttttttttttttttgagactgagcctcactctgttgcccaggctagagtagtggtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcaggtaagcagatttaggctgtttattctgtgtttacctgtctctacattttggggtggcagtttttttcctgtgactttatctgatgagacttaggaaagtcattgatttttagttggtttagcttttttttccttttctttcttctttttttttttttttttttttttttgttgagactgagtctcactctgtcgcccaggctggagtgcggcggcgggatctcggctcactgcaacctccgcctcctgggttctatggattctcctgcctcaacctcccaagtaactgggactacaggcgcgcgccactgcacccagctaagcttttgtatttttagtagagacggggtttcaccatgttggccagattggtctcgaattccttggccagactggactctaactcctgaactcgtgatccgcccgcctcagcctcctatagtgctgggattacaggagtgagccactgcgtccagccaagctttttttctcttgtgagggttgcagtaatgagtctcaagctctttacatgttggaactaaaactggaagttcctggtattcttttctacttctgtagtaattctctttctttggaaatcactttctctgtctgcccagctaagtctccatttttcaggttatgggtgcacattatgccttacggtgggaggggcagaagtactgtcatgggctccctctgcaatggtgtttgtcagtgttctcttcctccagattagcttcttctttccattaagtgagaggctctggtagacctcaggaatgaagcaaagcctgttctgctcctacagtgagatagcaaggcaaaagctgctgtgcagtgttcacatagtatatatggtagagtccctgtgtcttttggcatttttgttgccaactatcctttctctgcttctaaactagtaaagcagttactgttctggtcccagctttactagaatatttttagtccccatatcttggtgacctttggtgggggaagcgattccaagttagatacaggcagtttctctatgtgtagacacacattcctatctccagcactcatccatagcaactggaggaaattcacttctatccattttcctttaacccctgcatcccagtcacccctttattgcaatgcccgaggctctggatcactccaggctgctgcactctcttaaattccaggtaactcttttgggatatttatgactttcattttcagggctttgggacctgggagaatggtgtgagtaaagccagagggatctgagaagacagatactttactcctgcactggtgtctctagataatttcccagctggctctctctgcctgtgtaaacaagccttgaggatatgacccttgccaactcttgttagccactcctgtttacatagagctctaagtacatgcccatggaaatagctgcatattcttgaatgactaaacttgctcatttttctgtccaggtcatttctgctatccagaagcacagctcagctgagagtgaggcaccagaagaatgcctaagagtttccaaaagtgatgatttttctaccattaatatattatatgttggtagtatgaaaggaaaataaatcttggagcttcaaaatcactaggccaaatagaaaagtcaagctgggaactgcttagggcaaacctgcctcccattctattcaaagtcatccctctgctcactgacataaatgcctatctgattgactcctttgaaaaggctaatcagaaactcaaaagaatgcaacaggttgtccttcaccaacctgtgacctggaagccccctccctgcttgagttgtcctgccttttcagatggaaccaatgtacatctcacatttattgattgatgtctcatgtctctctaaaatgtatacaaccaagttgtgctctgatcaccttgggcacatgttgtcaggacctcctgaggctgtcagggacacatgtcttcagccttggtaaaataaactttctatattatctgagatctgtctcagattttcggggttcagactagacagttgttaagaaaataacaaaaagacattaaagacatagcatagttgcatgtccattgaactcagagaaatgagttttttaaaaaggaaaaaactcagctgggcgcggtggctcacacctgtaatcccaggacttcgggaggccgaggcaagcagatcatgaggtcaagagtttgagaccatcctggccaacatggtgaaaccctgcctctattaaaaatacaaaaaattagccgggcgttgtggcaggtgcctgtagtcccggctacttgggaggctgaggaaggagaatggcgtgaacccggcaggcggacgttgtagtgagccgagatcacgccactgcactccagcctgggcgacagagcgagactacctctcaaaaaaaaaaaaaagaaaaaaagaaaaattagctggacgtggtggcgcatgctgttaatcccagctactcaggaggctgaggtaggagaatcgaacctgggaggcggaggttgcggtgaccaagatcatgccattgcactccagtctgggcgacaagaacgaaactccatctcaaaaaaacaaacaaacaaataaaaaaaaccggaaaaaactcaagtgaacaaaatgaatgattgaaaattgaatgtcatccacacagaactgatgggctaaggtaatatacacatctcaacacatgctttaacaaatctgtctgatgctttactattgtaaatgaaagagtatctgagaaaactctcaatcaatttaggaagtttattttgccaaggttaaggatgcacccatgacagcctcaggaggtcctgacaacatgtacccaaggtggtcagggcacagcttggttttatacatttgagggagatgtgagacatcaatcaatatatgtccgcaaaggcgggacagctgagtccggaagggggtttccaggtcataggtagataaaagacaaacaggttgcattaagcaatagggcaaaggaagtaaccagatattcatttatctcacctgagcaaaggggtgactttgagttctgtctggagctttttttttttttttttttttatcttagtagctgtctttttttggaatagaatgggagccaggtttgccctaaccagttctcaacctgacttttccctttggcttagtgatttttgggtcccgagattttcttcccttttacactatctaaatgtattagttaccaatattgaaataaggaaaagaaatctgaaagtattaggttggtacaaaagtaattgcggttcttgctattataatacttttatttattttgtttatttttatttttttattttttgagacagagtcttgctctgacacccaggctggagtgcagtggtgcgatctcggctcactgcaacctccgcctcccgggttcaagcaattctcctgcctcagcctcctgagtagctgggattacaggcgcatgccaccatgcccggctaattttttttttttttttttgtaattttagtagagacgggggtttcaccatgttagccagggtggtctcgaactcctgaccttgtgatccgcccgcctcaacctcccaaagttctgggattacaggtgtgagccaccacagttggctttataatacttttaatttcaaaagccgcaattacttttgcactaacctgatagtaattgactcccttaaaagtagtcaaagcatattcccaaggtattggatgtggatacatttttgtgggaaagttgttaaacttccaacaagtttataattgtccttgatcaccatgcatgagtcagatggagagggcaaaaatgaaaattgtaccttgtcaggtggtttccaaaggtggcaccttttattatgtaatgtgctctacaggaggtagactaggattgttttgatgcatacagcacagaaaatgaatctatcaacttatattcctcatgaaaatggagcatgctgtttgtggaggcacaatgtggggtcatcctgtgaccaaacgagtggcaactcttgttcaagtttcctcctcgttcggtttgatttcaaggttacctcagtttcaaagcagccctttctgtccagggcacaaaactcctgatttactacttacaactagtggttctcagcctcagattcgcgtaaaaattacctggaagacttttcatttttaaataatgttactgatatatatgttatatgcaataatatgcacccatttactgtgcacagtttgatgagttttgaaaaagttttaccccttttaaagatttagagcatttccaacactcccaaaagttccccaggtcctttgtagccaacttttctcagcaccatccacctctccgccacccatcctccatctcctagcgggtgacatggtactttggtaggtagcacacaagtggatcgttggagctgaaggataattcaaattggtaaactgattcgagggaccatgtgcaaccatgaaagtggtaggagaaggggagttgggtgtttagctggcctgggaggcagggaaggttaaaacagggcttttcaaacacagcactattgatgttttggaatggatcattctttgctgtgggaactgtcccatacattgtagaatgcttagcggcatctgtgacctgtacccactaagatgccagtagcattcccctagttaacaaccaaatatctcttcagacattgccaaatgtgccatctagtgcaaatcctccattctgccctcgagaatcactggattaagagcattaccttctgtccagaggctctaaaggactacacagctcatttcacctagacgctccttccccttttctcttcctgacagccccaaaaatttcactttcatttctcaggcagttcctcctcaggagggagggacttcttcacacagaggaacctcatttgttgaatgaatcctgaccacacccaccctggcttttcttcacctcttcaaccaggagccgagatttctgttgctctgaaggtgtgtggggaggtttgtggggggtagagggtatgagactccaggagaaaagttctcagtgaagttaggggaatttgatttatggccccaagtctcccctgctctgtcgggagcaaaggctagcttgcaggcttcctgctttgagtgcacactgatagcagcctagagtctggggagggacagccttgaaagcagtgttaaagaggcagaaggccgcctttgttttctggggtgtctttttttcctccaggctgaatctatttccattcccttcctattgtataattttgattttctaccttgcaaaggaaacaattctctctctctctttctctctctcaaagagatgaacagaagatctcttattttccacctcctactccctcctcaaaagagaagttggtgaaaggaggtctctgttttccaagtgtgtgcagggcttagctcctagtatgtggcgtcagatagaatggagccatgggagcacggccaggggttgaagtgggttcttttgctgccctcctggcaaccactaaggggctttctgtggccatcctcacgtattcttagtccttggcctccctgacaatagcaggttgagtgatgtgactgctgcacaccgctctgttccctctgttcctatgtctttctgcaggtcgtctcagggctctccttgcacatccctgaacatacctgtttacttttacttcagtaacccatgtgctaccagcgtcttcacctgtctcagaacttgctcctcatcattcttcctcttagacacaccttggcattgatttgtaacctcaatttgttattgcttttctttgctcacaattacttaacagaagttgttcattgtgggctcagaaggagcccacggatttaatcttcttgttaagaatttgatatagagtatgtcctatcttaagctcacttgtgagcaatttgcaccttgattgatatgttacagatattctgacacatgccattctggcctctgctctcacccttcagagttcactgtaactgccatcctgtgtctctgccttactcctgggtagaatccatgtctgcctacatactgactgtctcccagaggcgtctagtcaggcacaagacccaacatatgggataaaattgattataaagcaggctgctaatgtaaaaacgtgcaattagcatccatttaacattcaataaatatgaaatatacgtggaagcctacatccaaatagaaagtgatcatagaccatatcgatgaatgttagagtacacaagaagatgactaatactatggagtaacatcttcaagaagttacattagggtaatgactctgtaaagacctcatgaaggccttgcaactttaaatagtttttatgaaagttttaaatagttttcattgtaagaacacatttgagtagaatcttaaggatgcgaggaaattaaaggctttaatggtttttcccacgggcttaaaaggagaacagtgtggaagattaagatgggagtgtgcctggagaggcataaaaggtgagttcttaccaggcgcggtggttcacgcttgtaatcccagcacttagggaggacaaggcaggaagatcaccagagatcaggagttcaagaccagcctggccaatgtggtgaaactgtgtctctactaaaaaaatgcaaaaattagccgggtgtggtggcggatgcctgtagtcccagctactcgggaggctgaggcaggagaatcagttgaacccaggaggtggaggttgcagtgagccaagatctcgccattgtactccagcctgggggaaaagagcaagactctgtctcaaaaaaaaaaaaaaatatggtgagctctgaggattgaggcagtgggaaggcatgtgtgatgtggacctaactggaccattatgaagtctggcctcgctctgggtggcatgggtttgaacaggagagtgacatgattgacatctgctttaaggtgatcactctgtctactgatgtaagaacagagatgagagcagagtgaagaaggacagtgatgggtgggcacagtagctcacacctgtaatcccagcactgtgggaggccaaggcgggtggatcacctgaggtggatcatgagtttgagaccagcctggccaacatggtgaaactctctctactaaaaatacaaaaattagctgggcgttgtggcaggcacctgtaatcccagctactcgggaggctgaggcaagagaagcgcttgaacccagcaagcagaggttgcagtgagccgagatcatgccaccacactccaacctgggtaacaagagcaaaactccgtctcaaaaaaaaaggaagggcaatgatagtatcagcaagactagtggaagaacaatttcctgaattcaggtggtttctaccagagtggtggcagttgaggtggttggaaactaatttgaaaaaaaactctttcagcatattctcacgaagtaacagacagaaaaagacattagggattgcttaatgaaaatgattctatgttaaaaaatagctttttggagatatattgaccagaacactacagctcttggggagagagtcattaatgtggtatagattgggccctggactctaaggagtagctgaagcaagaactcagtgcacagaggaatggggaggagatgctacaatgtttctgagctctcagggtctctggatgtcaaaacaggctctactttccttattggcagtttctgaccaagaatccagaagaagtgtctaggatattgtctagaaacttcaaaagacatcctcccctaaaagtcactcgtagagacactctaattttactatctacctgcagagagacttaaagtttgcattatcatatccagatgttaggagtccagatgttaggagaagactcaaatgaagggtataatcacctggcagctatggtaaccaggtaacctgggagttctgtcaggccaatggcactcatgttcccttctctacctccctgactgctgctgggcttgagccacactgggaagtggtggggtcatttctcacacgtgggaccgtggttactctgcacttttctcattcttttgccattatggtggcagcagctttggcatcaacatgcatcctcactgtgaacatgaagtcacagcccgtggcagaatgcatgttctactacttcctctcctggagccccccggtatttctaactattggttggatactgattggaataaaagataacaaagaaccccacatctgtggttggctcatggctttagccataaacaggggtgaatattatcatatcatataaactccttgtcttactagtcatcagatcctggtctgaccaatggtcattgtagccaggggctaccagtatatctcttttgtatgatttttagtatctgtaccattggctggatgacactcgccagtcaactttcagctttttttcctccttaaggtcttttgatggatggttagaggagtagacaggtctcgaggcctaggtttatctccatacagcttttattgtaccccatccttttgccaagcgtgggaaagattcctaagttgtcacacatcacagatctttctttcactatcaaacctgttcaattatattagtttcctagcactgttgtaaccaattatcacaaactagatgacttaaaacaacaggaatttgtatcacagctcaggagcccagaagtccaaaaccaagatggcggcaaagttgatttttttttttttcagaaggctctatgtgaaaatcggttctattcctctctcctagcttctggtggtttctagcaaacctcggcattctttggcttatatctgtgctattcccatctctgcctctactgtcacatggctttctttcccgtgtgtctgtatgtcttctcctcttataaaaacacaggtcaaggccgggtgcagtggctcacacctgtaatcccagcactttgggaggccgagacaggtggatcacctgaggtcaggagttcaagaccagcatggccaacatggtgaaaccccgtctctactaaaaatctaaaaattagttgggcgtggtggcatacacctgtaatcccagctactcaggagactgaggcaggagaatcgcttgaacctgggaggcgggggttgcagtgagctgagattgtaccattgcattccagcctgggcgacagagcgaaactccatctcaaaaaaaaacaaaaactacaggtcattgaatttagggcctgtctttatccagtatgacctcatcttaacttgattacacctgcaaagatgtgattttcaaataagttcacattcacataagtgaacaatttttgtggagggtataaatctatctactagaacaagtatcaaaatgttactgcctactgagagccaccctttttccctttgcctcacagtttcttgtctaaactgacctcaggttctgagaattggcattgtatcatcatgccactactctgtggtacaccctctggctgaccacaagcaataattgcaggtttgttttgccatttgcactcatgcagcttaactccacagggggaatacaggacaggagatatagcatgcagacagggccgcttcaggtgagctctccgtgaggattcttttgttttgttttgttttttgagacggagtctcgctctgtcgcccgggctggagtgcagtggtgcgatctcggctcactggaagctctgcctcccgggttcacgccattctcctgccttagcctcccgagtagctgggactacaggcgcccgccgccacccctggctaatttttgtatttttagtagagatggggtttcaccttgttagccaggatggtcttgatctccttacctcgtgatccgcctgcctcggcctcccaaagtgctgagattacaggggtgagccaccgcgcccggcctcagtgaggattcttacggtggtacaagaccatgtgaccatgtggatgcgtgtgaaactaacgtagcttaggtaaatcttacatcaacggattgattcccttgtaaagaccatgaacatagcttccagggccctacagagaatattttgttacaagagtctcaatcctcttacggaaaatgaggtctgtgcttaccaaaaagaataaaaataaaataatataccaggggatggtgatggcgatgtgttttttataggaagaaaggacttaagcctaatgataacctttttttcccccacatgtctagtctgacttccaatcttatttcctttaccttaccctacttcccaccctcatctgcttctctctgttaacttgtcctgcatcctcccatccctgcccccacctcctattcattggaaagagactgtcacttttacttcatttaggaagtgtcacatatccaggttcctctaggctcatgtgaggccaaggcctagggctttttgcatatcagccacacatttaaaaactttcgaacatgttatgatgctatgtcctccatgaacggggcattcacttccatgattccttctgcctaaaatatttgttttctttctcattctgtattcctttctcattattcagctttcattaaactcttacttatccaagcaagatatcttggatagttctctatttagcacattatttggtcttctaaaaacctatacctctctatgatggtgttttttacacctaccattttacattttatgaatgattatataattagcttctatcttcttaggtgactgtttactttattctggctaataccatctgttcattactcaactttggattttaatccatttcctgaattttaatcacggaagataatatgtcttcagtgagaatttccaaaataaacacatgaataattggcattcaattagtggatgtggatttaacacagacagaacttcatcgctcctaaatgtggtctccctttatgtattgggacatctctctcatggccaacagccatctccttggtatttctattcctcgatgatctgacattggtatgaatctgtgatctgtgtgtaattcagctggttacacccctcccccaacgaatacacacctttgggttcctatcaacctctgtaacatccttcaggccaagaagaaatcctaccatctacaaacacaagacccccccagaaattcccaacttatgtggtttcctccatttctacactctcataaccctggatcccaatctacttctttcaggctttacctcggcttttctttgtttaaataagtggagtagcatggagacctctgaaagagaactctgaggttattatgttcactccaattctaccatcgaattgggtgatctttgtaaatcatttaattttatttattcatctgaagaaagggagtactcttatttctcaagaattttggaaggaggaacaaacaggccaaagtgatttttaaattgtaactggtaatgaaatctccatattgtggtcattgctgtttctgtcggtatctctggaaagtctgtgagggcatgggaggattttgtgtgggtagatgtgttaggaggcgagcacttcttcactggaaaccacatctggggttctaaagttcagctattgaagaatttccaaataatggaaggaagataatgaaacaatgataaagttttagtcatctatggagagacagggaagttttttttatatgtttatcaaacattgtgcttctctgtgttctaaacactgaggctatagcagtaaaaagacaaaagtgcctaatctacatgtagattatgttttagaaagaagaggtggacatttaaaaatagataatgataataaaagaaagatggcaaatgtacactgaatgatgagtttgtggttgtgctgtacttaagtttgtcttagcagcccttctgatgaagggacatgtaaggagaaagttgaaaaaagtataaacgaaagtcatgcaaatagcaacaggatggtaattctaggctgagtaatgaacaagtgcaaaagccttgaggcattaacagctcgcccagaccactttcagccatttttggtttctcttcctcatcttctttgttctttgatattgcagtctcggccagtctttgatgtctgtgcaattagaatgctttttatttgtaccattcttataccatcccctttcaatcttctcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggtagggccctagatggagggagatggggcagaagatggtagttggtggaaaatctcaccttttcatccttttttttttttttttttttttgagacagagtctcactctgtcgcccaggctggagtgcagtggcgtgctctcggctcactgcaacctctgccctctgagttcaagtaattttcctgcctcagcctcccaagtagctcggattacaggcgcctgccaccgcgcctggctaattttttttttttttttgtatttttagtagagacgggatttcaccatcttggccaggctggtcttgaactcctaatcttgtgatccacccacctcggcctcccaaagtgctgggattacaggtgtgagccaccatgcccggccttttctttcttttttttttttttttttgggagcaataaagctttttaatcacctgggtgcaggcggactgagtctgaaaaaggagtcagcccttttcatccttctttaccccttgtggaaccataattctgagtcccgtgatcttctccatgtacatctttcacactgtgctcagcttccaatgcctggggtacactcttgtgtattcctttcatttacataacagatgatcctagagtacagtctcttagccaagaatgagaaatttttgtcttgttttttcctttttcattgtataagtgataaattccttcccaaagttagctctcttgcttctctaagcaggataattgctaaggaacattgtggattgaatgaggaaagagcattgataagaggaaaggactttctgcagggtaaatacttactctaaggaaagacagaatcaggctactccttttgaggggtattgattttcatcacaatgaatgaacaatacattcatctcctcaaaattttccccatgtcatagattctaatcaccagcttcacagtttctgtaaattgcttttttctgggatcaacttgattttttccctgtttgtcctctatccagatactaagaaagcttatagcttgactgtagtgtgattcccttctcataggagaaactccaggcagtcctcaagaggctgaagaaggaagaggaggaagctgagaagctggaagctgacatcagagaagagaaaacttcctggaaggcaagaggagattctgaaggatttctgagacaggaatcttgacaggaccttaatccaaggaggcctcgtcctttttattccttgacattgcatgagtcctgaaaccatttgattagttctcttctctgtcctgtccctgttgggggtggaggctagaaagtggacatgttacaattacacatacatacctggaactgagcacaaagatagactctatgatgaggaaggctagcaaatactgtgttccattgctcttttccaacagggctctactacttctggtggaagacactacataaaggactatggttttcctcaagattcaaattaggagtgtggtaaggcaggcagtcatgaatatccaggaaagctatctagaagctaagccttatgttttatattttgtctcagggttggcctagataagacagtttgaggtcattgttttggtaggtactgaaaggaaaatagtaggaaaaaatagcttccctccaagtacctctattgcttctactcccttgctgatttgaactccctgaaaaaaaaaatcgatatatagataatacaaatatatatatacagataatataaatacacacacacacacacacacacacacacacacacacacatatatatatatatatatttccctactggctcctaatcccttgcacaataggccttagcctgacaaacttactacaactctctcttgtccatccttgcagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggtaagaaggttcgctcaatctgagattctgggaacacagttccctcctgtgtccttgcgttctcatcctggtggtgacactaaggggtttctttggccttgcagtgccgccttgtcgtccattctagatgtcatggacatgaatgacatttttattaatttatgaagtaagggaatacattttaccttgcagaaaagatccattatatctagttatagtctctaggcccctattatatgtgatctagtgtcaagcattcatcagacttctctttactctggttagtcacaggtaaacacatgcattttcaggtttaagagcatacacatttaagaaatgtgttctatttaagtttaaaatatgcttatttgttatgcaaatgttccctgttaatttttttttttttttttgagacggagtctcgctctgtctcccaggctggagtgcagtggtgcgatctcggctcactgcaagctccgcctcccaggttcacgccattctcctgcccagcatcccgagtagctgggactacaggcacccaccaccacgtctggctaattttttttgtatttttagtaaacatggggtttcaccgtgctagccagtatggtattaatctcctgacctcgtggtccgcctgcctcggccttccaaaatgctgggattacaggcctgacccaccgcacccagccccctgttacttttttttaaacataaagtgatagaatattgagccttttggggagaaagatggacaaatatatagacagacagtgctctcctttctttgctgaatttccaaatattccctttttaagatttggaacgaagcaggagagtaactgattttcatttgttgaattgtttgctttgtctctggtgcttatatcccagctttttttaaattcctttttccttttgtcttctttttttgtttaaatttaagattactctggaacagaggttcctaaacgtattttacactcattagtatggctataataaaaaaagatggacaataccaagtgtttgggaagatgtgaagaaattgaaaccttcttgaattgctagtagagatgtaaaatagtaaagctacttaggaaaaactgcttggcagttgctcagaaatgtaaagagagttctcatgtggcctagccattccattcctacctatatacctagaagaactgaatacatatatttgtgcataaacttatatatgaaagttcacagcagtattgttcataaataaaacaactcgtatctccttaaactgatgattggataagcaaaatgtgttatatccaaacaatgtaatattgtttagctgtgaaaaataatgaattaataatacatgctatgacatggatgcaccttgaaaacattataattgaaagaaggcaaacacaagttcttttttgtatgattccatttatatgaaagtctgtaagtagcaaatccgtaatatagaaactagattagtggttgccagagctctggggaagaataggaagtaattgctaattagtgtacaatttctatttgtagtgatgaaaatgatctggatttactgtgcaatgacggttgcactacatcgtgaatattttaaagcctgttaaattgtgcactgtaaagggcaaatcttatggtatttgaactacatctcagtaaaaacaaaaacaaaaaggttccgtaggcccttttttatggttcttccttaagctcttcacaaccctttgaatcgccaccttcacaaaagaacactgtgtttatgtcatttgtccaggcatttgtcctatttcagtcagtcttagttgctatttggtcacttggaatttaaaaaaatattggtagatcaaaaattataaatgctgtgggattaacatttcacttctagatgttagcttcaaagaatggcaaatggaaaacttaggaacttattcttttatctgagtagggactttggctattcctctccaatatgttaagatataatctgttggcggggcgcggtggctcacgcctgtaatcccagcactttgggaggccgaggtgggtggatcacgaggtcaggagatcgagatcatcctggctaacacagtgaaaccccgtctctactaaaaatacaaaaaattagccgggcattttataatatacaaaaaattagctggtgatggcggctgcctgtagtcccagctactcaggaggctgaggcaggagaatggtgtgaacccaggaggcggagcttgcagtgagccaagatggcgccactgcactccagcctgggcgacagagcgagactcagtctaaaaaaaaaagatatgtgctgttgtatttgtggtatgtctcctccacaatcccatctcctgagagtccctgtaacagctttctttctatatggattctcatgatggcgatcgggatggatggtgttatcatatatccattgtttgtttgctagagggactgatactcatttcgtaagagctgcattcaacacttactgccaaagaacgatctagacagaaagacgctcaacttgaaaactgatgcaaaaattagatgagattttaggttgtttcccttataaaggagatactttgatttttaatgctttgctgtaatagttttattatatttggccatttttatttttgaaaggatggaatggtaggtagctaaatgagggaaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctggtaataacacctggaattactcttgcaagaaagactagcatgtctatttccatccttgtacttgtttagacctgagaaaatcagcactatcaagaatgaatgagttaattatatgtaaatcagcgtatccaatccttacatccctaccagccacacagtgattattttaagttggacatctgacccaatcctgaatgcttgtgggtgacaaaattgtactgtcattgcagtgaagggaagttctcctttttagcagaaaataatatcagtgaagataattcaaataaagagattcaagttgctatcaactaaaatctgagaatacagtcaaaatatagggaagaaatgagaattaataggcacagagaggccagaattgtgacagaggtttgagcttccagagccatctgtgactaaagtaatacctctctggccacaacccttactttcttcccagttaaggcaattttagttgttgaacaacaaaactatgctaatacagagagcaaaaccatttatttggttgtacaccagctggtgtcatgaaagagttaaagccaaatatattggtacatcttgctcaaaacaaattaacccacagtggtgatgatgggggaatgcagatgactaacagaagttaaggatggactggcttgataaaatgttttagtgtctgggacagggactgagtgaatattgataccagtttgacaatacggcataagaaaggaaacaatatggctggagaacagcttatgttttagatattcttagttactggtgccgttttttcttctttgtggaatgtagtattgtacctgtacagaatgaagtctagctgctttttttcacagtccaatgagatgcagacagacttggaaaagaagggagtttatttttgcaactggttacagggagaaggtcagagtaactatcagaccaactcagagttacaaagttttttttttctggtgcttatatacattttaagctctatgccttcacgtgggagtgcacctacatgcaggagtgtttcaatctatatctatctttaactagggtctggggtctagaaagctttctctagagtcttggaaagtttcttaatcttaaatgggccctggtacaagttgtatgtctaagaatgcttttattattcgatcagactttaaggtatgagaaaacccaggcagggtctttaaagggtttgttttcacatttcagccctggtactcactcaggcaccagcttttccagttctttaatgtttaacttacgcattcatcaaaattatagtaaagggttaagggaaactgattgttctggttgctaatggaaacctgacctgccacagtattatagaaacatgattacagacaaaagacaatgattagatataaaggttgacaaaaaacagcacctatgtgtgagctaaaattaagattggaggccaggcgcggtggctcacacctgtaatcccagcactttgggagaccgaagagggcggatcatgaggtcaggagatcaagaccatcttggctaacacagtgaaaccccgtctctactaaaaatattaaaaattagccgggcatggtggcacgtacctgtagtcccaggtacttgggaggctgaggcagaagaatcgcttgaaccggggaggtggaggttgcagcgagccaagttcgcaccactgcactccagcctgggtgacagagtgagactctatttcaaaaaaaaaaaaaaaaaaaaaaaaaaaagattggaagaggttgcctataggcggtggatagaacaggacttttctgactgtacataagactatgtcatctgtaaaaagagagagatttactattttctttccaatagagaagcttttttaaaaattagtttttattggtacttaataagtatacatatttatagggtacatagattttggcacaggtatacaatgcataataattacatcagtacatcagagtaaatgatgtatccatcacctcaagcatttatcatttgtttgtgttgccaacattcagattatactattttaattattttaaatgcataataaattattgttgactatagtcacactgttgtggtatcaaatactaaatcttattcattctatctaactgccaacatagagccttttatttgttttctgtgactaactgccctgactagaacctccaataccatgttaaatagaagtagtgagagcaaacatccttgtcttttctgatcttcgggaaaaagcattcagtttttcaccacaaagtatgatgttagctgtaggtttttcatagatgtgttttatcaggctgagggacctctcttctattccaagtttgttaccattcctgttttgttttgttttttttatgaaagtgtgctgaattttgctgaatgctttttttcatgtctattgagatcatcatgtggttttcatcctttattttattaatatggtatattacatcaattgatttttttttatgttgaaccaaccttgcatttctgggataaattctacttggccatcaggtataatctttttgctggattgccagatttgattttcttgtatttttgttgaagaattttgtatttatatttataagagatattggtctatggttttcttttcttgtgatgtctttggttcttttatcagggtcctttatcagggtaggatgagcctcatgtaatcaattaggaagtgttccctgctcttctttatttttgaaataacttatgaagttttgatattatttctttttaaacctttagcagaattagccagtgaagccatctgggtgaggccttttctctgtaggaagtctttgaattccaacttaatctcttaacatgttttaggcctattcatattttctatgcgttctttaatgtgtattgatagtttctgtatttctaggaatttgtctgtttcattaagattatctaatttgttggcatacagttgctcatcattttataaaccttttaatttccttaaggtcagtagtaatatcccatctttcattcctgattttttttcttggtgtgtctagctaaatgtttgccaattttgttgacattttcatataactcacttctgatttttccatttttttttctactgttcttctttctttcattagtcttacaccagtctttatacactttgactcatgttttctcttttctttctaggacatgagtggaatcatgaaatggtgcgtatgggtggccaggagtggtgcttgtgagttataaagaagtgtttgtagctattagagttatttggtggtcaattggaataaaaaatctcccagagtagtaaaatttggatgtatcgttatcttaaattgctggtccccgatgagtatttgagtgttccgtaactattaatggactcgatcctatggtagtaaattcagtggttgaagttcagagctacagccaaaaaggatattaaggatgagagcttttactgtcagacttcggtgacttcactcatttaattcatcctctgtccctgcatccagccctggatcttttattttatatgtgtttgtcatacacatggagggccttgtcaaatcctaaaatagggcatggagacagcttctttatatgtactttgcttacttagaaatagaaggtaccggatcattatgcaaggttctctttagatttccaaaagtagactcgagcctcaggacggtagctgtgactctggtgatgataattaatctctgccagttcacacactttagaagctcctatggaaaagtgtagtccttgttccttgtgtctaccattgccaacccacttggaaacatcaagtttcttacaaagacataaaattctaaccatttttagttaggttgtcataacttctcctttgccgagtgttcgtgtttcccaggaatctgaaatctcaaatatgcgccattccactggagttcaggctttgaactcgggcacaggctgacaggatttccctacagagccccgtatcacagtcaggatctacagctcagaataccacatctctggcccctcccagaaggcccactgagatgcagtgagttttccacatatcacataccatttctacaggtagcaaagtcttttcctatcgttttatccaattttttattatttccattagatatcaaaggagggtttaattatttcatttttaaggaagaaactgtgctttcaagaaatgaagaccttctcaaggtcacccagaggataagagggaaagtagacacagtcacatttcttctggatccagggtccggctctcccttctccccctcctcaggctcagggagaagggttcaagtgcatcagtgatgtgaaggagatgaaaccagtgatgtgggagggatggacacaggatgagagatgtgggggtcaaaaaatttttttcatccctaggagtgagatctggaggctgaaaaagccaaaaatggtttccaagaaactgaagactgtattccatgctccagatctgagtaggatgctgcaaatgtttagaggtgaggagaagcagacaaagactgtggatgtgggattgttgtggtgtcaggtaataaactgtctaggtgggataacttaaaattgaggacagaagagaggagggaggtcagagaataaggaatattctgtggtgaagaggatgcatttatatgtaaggaaaaatggctaggtctctggtttatcttttaattcactagctcacagcttcatggtattcccttcccctgtccctactctaaagaatatataggtatcagtgcttactcctttgtttctaatcagcatcactgaatcttttattatttcagaactgacagctgtccggtgctactggggtaagaaaaagttagtctttaaataactgttttccaattacctttcagaagtttatggtttcaatgatatcttctgatcttagcctcatgcattctcagcacctcccaaaacatttgctaaatacatttctccagtgttttacccctccaattcatcagtgcaagtttttcagtcacttcccaagttcgttcatcaccatgtcactagataaacctactccatatctgtcacctaatcatatatatcacacagatgattatattcatatacatatatatatatttttttttttcttgcagtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaagtgtgagctgtagtaatgtcctgtgcaatagttttgtggccttcagaggaatagtagttgattttactgaagtctcatttttcaagttcccagactccactgttaagaccactccaattttagttttgttttatagaactttttatactgagagtgggactgttttttttcttttttattgtacatatttaagatatatatactatgatgttttgatacacacttacatggtaaagtgattactacagccaagtaaattatacatccactgtatcatatagttaccgtgtgtcgggggggtggtggttagtgcatttaaaatctttcttagcaaattcccagtagacaatacaatattaactagaatccttgaaatagttgggatttttgtcctgcccaaatctcatgttgaaatgtaatccccagtgttggaggtggggcctggtgggaggtgattggatcatgggggcctcatggagggcctcgcaccatccccatggtaatgaatacattcttgctgtgagttcttgggagatctggttatttaagagtgtggcacttcctcctgtctctgtattgttcccactcttgccagagatgttcctgttcctgctaatgttaggataaaaaagtgattatatttgacaaaaaaaatttaagttagtacaacaataaaaaagtacgataggctgggtgccttggctcatgccggtaatcccagccagcactttgggatcccagccagcactttgggaggccgagaagagaggatcacgcgaggtcaggagttcaagaccggcctggccaaaattgcaaaaccctgtctctactaaaaatacaaaaattagctggatgtggtggcgagcccctgtaatcccacctacttgggaggctgaggcatgagaatcgcttgaacctgggaggcggaggttgcagtgagccgagattgcaccactgcactccagcctgggcaacaagagcaaaactctgtctcaaaaaaaaaaaaaaaaaaagtgtgaaaaaagtggtttgttatatagatcaccaaaaaattatgaaacattgtcatacaattcaatgctaggttttaaatctctgtaaaatgaataggttaaaattaacaatcttacaatcaggaagaagcagaaaattccgtagaaccacaataataaaatgatgtaaacattataaaattatatgtgttcaagtgcatagaatgagagtacttttgaaggtctaatgttttgggtcagttctacaatcaggaagaaaaaaagacaggcctacctttccttcttcagaagagagtggggacagaggagatttgatgagggtcaagtctaggaaaagcttcacttttgctcattgtatgttgattctctggatacattcccacctgttctttgccctgatgatgagacttttacccagatgtgacaactgctctcttcatctcatctagtcttctggaaaaaaaaaaaaaatatatatatatatatctatatatagatatatatagatatatatatagatatataaaacatgtatattaaatgtatattaatatgtgtatgtatttataacatatgtgtaatttataattatatataatacatatatacatatgtatagtacacataaatatattagattatatatgtataatacatataaatgtatacattttaatatacatgtatattatataaatatacatatacacacgtacacacacacacatatccccaaatacaccaaccaccctcatgtttcttcccagaattccaaccaccagaggcacagcttttttggaaatatcattttaccacagtagcactggatgtctgtccactctgaaatgataaaaattcataatattgactatatgcaaaggaggcagcactgacgtcaattttttctccagaacagagaaagaggaggggactatgttagggcaatgaatttgcgaataatagcatgaaacagtctcttggt

SEQ ID NO: 12884 - DNA, 5015 bp, Human
aaatctcaatacaaaaatgcaataaagagtaataagccgttatataatggccaataaggataacatttctcaatcccagaccaagaacaagtaccactacttgtagaattgctcaacctttcagttctttaacactctgaaaagtagtatttttacaccattgaaagatgatttttaaggaaaaacaaaatcaaatattaagttttttgttggcaaagttataaagtaaatttctgattgtttactttagctttcatgtagttcaggataattgaataaatccctagaagtggaatcatggttcctcagaaatgtaaactctgggaactaagcctatggcaaaatataattcctgcttcattttaataaatgctgaacaaagagaaatagccactcctccctatctgctcttccatgtaaaagaaaagattcatcccattagataaaggtctggaatctccctgatgtcttattgtcccctgcccccacccccatgagctaaggctacttctcttcccaatgtccaaatgtgaggctttgctatcagtgctacacaacagagaaggctcccagatagcagagatagtttgtccaggagaatgttgtgattttcgctttgctggttctgtctcaaaatatgcattgctccttatctcctgggaagtgaatatggagtatccctgatggttcctttgggtctttgtagaatgcatcatttgaatgaaaggggacaaagactgaggagaatacaggatggctaaagggataagtaaatattgtaagagatatttgactaaagtatggactttaggtgtggtggacagagattgaggtggctcccatgatctccacttgcctggtattctcgtacttgtatattcgcctttcctgaatgcaggtgagacctgtgatttgcttctaaccaacagggaatagcaaagattagagatgtcattcccttgatcatgttattaagcctccatctgagcagactggagctagagtttctcctagctggcttgatacagtcagtgaccatgttgagaagctacatggcaaagaactgtgagtgacctctaggtcttgaggggtagcatccagctggcaactagcaaaagggctgggctgctctcacacagaaacaaataaataaattttgccaacacttgaatgtgcttggaagcagatttttccctgtgcaatcttccagatgagaatacagcccagtcaacaacttaattgcaaccttctgaggccctgagcagagaacccaataaagccaggtctggactcctgagtcacagaaactgtgatacataggtattcttttaatttgtaataatttgttatgcagcattagaaaactaacaaaccggccaggcacagtggctcatgaccataatcccagcactttgggaggccaaggcaggcagatcacaaagtcaaaagattgagaccattttggccaacctggtgaaatcccgtctctactgaaaatataaaaattagctgggcgtggtggcatgcgcctgtaatcccagctacttgggaggctgaggcagaagaatcacttgaacctgggaggtggaggttgcagtgagccgagattgggccactgcactccagtctgccgaccgagtgagactccatcacaaaaaaaaaaaaaaagaaagaaaagaaacctaacaaaccagattacaagtggaagtcagaaagaagacttggtgaaatgattatcagtaacagagaggtaaagaaaatgggttggccgggcacggtggctcacgcctgtaatcccagcattttgggaggctgaggtgggtggattaattgaggtcaggagttcgagaccagcctgcccaacatggtgaaacccatctctactgaaaatacgaaaattagctgggcatggtagcgggcacctgtaatctcagctactcaggaggctgaaacaggagaattgcttgaacccgagaggtggaggttgcagtgagatgagattgcaccactgcactccagcctgggcaacagagaaagactctgtctcaataaataaataaataaataaataaataaataaataaataaaataaaagagttaagtgcagagcacagggcaacatgaggaatggatagtgtaagagtttttgcattatttacaaaatgtaaaggactgtatttgtcaatgaaaggtgaagcacactgctgtacagcaatatctttagggtacaaagtaatttcaagttatgctgtactttttagatcctgaaacttttcttcctattaaacatgtatattctttgcttcttaactgtttatccctgtactgcatgtttcattttcacagctttgtttagaatccctacatcaactggcccgttcccacatcttttccttacctggttgaactgcaagaaactctttttttccaacaacataaatagtaagatctgacattgtaaaagtcctcttttataaagaggaagcatataatgaaatagttaaatcttttttaattagaataagctagatgtactttctggtaaccaatcactctatcttactgattctgcctcatcgattcaccatctacttccaaacttcatccaacaacatgttttctttctatgatcacacctcttactttctcacttttattcaattccacatgaactttttgaaagttaacacattcatttcctcaacactgtacccacaatcttactcgctaggccattcattgcaaattagtcttggccataatttaagcagcatagagaacatagtaagtatcgtggcgacttggtactgatggcattggggagccaggggaaacattgtggttgtatgtaatcactcaccattagaaagagcatcttttaggttttggcaggatgttgacatatccatggactacatgccacccttatcacaggccgaccgcggaatttccttcctaccgtttttcctcctgctaccttggtgagaggcacctatctccctaaagctcccctggcagaatgtgaatatactcagatcctctgtcttgatgaacctatttgccgtctacgtttggtagatttgtggattcagataatttcaatgttatgccctggaatcaatcagttggccactggaggtttcaaacctcagtatgtgctgcacatactgatgtggttagatattcttcttaaattctaaaccagtggtattcaagaatgccttagttatggcccatttttgtaaacatacatcatcttccagtgattcaatcatgcaagaacaataatggatattaagagctattgtcactgtgctacatttccaggtggaattcccacaatggactataaaaccacttaaaggtagacagtgtaactctattgtagttcataatggtgaagaattgaaagagtataacaattgtgttcaaaagtctatttcatgaactctttagattaaaaatctatgttcaatccacagacaacaataaagaaaatactgatccagcaattatcaggttgatttagacaatatacttcatggatctttgtaactaaaactaaatactcccttaattttcaaaagcagctatataatacatggcctactacaattacgtcaatgaatggttcaaaatattgctgtatagatactaattaacaaagcagcgaggaagagaagaaggcaagcaaataaacagttggaaacaaaatctttacaagcaccaatggtttaaattatgcttattatcatattattaaaattgtgttcatagtcaattccagctttaagttaccgtatcagtgaaaacactgagatatttacaatgagatatctgcatatatttcaatatttcactatttcaaactaatcacagcacgaagtaatgaaagacattttatgtaaatctattaattttaatgttatagaaatatcattgtaaactagtatattattataatgtattatagtctgagagttatggccatagagttatttttatatactctatttaaaaatattaaaaatatttttaaatctttttattaattaaagactttagttttatcttctggataagtaatatgaagctacaatgttttaaatttttggttcagatttagtgcctatccaagatactgctgaagtacctgtggaagtacaagttgctattgaggaagattcaacttacctaaataagagaaaatcttaaaatagtcaatacgaaacattagaataaataattccagcaaggaaggaataaaagagcctaattagtaataaactgcactttaaacaaaaccttaattattgtaaggcaatatttctttattttatttatttattgagacagggtcttgctctgtcatccaggatagtgtacagttgcccaaacacagctcactgcaccctcgacctcctcggctcagttgatcatcctacctcagcctcctgagtagctgggattacagacaaaagccactgtgcctggccaaggcaatatttcttgactttataaaaggcatgctccctttgttgaatatagagattgtacacccttcatattatttagaaatgtaaataaatctcatgacttaaaaaatcaaagtatttgacaaagtgatattttatttataaaccacacatattttcttccattctccattaaaataagaagcccttggggtgcaccatattccctatctgcatccttacctttgctctataaatgacagcctttaatcacatcaaggaaagattgaatagaattttagagaatagctactgaatctcttggtctccctaccacaagatacccttcttaaattctaaaccggtggtatttgagaatgctttagttatggcctgtttttgtaaacacagatcatcttccaaggaatttaaatgtgtaaaatagtgagagctgaccactcagactgactgataagggagtgagtgtgttccaaattcatttgttgagtcttcctctctgccctccctagcacccactc

SEQ ID NO: 12885 - DNA, 10571 bp, Human
ggagttccagaccagcctggccaacatggtgaaaccccttctctactaaaaatacaaaacttagctgggtgtggtggcgcgggcctgtaatcccagctcttgggaggctgaggcaggtgaatcacttgaacctaggaggcggaggttgcagtgagccaagatcgcgttattgcactccagcctggtgacagagtgagaccctgtccccccacaaaatgaaataaaataaaataaaatgacaacatagaaacagattcatcttctagaacttgcattgctcagtgaaaaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtctaaatgcctttgtttatcggggagaaaagttagtctcgaaagagtatgtatgtatggggtgtctgtgtgtctgtgctggtggggagaggttggtggggagagagagaaagaactggtgaggatatctcaggtaaagtatatgtatttcgagggtgtttctcttgcctgctccctccttcttccctgttgccctgtcggagtcctgggctccctggggccgttgtggtgggatgtatgagcaaaagcaactgccttcagttgcagaaccattctgggcctggctcggcttttggtgcccctagtaggcctacaggtgcttttttgtctgagattcagggcctctcaagctcctgggcttcctcttcttcatgctacctcctctctctgcccctcagcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgttgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttcataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgcggagtctgccaagatgtaaggaggggagaagaggggatggacaagggctgaggtcacatgggcctacatggaggtctgagaaaggccacagcgcaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcctaagaactgaggtttgcctttattcttctcatggctcatgttacagccattcactccagaaagcctggcacgtcatggaccgttcaaggctgtgctccatagagtaatgatgcctccagctatgcgaggctttgggcccacccttcccactgcccctgagggctaaggggagcccttccttctgctcctgcctgctcaccagtgtgcctttattagttcggtggagaaacctcggtaagcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtcccttttgttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgaggcagttggagaaggtcttggggagagcagtgtagtgtagtgatggagtgcacatagtggggccagactgccttggttcaaatctagttctacagcataccaactatatgacccaagtgagtcactccacctctctgtgcctcagctgtctcatgtggaaaatggggacactaataggacttacctcagagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagtagagagggtactgcaagccaccaagaaagaaagaatcccgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggactttctgacactcctgggcatccccatgggtgagctgaattctgcctctggaccagcccttttccaggcgggagcagcctctgagcaggggagctgggggtgggaggacaggaaacatctgccagagtgaaggcctgagctggtcccatccaaccctggccctggtccttggtcctgaggactcaggccccaccgcctaatcctactaacctcctgtgtgcccctcccagctctcccaggataccctgagtgcagggaaatgggagagaccctccctgagaaaccaggtgagtacaggttgtctcagggattcagtgatggctcaccagggctgccggctggactggagccagggagaaggggcttgtgcaagttcagctgggagccagggagggagcagcagtgggaggatggctggggctcaaatcgcttggtcagctctgagtctaactcctgggcctaaagacgacctctctggagatgagaagagaaacaccagtcccagatacagaagagagggctgtgtccgaatttctggtaccaggaatctggtgatatttccagagcaagaaatcagagatactttggtctttctgtggagctttggcagagctggcaaaggatggggttaggggctgtaagactgaggccaatcggacgtgggaggcaggagtctaaggggaaaggaggaggaggcctggaaaccccttgatttgctgaggaatctgcctctgtggagggatggggtggagtggccaggctcagctgtctgtggaacactaggaggaggtttgggcttgagaaaattctgggggactaggggcactagtgggctctactctgtgggcaaaactcagttctgatgcccatgcactcaaggttgactgaattttggcctggttctgccctcatcacacagtggagccctgagcaagtcagtctccctgatggggttcagtctcctcactgaggaaatgagtgggtggccagggtgacctctcaggtcttctagatttgacattctgagaaccaggggccacccaagccctggcccaggtgggagtgtgtaaaggaacttccaggaggatgccaggcaacttccagactgtagttaaagtcagagcacaaaggaaaccagtgctttctctgggggcttccatgacagtaagaacaggcagaaaaaagaggctgtcaaagaccccacctcagatggctggagtatgattcagagcagagccaacagatttaagagcttgagcaaaatatcacttgttcagctgtgcttgcagcaaggtcgcatgtctgctggccaggcccagtggtgataggggcctgtgttcacaccagggccaaaacagatctggaaaaaacaaagtccaagcaactggattatccatcttgttgtgtggttctgtctgcactggcataagcacatttcacaaggcacttttgcagccaggcattggggctgcataaatggttttttaaaaatcctttcccaaaaggcaaagctgggttgctgggattcttgggaaatgtaatagaatgggaattcagaatgcggtttactgcagaatttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttcactctgatgctgaacacccccctcccccacctcttccccaatatctcagatcccaagcctccctggtttgcttctaggaaagctcagcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaagttcacgggaagtcaaacttcagatgagccctgagtggagattgctgacatgtcctgctctgctattctcccaatgtagttaccagaaggatgtgaccttctcagagaagtcatctcaggcagattagaaacatgactggcagtctccttgagggtttggtgagtgcccttggagaggcttcattttcctgggactctacgcagtaacatcgtgcaacatttgttgcactttttatggtaggataaaaagtactcactttttatggtcccacaatcagatttcatacacacttattgttttagtaataagggataataattaaaattactgcgttattaaggacttactttgtgccatatagtttgtgccaaactatatgctttagaatttagagaatttacgattagccttttatatttcctcttttgtgagtttcctgtgtatttattctttgcccatttttgtagatacaatgtatgtccctttatttataaattgcatagtagtaacttatttccttttatttatatgtaaattatttcactacactaataatgtattctttttataaaattaagatacagatagggaaaacaaaaaaattagatcgcccataaatccataaaccagaaataattaatgctaacatttaaggatatcaatccatattcctgtctgtggcagtgtgtatttgtgttttaaaaattggatctaatcccagctactcgagaggctgagacaggagaatcgcttgaacctgggaagcagaggttgcagcgagctgagatcgcaccattgcacttcagcctgggcaacaagagtgaaactctgtctcaaaaaaaaaaaaaaattggatcatatcatatattttacatgttaataaatacactcaggcaaaaatgtatgctcattgtaagcatgtaagcccaaataatacagaaagataaggagtaaaaagtagaagttccattttgtcatcagttccctctatcctcttcccttttctttctttctttttttttttttttaagagatagggttgtagtccaggctggagtgcagtggcaggatcacagctcattgcagcctcaaactcctgggctcaagtggtcttcccacctcagccttcctagtagctgggactaccacacctggctaatttttaagaattttttggccgggcatggtggctcacgcctgtaatcccagcactttgggaggccgaggcgggtggatcatgatgtcaggagatcgagaccatcctggctaacacagtgaaaccccgtctctactaaaaaaaata

SEQ ID NO: 12886 - DNA, 15069 bp, Human
gatgataacactgtcctttcttccttccactgagtatttttagggagtgggccattgggggtatgtgagcatcatgacttagggaattcttactgccccacactcgtcttaagcaggtttgaggatgaattaaagctttgaaatgaagtttccattaaatgaaggtaatggaaacttacctgtctccatcctacacactgcagatctcatgggagaaaaaattatacatcctcctacgttgctaacacctctcaccctacccccaacaggcttcccaatgtctgtaccacaaagttgaaagtcttttggccggacattgaagattgtctacaatctagcttcatccacatttctaacattaccccatcttcctgacaccccacgtatgttcctacctttgtacttgaacttgcactgatttttttgggggggaaagggaggtgggacggagtctcgctctgtcgcccaggctggagtgcggtggcgcgatctgggctcaatgcaagctctgcctcccgggtccacgccattctcctgcctcagcctcctgagtagctgagactacaggggcccgccaccacgcccggcgtgtgtgtgtgtgtgtgtgtgtgtgtgtgtgtgtgtgtgtgtgtgtgtatttttagtagagacagggtttcaccgtgttagccaggatgaacttgcactgatctctttaccaggcttccccttaaccctctgcgcagaaattcggggtttttctttgtgtttgagacaagagtctccctcggtctcccagactggagtgcactggcgcaatcacggctcactgcagcctcaacttccagggcacaagccatccttttgcccagcctcctgtgtagctgggactactcgggagtcccatctactcccgtgcgctgccatcacgcccagctaatctttgtattttttgtagagacagcacctcactatgttgcccaggctggtctccaactcttacgctcaagcgatcctccccctcggcctctcaaaggcgtaagccaccgcggccagccttttttggaacttaaaaaaaaagccataatgtgtcattaggaaccttggtgacatgacagcaaaaccaaaatgtacttatttattaggtgtcacttggaagcgcaattttcaacaacgcaaaactataaaaaaaacccaacgtcggcctccacaggctaatcagtctccgaggcactgacggcgggagagatgaaaacgcgaaggccagaggagaaaaagaggaaggatttgcagagagaacggtaacgtggtggacatgaatacacccaagaaacccggatcccgcgcggcacattgggacgaagcgcgctggcgggcggccagcaactctgggccaggggaaggaggcggacacccagcccgagagccgaaatcggccccagtggacgctttcatcttcgcggcccagaaacactcctatttttcaccgcacaatgcaaacatggtggaccagaaaatccgccccgcgtttgccggtcgaaccacgtggggccctttccgcgccgtcgatgcctagccagggcggggccctcacagaatttgttcacggtgggggcagatcaccggagaacttctccagagcgctacggcacggttccttctacacactggcagaactgccattgccatcgccccgaggcggcagaatggtacgctctgaaaactggatggttctaacgtaagcaagaaaaacggtgcgcgctgcagctctttaactggaacagcctctgctcggtctacctcgcccccaacagctgcgcaacccaccaccgcgcaggcgcgctgcgtgccgccagcgccatgcgaaaccgactttcccgtctcgcgagagtggggccggccgccttcgcagttctcgctccgccccccacttcttgctcgttccctcccatccccccaagccagtagctgtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaagggggtaggttgggctggtggtttcgagagcggagtcgggagaaggacgaaaggccgggaggggctgggttggggggtagtggggtggtcgccgctcggaggccgccgcttggaagcggcggggctgcgcctccccgaccatctcccacttcagggagggcggcttgccgatgggaggacttgctcaggtggaattcagtggacgacgccgaggcccgaagtaggggacatccagcattttcccctttccctgctggcttggcctccgccattttgggtacagtggcgcggccacctcggcttcccgcccttccccgctctttttacttttttgttccccagcttccgaaaactgatctagaaggccaggggagggggtggtcaaagctccctggaagggatgagggtgggtagtgaagcgagcagggaaaggccgggcagttgggtggagggaggatcgggtttgccgggcgcgctcccgatggaaatggcgccggatgggcctggcctcccaccgcggcctcccttcctccgcagtctcggcagggctacctgggctgacgggactgcgagtgacttctgacgcagattcccaagatgagagaggctggagctgggggaggaaagccaatggcgacgaaggtgctcaactcccaaatccaggacaaaggaggcagacggcctcctttgtaattctgccgcccggtggcgaagggttttaagccaggcttggctgctgacgggagggggaaggggcgtactctccctagctttctggtctctagggcagctagataaacggaaagtctcctgggaggaataaaggacgcttagccggcccttatattccagatttggaacttcgaaaagagtacgtactgattttccaaagggttttttttttttcatgtttaaacgttaataaggacttcggggatgattttgtgagcagaaaagtgggtgatttatcaaataggaatgtgaaatgggcatgtttcaagtaggtcgtctgggcccagtgaactataattgttgctttttgaactttgggggtgggggtgggtgatgtagcaattgttttgcgtagtttggcgtatatatgttagaatttgtttttaagttttacttttgggaaacagttaaaacaacccagtgatggtagatgtgtgtgtattgaaattgagctttcgatgttaaatcttccaagagttgtattttgtgcagttttttttccgatggcattaaggctctagaagtaaaatacttcaaaatacggttatggtttattttcttttggtagctaggcatgttttttctttagtgtaggagtatagtacactgtaatcgtattttaaacaagggaataagcctactaaacataaaaacaaattgtaaacccagtcacgtggtggtggtgtgattcggatgagggtcctgagaactggatccgtaattttcattgaagacagtacaaaagggaggagaaaggcctgagagtaagaatttctgataattcatgtaaaactttataagaatattgttacctacttttccagctctaaaaacaaaaacttattattattgaagatgttcagtgatgctttctcaagattgccaaggaaaagtttacgaaaatcttaccttgaaacagtaggtttgagtgaccctttgaagagatagtccagactgtcctgtaaagttatatatgatataacaaatagctttactaattggattggactacacatcttttttctgtcctcttttcatttgtgccgttatctggaaatccatctaattgcctttttaaaataatgttatctttgatttccttgttttggtaaactgactgaactgcagtagataaaaacctggttctagtgaactaacattttagagaccttacctccttaagctattaggggtgtgtctagttttttgtttttgtaaagagcaagcccattgggaaggaatgatgtaaattttctgttaaacttaaatcatcagcactttttccaaaaaataaaattcattctcatttcttgaccactgggctaccatttagaaagttatttattgatgtaaaatcctttatgtattacttcagaagataggctatgcctccgtgttaagaggattctctatttcatttgttctttagtggattttttttctttaacgactttggtatataattcacataccgtaaacttcaccaattttaaatgtacagtttagtggattttagtacattcacagcgttgtgtgaccgtcactacaatttaattttagaacatttttgtcactccaaaaagatatccataccctttactggtcattcccattgctggcatcctccctcccctcaagcctcagacaatcatgaatagaaatggaatcatgcaatatgtagtcttttgtgactggcttgtttcacttggtgtaatgtttagaaaattatacttaaagtctcataaaacttgaccaaagctatcctcatattttaactgtggtatcttttattggtactagcacctagaattcttaaagcagagtagtgattagccatgacattgttgcaaagaaaggttgaggtggattatcctgaataattagtaaactgttttaagtagtttctgacagctttattagagcagattgcttcttcctgtgcccttagagtttttcttgtttttgttttgtaggtaggatttttagttttgaaggggttggtagagtgaggctgtttttattgtatgtgctttgcatacacagtcaccctataaaatagattaagtgttccgagttcggttgggttttccgcaattaaaaattgtgttaacagtttagtgtttcttacagataacactgataacactttttttgttttcattgggtcttatcattggtacagactgatccaaaaatccaattggcttgctagtaattttttcctgtgaattgctaagatttatgggtaaattaatttttctttttcttttctttttttttttttttaagcatttgctccttaaatgcaaatcgtaccactaagatcctctcacaacagattaaggtcgaatttgcagagttcttcaatttttcatgaagcagtgagggtagatctgtaccactttttccgttctgtgtaaatcaccgtttatgggaaacacttgttttttaggttggtgctatttaaaaaaaataaataaaacggtaggcattttcaaaacatctctgaactttttttttttcccaaactggattggggccgcctcctctcagagctactctttagaatagtattaaacttataaaagcctttgctggctttgggaaataaaatttttaataattctcagttcttttcaaggcttgaattgttttctgtccttcagggttcacatattttgtgtatggtatagctcactggcttttgcagggccccttaaaatccagtaacaattgccatcagtaaatgcttaccatgaggcagaccaagcacttgaatagtccagtgaggtacaggtacaactgctatagtttacaattgaagaggctcagaggtaaagtggttcaggtagccagtgagtggcagagtagggattcagacccagaacattcataatatttatttgtgtgcataacaagtagttgtaatgtcagttaaaagtttgtattcccattttggttttctatgtctagagtggcacctagggctgaaggtgattgacactagaggtacttaactacttccagagaatttctacattagcttattttaagtgcatgaattctagggaaaaatattttaccctttgcagatgccacccctaagagatgcaccaacaaatagatgacatgaaattaagcattagtgaatgctgttgatacgaaatatgatcttcaaacataaaggaatcaaatgaacaaactttgtttacaggggaggaggtggtgagggaaaggtttgaaatactcaggtgagtaggattcctacagctgcatagtgagatttgtaaggttctggtaagtttctgcagctgaaggacttctgcattcacctcttttgtaaatattatggaattttaaaaggaaggatggttgcctctggggaagggaactgggaactgaggttattttggaggggaaggggggcttctagatgtaccttttatgctttattaaaaagtatattacctattaaagtttgtttaaatctatttgattaaaaatttgagtaaactggtttctaaacactgtctccagtggcttcaaaaacacaggtactgttggaaggcattcacttttgagtggcctttgacctcagttttaatctgattaattcagtcattttataatcttgctcttggtgagtttaaactagatttggctaaaatagaggtgggagtgttggcccttcaaagacagtttgatgtgttcaaaattgtagtgcatttaaaagggttagacttctgtgatatttgtccaacgtcaatcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtaaaataaatattaaagacatttttattcataggtaaattttagtatttgctttgcaagctcttagtggtaatataggaaacttgtataaagttaattcagacaaatttcagtgcattcctatatagagctttataccttgtatagtatgtatgtatacttccctacttgtatctgtaatagtttataatcttggcaaattgtgttttccaggtatgggaggacatggctatggtggagctggtgatgcaagttcaggttttcatggtggtcatttcgtacatatgagagggttgccttttcgtgcaactgaaaatgacattgctaatgtgagtaatttttaataactattagtggttttatacttatcctggtgtctaaatctttaagcattcttaatgttctcatgtttatagcttaataccaaaatcccttgaatataaaaatagatctacctttaattctttttttgagatggagtcttgctctgtcccccaggctgagtgcagtggtgtgatctcggctcactgcaagctctgcctcccaggttcacgccattgtcctgcctcagcctcccgagtagctggaactataggtgcccgccaccacgcctggctaattagatctacctttaattctaatcactgatggatatttttgtatccattgtgtgtcaacctacataggattcaaacaagtaaaaagctacattcgtgaagtccagttaagagtataatgaaagactgatcagcatagaatggtgatgactataccattttgtgctggtgtcttttgttgtaccgttttttgttttgttttcttttttgagacagagtcttgctctgtcgcccaggctagagtgcagtggcgcgatctcggctcactgcaacctccacctcccgggttcaagttattcttctgcctcagcctcctgaatagctgggattacaggggcacaccccaccactcctggctaactttttgtatttttagtagagatggggtttcaccatgttgatcgggctggtcctgacctcatgatccgcctgccctggcctcccaaagtgctgggattacaggcgtgagccactgcgcctgacctgtattagggtttgaaagagtgaatatataaatattagtgatttggtttggctttctaggctagatagtgattagaaactgaggagttggaaataacaggaatagatgctgctgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttgaaagcaatggtgtgctctagatcttactgggaatcagctggcctgagttccaactgcttttaatgatagtttaaaacctggctaacttgtgattagaaccaaatgatatcttttggggaacaatttcatatagtcttaaataggtggctttattcaaaccgcatagttccaaatcatgatatcccgtatttctctctgtgtgtttgtgtgctttttttttttgacagagtctcccactctgtctctctgaggctggagtgcagtggcgtgatctctgcttactgcagctcccacctcctgcgttcaagcgattctctgtctcagccttctgagtagctgggattacaggcgtgagccactgcgccctgcctatctgcttattttaaaagcagtaaattctttacattatccctaagtgtatactctgatattcacagaacctctgtagttgactaagttattagtctgacagggcagtggaagggtttgttttaattgatgaggaaaaatcaaggtatgtggtaatttactttaatattctcaatagaaaagtaaataagtgtttccttttatttagttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagtatggcgtctgtcctagaatgctttgtgtcagttactaattctaaaatcaaattggtagaaggtggtactacatacgatgtctatgatttaggagagggagccggggcagcctatatatgtggagcctcttgactgaagctatgattcatcttaatgcttgtatccacttcctttaatgagcaatttaaatattagggcatacaccacctgtcttttttgaaagttgtatgtgttttattttcccaggattactctcttaacatcttaaagcagtaaaagtatacagtattaatgaaaccaaaattgcccttttaaagcaggctaattttccaaatatttatttagttcataaaattcacattttattttttaaacattataggttagaagaattacaattgtaattccctggcaccatgatagcattattgtggtagtactgctaggtgagggaatggtatgttaagtctgtttttgaaaagtaaaatgaatacgagttcacaatcacgaaatacagattgttaaaagtcttgtaacagaaaaatccaaagttagtatagtttttaaataagccaaaactacatggagcaagttgctgtcataaaagctgccttaaaaaaaaaaaaaaaaaaaaaaaagcaagtaagtcagtgttgatacatgagttttgaaaagtgagaaacttacttaaaggatgacaaaatcatggtttgttgaatgaaattagccttggaatttaagcaacttaagtcacattttaaaatttgttctaagcacagtaataaaaaagcatatttgaaaatttcattttttgtttattcagtaatcataaaaatgttagcccatcccacctatcaatacaaaatggttcaagaatataatcctctcttgaggacatttctgtcagtattcaagaaagaccatctagaaatctgtgtcacatctgacacctcaaaagctgactggaaatttacgggttttggaaaaaatagatcttcaagtaaaatattcatttcatacttaggctattcagaaaaatttaaatttcatggaagcatatattcatgaagaaaagatcctgcagtattaataagaactcctttgtaggcagggaggtacctaggattaaccactaaatataatgctcttaatccataaattttctatgtattttttataggctcacaaacttaaagtgcatggttaaaaattaatgtaaaaaataggatactgaatggtgatagtgtttatgtaactattcagaggtaatttatacaagttaaattcttagtatgccataagcaatataacttggattagtgttcattgagtcagcttgaaataggtcaagtgtactggccaggtgctgtggctcacgcctgtaatcccagctacttgggaggctgaggcaggagaattgcttgaacccaggaggtggagatcgtgccattgcactccagcctaggcaacaagagtgaaactccatctcgaaaaaaaaagaaataggtcaagtgtatatttcatcatctcaacacccttggcatagaggtgctcaatggacatggtgaaattttactgtggatgtatacaggtaggccactacaatgtgatacttcctaaaatttactccaatgaaaatgttaatacaaaattttttgaactgaactctaatacattaccaaagcaaagtcctgatttttttctcacttttaatgcttagaggagaggacctttataaggagcctgtaacatcccctactattacatacttttttttctggggaaggatttgtgttttcatctttgaattggggtctgagtcaccccttaaaaaaacagcaatttagtgaaacagcatatgggaagatttataaatcaggaaaagaaagatggttatatgtaacttcctttcaagattaaaaggaaaaaagtagaggccgaggccaaataatgccccctttaatttaatccactgtagctgaaaatcttcagca

SEQ ID NO: 12887 - DNA, 20537 bp, Human
cagctactcgggaggctgaggcaggaaaatcacttgaacccaggaggcagaggttgcagtgagccaagactgtaccattgcactgcaacaagagcaaaactccatcaaggaaggaaggaaggagagagagagagaaagaaaggaggaaaggaaggaaggaaagaaggaaggaaggaagggagggagggagggaaaaaagaggggagagaaagtccctctgctcaatttggcaccaagcctgccttgcctagacagaggtttcaaagccatggttagagagacatgttggggtttaggacacatgatgtttattaggggggtggagctctagaaaccaaatgaaataggatgtctcagaccctcaaatgccagcagcagttgtcatggagattttaaacgcctatgttgggaacttagctcaaaaagagggctacttcttggttcctgccaatgtttttctgttttgtgggcaaaaagggatatgagaaagttgtccagagcagtttcctggccctgttactgtggtgcttaacttcctggtcatgaaggctatgagaatactgaagttttctgttctcaaggagaagagtgcatggcaaggggagggaagcatgcctactgaggccaacaccatgggccagcaatcaaatcagcacagaagacagtatgtttatcttatgcaagcatggatcttgtagcccactttcctttgaatgaaggaatgggaaagaatggcccagttgatgatgaaaaaaaggtgcacttatggaatgccatttagaatgacttaacctgtcgcttttggggaactttgagtggaggagtggtggcctctcaaggtacacatgtacactctcgtctcttctgactaagagtacacatttaggactttggcacttttagaaaccacttgaaattcaccctagtatgaagtcatgagtaagtaaagaacctcatgctacctttctctttgagtaggataagccccatttatgaattactttagccccttcattaaaattcctctttgtagaagacaacctttctgcatacttaactctgtcttattttgtatagctctttagaatggtttgatggaccttagctcctttaaccctcccaagagctatatacaataggtgaagaacattctatccctttttcttagattaagtaaccgaggccagaaaagataaagtgatccatcccagattgtagattgaaagggtaagagccaggcttggtgaacagccatcccacttcaatgctagctctactgctatatgcatctgtattccaagaactattatctgagtaatgtttccctatctgtgcacctttgtgcaccaaaatatgtctacattctgggttattctcccctcccattctgcctaagacagaagctatggcaggtattggtcctcagaggtactgaggccactgttggcaaagagaaacaatgtttcagctttttcagttataaaataaagatgacaatctctataatgcttacctcacatggatgttgtgtagatcaaataataatagatgtgaaagtactttctaaattgttatgatctgttcacacatgagggattgtgattattctttaccccctgggcagaagccaactccttgtcttattactctctttacaaattcagctcctggtatagccactgactgtgaatttgagcaaattgcttggtctctttgcctcagtttcttcatctgtaaaatgttgctaacaataattcttaatatgattgtcttgagaatggaatgagttactacatgcaaagcatttacaagaactcatggcacatggtcagagctacataagcattaactcttttgtgttggcttcctcgtccctactatctcagatctagagaatagattaaggggacccagaagccaagtggcatggaagccactacttatagtcccttcccactagcttgctagttcttgtgttctctacccacagccttcccaccatggattgccaagaaaatgagtactgggaccaatggggacggtgtgtcacctgccaacggtgtggtcctggacaggagctatccaaggtaagttatcctattcagtacacttatttctgttgcatcttaggaaccagcccggcaactgaaagaggccaagattaggggagtcagccctacttatgactgatccagttcagcgggtaaaacctgggatccacagagtatgcaatagcagtcatgattccagcatgaagtcagcctagcaggatcaaggtcaagggaagtttccatgagataacagagtatttcaagaatagatgtgtaatgcagagacccatgaggactgttcagcattagggtaatctgtcatctaaagcaaggcccaaccacatggtgttcaagagccagatatcaggtcttaggaatgagaaagagagaagagccaagaagacctctgttctagagggtctgcgctactgaggaagctgtgcaatggagaatatagggatagggaaccacggagggtctaaaatcccaattaaagataaggatcagaataaaatgaccagcaaggcagagactttatgtaacttacttgtttcaagcctggatctgcttaattgttctttcctcaggtcccttgtaggtccctgaacttgggggtggtattaaattttggctgcagctggggctacagaggccagaagcaagcagctagcagatggtttctgcatattcacactctattttatgcaatttttgtttattcagcagttgcttattgaacacttgcagagtggcaggcatggttgtagacaccatggatatggcagaacaaacaaaaatatttgccttcatggaccttaccttctattattagtgaaaaaataataattgagacacatacagagataaatgaagaatctggatatgaagatatgagaagaatcaaattagggtgactgggtggctacttcagattatgaaacaaggaaaggtctccctaaggagacagcctctggggagaggatactagtgcagagtcccaaggtgaaaatgaactaggcattttgaaggaaaaggaggaaggtagtgcaatgggtgtatggtgaatgagagggagggtagtacacaaagaggtcagagagagaagtatagaccagaccagatagcagcttgaggtctatgagaaattttcatctttctctaagtgcattaggagctctttggagggttttgggttggaaagttataggaatctgtggctggaaaacaacataataattatctagcccactttattcctacctttgtattttaaaaaatgaagagaataaggcgcagggatatcaagagatacaagcactaattctaagtttttacacatggcattatgtcccacagtggggtacccacatggttgataaaggatcccagtaccaaggaaagatcgccagaggtaaggtcatgctggacattaaaatagatattaaagcttatatatgtgtaatacatataagctttagagccagatacacatgggcatgagtcccatctttgctctgggcaaattatttcacctcagaatcaattaggatgtagtaagttgaaagtaacataaaatttaaccatgacatgaaccataagtatatttatttatgtaatgaagtctggagacaggcaacctttttgcttgttgggcagatcagcaatgttatcaaggactcagcctcttttcatccttcatattggacatcttgctgttttgttctcattgtggcctcatgattgcaaaactcaaagcatcatatctccatacaatagtcaaagtcaggaatcaggggcaaggtcaaaatagcttgccttttgtagggaagaagtcttttcccagaagctgtccaacagatttttccttatatcttatggtccagaactgggtgatgtagctatctttagctggaatagagactgggaaataagtatctggccaatgagaatgggattgtgtgattaagaccaatcaagaatccgttctggaggctagtcttcatgccacctagaatgaaatcagtgtttttatagtaaggaagaagaggggcaattgtttgaataagcagctagaagcatctgatagccttttttaaagtaacttttatttacttttaaattttactcatgaattataaacatcactgtaaataaatcattgcagaaaattaacaccatttcctcaggacatttttcttgatgtataattgccaagctaaataatgcgtacgattttaagactcttgaaatatatcagcagataacacttctgaattttgtttatactaatttctattaccattacatttattttcaacagtgcatagaattcctgttgtggccctctgttcggggtccctgacttcccacaacaaattcccatgtcccagaagcctaaacgcaaatgaataatagatattttcatgatctattaattttatgccttccttttaacagtaattactaatttatgaggactttatgagaattttggttttactttttatctatttgataggggaaatgtaccaactttactgtgtttatttgcccatttgcctttccaattttgtgatctatttctgattgtttctctttctattctttctattcattatgtattgttctttgtctactcacataaggaacctaagtagacagacatatagtagataacagagtattttaaaaatcgtttaaaatgtaagtatatttgtatttaaaaaccagaaatgcttttaaattttgtttcattttagtatcatctgttgatttgtaaatatattttccctttgatgtattaatttgatgacatgtattaataaattcctaaaatttaaatatcctgcattcccagtataaaccattcttgattatagttttaaggtaaatacccttttatgttgtataagttagtattttaactaaaacaaataattattattgtaacactatcagcatcaaaattttggatcagcattgtgctaccatggcaaaatcaagaatatcaatgttttctggctataaaagtggttaatagcaaaagaaattttgcaccttaatgatttgaaagaacttcctttgcctcctaattatgaaggagaattctcaataaatttttaatgataatttgctccttaatttattaaaaattattcatttatttaatttttattgagtacaatttgatagtctttggttttatttcactatgccaatccctgtcttttaattggcttacttagaacatttatgtttaaataatctttgatattttaagatttaaacctaacattttattctttttgtgtttgttttctctgtttcttttgtccctctatttgtcttttcttgccttcctgtgggttccatgaacattttatttaggattccatcatgatttatttgtagtgtttttgagtgtgtctctttgtatcatttttttagaggtggttctgagtattacatgaaaaactaacacgttactttttcaatgtcagctggtatcaacattttgccatttcaagtgaagtattgaaatatctgttccatttagattcctttactttccccacttttaaatatcattgtcacgaatatcagatataatttttgttaaatttgttttagtcatctactatgatttataaaatgtatgaagagaaagatagtacattttatacaaccatattttttctttcccagtgttccttccttcctgatgctccaagatttcttcttttatcacttccactctttcttaaatcatttcatttgtgttttatgaactctctttagaattatttaagggtaggcctactagcaactcattctgttagttttcctttgcctgagaatgtttttatgtcccttcatttctggggatactttcactggatataaatttgcagttgacagtttttttatttcagtacttgaaaaatgtaatacttccttcttggcttccatggcttctgacagaaacccactgtcgtatcatttgaatgggtgtttttctataggtaatgccatttattcttggctattttcaatatattttttttagttttcagaagttttattatgatgtgtattggtgtgcattactttggatttttttctgtttgggatctgttcatcctctttaacttgtaggtcttttaccaaatttgtgaagttttcttccaatttgtttgaaaatatttttagataaacatttaaaaaattttcttttcataagattctgacaatatgatttttctatattttgttatagtctcataggttcttgaggctttgttcattttattttgtcattttctccctgttgttcatattgcataaattctgttgttctgtcctcaagttcactgattctatcatctgtctcttctctactactaagcccatccagtgaatttttaaaatttctgtcattttatttttaataattaccatctgtttatttaaaaaaaacttctgtttctttgatgagattttctatttttaagagaattttaaattgttttttaaaacatttttattatgggtgctttagaatccttgttcaatcattccaacatctgctttatctaagagttgctgtcagttaattgacttttctcattcatgttgtgattttccttattcttattatcatgggtggtttttcgttgtgttctggacattttgtcaattatgtcaggagactcagggtcctatttaaacttttactttagcaggcagtcatctgtttatgtttagcatacaggttttggcctacgtttgtgagctgcagttctaaaggctatttaatttccagaacctttgtagtgtgatttttggtctgcggggtttatcttgtgctgcctcaggtatagacgatttcctgggccaggtcacttggtccatttaggtcggcataaagaagtgtctgagttgtagagtcaaagaacatttcccatgctcgaccacttgttattagtaggataccacttgccagtataccccagccacctgttcctatgtgggggaaaataatctcagacccacaggacaaagaagcatttgagctggttacttatggtggaatctcaagtgccccctgcagcctattgtctctagttgtgtgtggggaatcgcaggcccatggggaagaggcttctcaggccaacaatttgtgcctcaattttgcttatttgtgaaacatggattatattgcacccttataaggttttatgatgaataaacaagtatataaattcatgagtgtgtggatttttgtctgattgattcaattatttagtcacaatattcagaatagcatcctcatgcattgtagttgcttcaaaaatgttttctgagttaaccaataaaatgaaagggagtgctaaccaattaatcaatcaatcaatcactcaacttattggttaactttcaataaatgctagcttgcttttgtcattcccttctctagcaagtgagtaagtgaggagtcaggcacatatcttctgattccagtgctatagatagaataaaaacttgctttccagaagaacaatacctaatgttcatctgttcattgaaggattactatgttctaggcatggtgacaagcactacacacaacccacacacagagctatatatgtatctgtgtgtgtgtgtgtgtgtgtgtgtgtgtgtgtgtgtgtgtgtttgtgtatctggttaagagacatcctttatctaaataagagctgtttgtgtttctttttctgtgaatatatgtttagtttctcataaggtggttgtcgttaatttatactagttctgtgttatcggaatataaatctttagtctgtgatatggtgtacatctttttactagttcattatttgtcttctaattttgcttatgaatcttttaccctgaaactttttaaaatttttatgtaattatatctatctttcctttactgcttctggacttcgtgttgcagttagagaaaatttctccactcccagattaaagaggaatttatttatattttgttttggtactttttggttttaatttttatctataaatttctgatctattttggtgtatagtgtgaggaatgtatcaaattttatcatttttcacattgtcattcggttatccaacataacctatttaaaaagccagctattctccattgctttgggatattccttttgttcatttggtcagctcatgtaatcttaacaaatctataagttggatagcattatttccaattggattgacaagaaaattcaggcccaatgacttgcccaaggtcacatcgctggtcagtagtaaaagtgggagttaaagataggtcttcattaccttggatcagggattttcatcactacattatatttcctaataatttgacccccagctcactgttttaagcagatatggaagctatcaccattccagtggtgcacataaggtagcagagattccaagaaaccctttaacttttcaagaaacttagagcatgagtaaaatgactactgcccatgtcagatcccattggtagatgggatcattgtgagtgaggctgcaaggcattgagtaaagcctgagtgggcaaacatggggcagaatggaaggagtatttcgagcctgcctgatgctcactttttccaactcctgggaaagtataacttaaatgttagttcaggtaatattaactgctgtaacaaatactaaagtttggtgacataagaggttaagggtttattcctgaatgtgactccaatccatgttggggagtaggaagattcttctcagccattcaggaagccaggcttatgggagctctgtgttttttaagcagccttattaaaatacagttcacataccagtcaattcacccatttaggtttacaattcatggtttttggtatactgcattatgatttttaagattgtggtaaaatatgtaatctcaaatttgctgtattagacattgtaagtgtataattcagcagcattaatcacattcacaatgttatgcaaccgtcacccctttatttctaagactttttattaccccaaatacagtctctgtatgccttaagcaataactcccaatttccccctccccaaagtgcctgatagcctctactctctgtctctacaaattttgctattctagatatttcatgtaagtggaatcatattttttcatgcagtcacctttaccagagatatttactctttgcatggctttgggttactctccattgtctgttcatttcagcctgaaggactctcttcttgtagtcaggtcaaatgatatcaatcagctgttgtttgtctagggatgttttaattattcctttatttttgaagaacttttttctgtatatagagttcttggttaacagtttatttgtttaggcacttatatgtcatctcactgactttaagtctctgcactttgtgatgagaaatatgctttgaatcttatcgagaatacctttacttgacaagtaatttcactcttgattttcaatattttctctttgttttcagctataaacattttttgatagtgtatctcagcataggtctctttatgtttactctgcttggagtttcttgagcatcttggatgggttaatttatgtctttcatcagatttgagaagttttaagccattatttcttcaaatattcattctcgtcccccatctccctgttttttctgtgaatcccataatgcatatattggtcacctgcatgatgttccacaagttccttatgttctgtttactttcttctcctcagacttgataatttaaattgtcctacattcaggtttgctcattctttcttttacctactcaaattctctagtgaagttttcatttcatttatcttactttttagctccagtattcatgtttggttccattttacaatttttcttaaccaatattctcactttgtttatacatttgtttcctgatttcttttagttctttgtccatgtgtgtctttgagcaaatttaagacagttcttttagtctttgtctactaagtgcaatgtctgggcttcctcaagaatagtctcaattctttctttttcttgttcctttgaatgggccacacttgcctgtttctttttacactgtgtgatttatttttttgttgttaaaaactgggcagttttgtattgtaatgaagtaactctggtagtcagatttcccctcttcctgttttacttttggttttggttttgtttgtttgttttctagatttgtgttgttgaaggctatagtagtccatctgttgttgttattattatcattattgttattattattattttgtttgggactgggtattgctctgtcaccccaactggagtgtagtgtcatggttattgctgacttcagcctccacttcccgggctctagcgatcctcccatctcagccacctgagtagctgggaccacaggtgcatgccaccattcccaactaatttttgtatttttggcaacaaggctttgccgtgttgcctaggctagcactccatttgtttaggtgtttttccaaactatttttgtagagactattttttgtcatgtatcgccattgaaacctatgttaatttagctcatgttcagctaatgtttggacagcaatttcattgaatgctaaaagttaaaaaatgacaacaacaaccaaaagaaaaaatagtcacacattactctcacatttttagattggctctgtgctggggaactacttaaacagttagccagatgtgcacttagcttagggatcagcctgacatgtaagctttaggtctccactagtattttctgagcatgtgtcttgtatgcacacacctttctaaattcctccatgtggatacttttgaatgtacttatttctaaaggaacctcccccagcttttgctcccagattcagacagtctgttttatgtcttaatccataatcattgccctaggtattgtggtttgttagtttgccttgcaacattttgaaacagtgcccatcacttttccaatctgcattctcaatcgagtggaacatacataaataccttgtatcagtccttcaaatagccctcaaataggttaggacagacatacacagtaatttgtcaataagttttgcttagctcactctggaatcaggtactgaggtctcacactaggaatacaggctgaggctactttaagacttccactactttaggactgccactgctctggggtgagggatgtaacaagtacaagtaaaaatagcagaaaactttcctattattttcaagtgacctttttcttgatttaacatttacatggttgatgtaagcctttgaatgttttccagagttctgacaacattgattatgacagttcctgcttgtttttctatgtttctgtaggggcataagagcttgaagctgcctactcctccattttatctggcttccgctatcattcttaatatatttattccaaggtttccaggggtgtcagcatgcactggaaaatgaatgtatgaagaaaatttaagtatcacacaggacatgtttttgagtcaagcctgggaatggcaaacaatattagtatccatatttcattggctagaaatgatgcacatgcccccacttcattgcagtggggttaaagaattttggctaatggtgttcccaggagaaataaagaataggttaagtgaacaaccagccagcttctgctacaactagcatacaattaatatgctttcacaactagaattgtttctttgagaaagagctgtgactggtatcaggcaggagccttgttcctgttgaagttaggctgtcagatctaagaatctctagagagcatttatttcaatttcctcagtgttgggacttctgatgcccagaaactgggggtcggggggaaggaatatggccaaagttagtaccagagctgagacaagagccagctagagtgtttgcctctcatctataccattggcattcaaacattttttaccatgacctagagtaagaaataactttttatcacaacccaatatatactttcatgcattttatctgtaaaacttttataaaacagtacttatgtgggtagtgcttatgactatttgtcaaatatttcagctccccacattctgtcacattgtagaattgcattttcttgtacctgttgtagttattaatgatcatgtgatgtgtatggccaaggacatgtgagtaaagcaatatgggtcatttcttggggaaaactttaagagcttgtacgcagttcacaatgtttcaatcataaaagcagaaaaataaagcttctgtaaccccgggtaccccattgaggatgatgtacagcagagtcctcaggaaccccctggtaggcaaatatgatgagtgagaaataaacttttattcttttaagacactgagatttagggtttgacttttgccatactgcagcatagcctatgctgactgatacaaatacttagctttacttcattccatgtactcttatatttgatactattattctatttcattctattttatctttcaatgctggctggaagctagtgaattggttttatgacttagtaatggggttgcaagttgcaaaatactaccctgtacagtccacttgtcccacaggtgatcccatctccaagctcctataaagcaatattaacaacccccatctgtctacaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggtgagcttgctttatgagaccaagcttgtctgggcttttctagctgttggaggtttctcccatcctcacctctcagaacttagtcgaaatattcttcttataaacataatattcagtttaagctcccagaagagagaagtggtgtcttcccaagatacctctataaagtgcttagcacattgtcagtcacagatgagtacttgaccgcttttccatcatcactctcagctgaagaccaaagttcaaggtaaatctcactgtagacttaaaagaagttatgatgtacttggtatcaaagcagtgcacccctctcttgtggaattaggtctccttttggctacatggtgtcatgaatgggggaagaagtagagtgtctgggtctctgagtcagaaaaagacacagaggcagataactcagaaagaggggtgggcacttactttcaggttggcaagattcttaggagctgctttcccaggaagaactggtccaagtgcattgcttgtttgatcaccctgccattcctaattgctctgaacacaggttctaccgaaagacacgcattggaggcctgcaggaccaagagtgcatcccgtgcacgaagcagacccccacctctgaggttcaatgtgtgtacccagttctcttcttccctttctcctcatcccattgggtggcagcaagatagggtagtaaagactacccatatcccctcataccttttcatgtagagtagagtggcaagggaatcagattagaagtctggttttacaacatattatctttgcaactctatgcaaatcattcaatctcattgaacctcatttcctacttctgaaaaaagggtgagtcatgataatcatttttcttcataccttgtgtgatgggtatctaggtctaatgagaaaatggatgttaggaagcacttcacaaattataatatttgtaaacctatgagatattattattatatgaagtatataggagcccctagggctgaggacttgtaagaggctgaatgaagaactagggtccaatctatgcctataccactatccatttatctaatcgtctatcttttttgtctaccatctatttacttacttcctattttaaaattattgacatattttttaaatcatgaaagttttcaaacatgtagaaatatttttaagtgcagaaaaatataaaattaaaatgcaatcacccagcatctatccaaagttaataaatcatagcattttgcatatttgcttcagatgttttaaaagaataaagattccacagatataatggaattctcttctagattctctcagagtcctattacctccctacctcctcagatacaaccactatcctgaaattgtatgtattctgttggtaggctatgctaaagtaacaaacaaactgcaaaatctcagtgactttatacaataaaagtttattttttttttactatgcaaaggccttcctacatcatttgactgtgcattctagaccatatgtcttccaggtcaatgacacaggggaagagatggaggagacatactggttcttaactgcctcagtctggaagtgacacatgttatttcaactcacagttcattggccagaagtactctgatggccttactgcaagggtgtaagggaaatacatgggagtatgtggataactggtgagcactatacctctgccatactctccactaatgttttaatacttgggttcttttgtgatatgtgtgcatattcataaccaatatatgctattgttatgtattgtataatgttttatagaaatgatatcaagctatatgttctgtttctccaacttcctttttccccctctagattatttatattgatccataaaggcctttaagtgctgtataataatgtaagattttaggattatatcatgatttgtttatcttgtgctctactgatgaattttttagcttgtttccattgatctggattatataattagatgtggcacagaaagatcacaggatatgtgcatcttcgattaattgtactaatttctacataccagcactatatacaaattattttgccttgttctttataattttgcctgctctagaaagaagtaaaaccagcatagccaccctaattggggaaggccctagggagaagggtgacagcctgaggaagtccaggtccagggtcagggtgactgtttactgcccatgctaactgacctcccccatttttttgtctcacaggtgccttccagttgagcttagtggaggcagatgcacccacagtgccccctcaggaggccacacttgttgcactggtgagcagcctgctagtggtgtttaccctggccttcctggggctcttcttcctctactgcaagcagttcttcaacagacattgccagcgtggtaagggtggctgtttcatgtttcacatgaatcaggaacaaggctcttattggcagaagagagggatgttctggggttgagagacaatgggccttttctaccatgcttgaaaaccccatgaatagtcttctgttggcctggggaactatctggggctgcaatggaaagcatgggacttaagagattactgaagccaaccctgagagtttagaagacctggttcattatgtttcaggggattttaaaggaatgtggcacggtgggaaacccctcaggaaaggaatcgggagacctaggttctatgtctacctctaaatcaccgtgtaaccttagacaagtcatctagcctcttcagacctctttcttcctaatctttaagataagagataggattggatttgttgatttctgggttcttttccaattctttatatctatactagtaggtataaattctagagcatgtcatgaattgaggaaggcttggctatatctgagatacgactgtaataaaagtggttgaggtctaaggccactgctatcagtataataacttcacaaatggggataactgaaagccctatgtccagagtagttggcaaacctggactttctccctcagataatactgatgtcaagaggtctagcccagtccatatcagacagccatgcaaaattccagatggaaaatcatatttaaagtcacagtaacattgtgatctctattaagcacaacttcagctactagacaagaatgtgggacagaaaagccagctcactgaggacaaagatgggggaggtgggaatgtggctgatcaggaccaggcaaagagttagaactccagccaagagtaccaaggttcagtgcagcttcattgccattaagggaactgagagttaggcagggacactgaaacaggaactcagatcagagaatgaagttgatttataagggggaagataaagtttactagataaaagagtgctcaggactccttttcagcccactggatactgtgtgcaaagctgcagtatttgtgtgggaagatcctgctaatgtaaatttgccttgggtcagtttggctctggggcctagcagatgatcttgaaaagcccaagaggtatgtttggttgtgccctggcttaattggagatgaatatagcatttcatgggctgcaggatacacggggaacactgttgttcctttatgatttttctcaaagtctacttcttgctagctcctgggacactgtgactcaaggtagaccttcctgtctctgactttggaggccagtgtcccagataagagttgttgcttaggccctgggtgcatggacatgaaacatgagcaatgaagcatttggactccagggtccagaagatgaaaatgagaaaatatcagagagctgcctcagaagaagagagatgggtaacccttttctgctctccttctatcctgaagataataatgtggtaacctgcttggaatatgagggcaggcagtttcctcactgtttttataagggctaggaaggctagacattttcttactttggaaaactgtttttcaggagtcactgacttacacacatactggggtgagatgtatgtgcgaattaaatccagtgtaaggttgcaagagagaaaagtgcaactgtggcaaactacagagcacatcccttatctaaaggggaatcccactacttggatccagctgtttgtaaccatatggaaatatttaatgttgcaagatcttctacattttcaagagaattcagaaatctggattttttttaatgaagttgtgttaaccatagtcaatgaatttgaataaagagcaaaatcacaaccaaagcaaagaggacaaacacaaatcccataggttctcagtttgtgacctgatgttgaaccagatccatgcatgaagggggtattacttttctatcatggccataacaaattgccacacatttagtagcttattatcacagtttccatagctcagaagttcagtaggctcaattttgtctctgcttagagtctcacaatgccaaaattaagatattggcagggctgtgtttctttctggagtctctgggagagaatctgcttgatcatgcacaaaagtggcagaattcaggtctatgcagttaaaggacttaggtcccatttccttgctggctgtaagctgaaggtcattcctagcctctaggaccacttacattctttggctcatggcccccttctattttcaaaactagcaatgatgagttgagttcttctcatgccacatctctctgatactctctgtctcctctgccttcctcttctgcttttagggacacaggattacattggacccatagagtaatccaggattctctccttattttgaaatccataactttaattccatctgcagagtctagtttgccatgtaacttaatgtacatagacataagaccaggccatgaagattatggcaagggagatggtatcaaaatcctgtttcccacaaaggtttctttttctctagagaaattgattattttctctgatccagtaccagctagcctcaatctgatacctgaatgtaagtatgtttctcaactgtgtcacctcagcctggtgctaggtgctctagaccccagggagaggaaggaaagaatcagctcccagacctttacctgtcttgtactcagtacccagtgcccagctgagaagagcccctgcttttgggtaacccagtggctttctgcttcgagttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtgagctggaaaggtggatcagaaaaaaacaaaaaaagcaaaacagaaattaaggactaacctcaaggaattctcttttggaatagtattattcactaggagtggaggaacagcagcaagctaggaacactttgggtggaggggcaacagtggtgatgctaaacttttaagccagacagatatcacacttctgggtctacaattgtcagggaactggcaaggttgtcatgataccagtctctccattctggtctttcgtaagctctctcagggccccactatctaatggtcatattcaggtatctccctttatgtgtgcaagcagcatagcacagtagaaaaagatatacaagccttgtcatctggaaaccctacatttcaaatcaaccttcattccctaataactatacaaaccttgtgtgtatgtcacttcattttacattttacagaggcaggaactgagacacagagagggaaagttagtttctcaaagtcacagggcaaattagtgggctagaactgtgcaagaacccaggtttgggggctacattttagagttggttcaactccaccattgcaaccatttgatagccaatgttactttctcaaagcttatgtagcatgaggtaggagagtaggtagattcccagttttcaactaaccaaatatcttgcagtgcccacttccgtatttcttcagttaatacattttcagttctcccaatgacttccctgctccctgcatccaacctaagaaaacgtgaacaaatgtatatttgaaagtcataactgatatcaaatttgaaagttataactgatgtcaaatcaatcaacttaggtaccttcaaggttatctagtccagttcttcttccaaggtttgggtccattttataatatccccactaagagtttgtgtagtccttgctcacatactttaggtggcagagggctgactacttctcaatgtatattacagtatacacaattgtgactggtgggtttgagctcaatgtaagaaagagctttccctgtagtacccgcctatccatcctggctctgttcctcgtgccagacagacctcatcagtttcctctgctttaagatagccctgcagaggcttgaagacaacaccacctctctggagaataccactttaggttcttctaaagtatgtggagcttagaactaaacctatcttcaggataaatggtttcaacaatgtagaatagggtagaattgtcatatccctatctaggtaatgtctttctgctattacatcctcaaccattggcttaacctatgatatttggaggggtagagaaagaagggtgctagtgagatttccccacatgtttctaacttggtttgctctctccttaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttg

SEQ ID NO: 12888 - DNA, 6373 bp, Human; identical to SEQ ID NO: 12830

SEQ ID NO: 12889 - DNA, 9689 bp, Human
tgcagttggtggggcaactcttcactgtgcttgcacctgggctggggcaggatcctgaacctctcgggggcgtagcccgcggaacgtggtcggcttgttggtgaaggggtgccactggccctggatgctagggttgtcggtgtggaagggcttgcggatgcggatcacgtccaagcccgactggtcggccagcttctgcaccagcgtcgagatctcctcgaccgacttgcagtggatgctctcctcgcgcacagccccgttaactggcagaagaggggtgagagtgggtggaagctggccggtgcgaccaagcgagaaggaggatagcgggtcgagcccctgatcccgccctccagcccgagcccggccccactcacggtattcggccactactctgggcacgcagcacggacgcgagtttacatatattacgacccctggattccgtcgggcgaagtcgatcacctcccgctccacgaactccctaagcgacccgggacagtgagcagtatgacccctgactgggggcgacctacccggggagtcgttgccacctccacacccaccccgacccgcgcctgcgcacttcccttggctcacctggcgccgcgagacgaggcgccgtcgcggctgacgctgaagctcagacgctgcagctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacaggtaaccctttgagaaatcactacttagagtaaaggggcagaagatcaggtgacaaaagcaagtgggtttgggccatgacaatgttgaaaagaaggttggccctttccccccagttttaaagccctgacctatgtcttggtttcaagggtaggacttcctcctcacccaggtctgttccaccccactgcagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggtgagactcccagattccagccaccttgctttcccagacatatcccagcactcaggaacctttggttccttttccagctccagtaggaactcccccatctccttaggtttggagtttttcaaagaatgagagggcagggctggacacactggctcacgcctgtaatcccagcactttgggaggctgaggtgggaggatcacttgagcccagggatttgagaccaacctgggcaatatagggagaccacccctctctataaaaaaatttttaaaaattaggctgggcatggtgatggcatatgcctgtggtcccagctactcaagaagctaaagtaagaggatcgcttgagcctagtaggttggggctgcagtgagctgtgatcacaccactgcactccagcctgggctacagagcaagaccttgtctcaaataatagtaataataatagaagggcagaggaggcagccaagagagttttcaggatgctagttcttctgcctggggtggtctagagacaacttgtcaaattccttgcctttcctcttcccaggactgtaatagatacaatgcaacatgcagtctacgtctatgacatttgtcatgtgatcatcgacaacctgcagttcatgatgggtcacgagcagctgtccacagacaggtgacggtgacatcctctcttgtctagcttgagcccgcttggacatacaacacacacttctcaggcagctggcctctaggcacacatgctgtgctctcctattttctgagatgtgtgcaggcacgtaccacccccatgtgtatcatatggaggtgtggggtatggcagcaggatgtatggacagggatctgagtgtgagtccttgggtagagggaggtagagtgggttgtggtagtttgtggggagatgtgaatggatcaagagtatgtgtatgttcttgtccttctgtgtctgataagctctttgtgttgttgggatggcgtaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggtaggtgtgaccagggacagccctcattcagccttaatcgtcttgactgtccatccgaacaggcaggaggcaatgcctctggggccatgacatgaggaatatatgtgctggaaatacaaaggctgatagttggttcttatgctcttcttgtcccccaggagctcacatcctctcctggggaaacagtaagacagtgattgcaattcagtatgataagagtatgataggcagcacaagtatttggagagcaaagagaaaagatgtctgagtcagcccgggacatctgggagacttccagaggaggtgacaacaaaggttgggttgaggtttggtagacaatgggtattagacaatcagataaatgtgagggccttctgggcatcaggaccagcccaatcctggagcttctagtgttacactgaatgcctattacatacgaggcctgggctgggcctagggaattcagagcaaggagcacaaatcatgtgccatgatggaacaaacatggagctgggaaagagagtaatgcagaagtggaaaaatggcagggtacagtggatcacacctgtaatctcaacactttgggaggctgaggcaggaggattgctggggcccaggagtttggcaatctgagcaatgtagtgagaccctgtctctacaaaaatatttgaaaattggccaggcgtggtggctcacgcttataatcccagcactttgggaggccaaggcgggtggatcacgaggtcaggagatcgagactatcttgctaacatggtgaaaccctgtctctactaaaaatacaaaaaaaaaaaaaaattagccgggcgtggtggcaggcacctgtagtcccagctacttgggaggctgaggcagaatggcgtgaacccgggaggcggagcttgcagtgagcggagatcgcgccactgcactccatcctgggtgacagagtgagactccgtctcaaaaaatatatatatataatatatatatatttaaaaattagctgggcatggtagcatgcacctttggtcccagctactcaggaggctgaggtgggaggattgcttgagcctgggaggttgagactgcagtgagccgtgctcacaccactgcactccactccaacctgggcagcagagtgagaccctatcttttttttttttttttttttttttttgagacggagtctcgctttgtcacccaggctggagtgcagtggcgcgatctcggctcactgcaagctccacctcccaggttcaagtgattctcctgcctcagcctcccaagtagctgggactacaggcatgtgccaccacacccgcctaattttttgtatttttttagtagatacggagtttcaccgtgttagccaggatggtctcaatctcctgacctcatgatccgtccgcctcggcctcccaaagtgctgggattacaggcgtgagccaccgtgcccagctgagaccctgtctttaaaaaaaaaaaaaaaaaaaaaaaaagaatggtctccttcatgagatgtgacatttagactgagacctaaaagagaagaagctgaggttgagtggggtggcccgctgtggagaaggagagggaacagcacaggcagcgtctgaaacagtagcaagcttgtcagggaactgaaagatttgagtggccccagcatcgtggtcagtagttcaaagagctttggtcatggggggaagtacttttccctctcccattctttctctttttttttttcttttttgagacggagtctcgctctgttgcccaggctggagtgcagtggcacaatcttggctcactgcaacctccgcctcccggattcaagcgattctcctgcctcagcctcccaagaagctgggactataggtgcatgccaccatgcccagctaattttttgtatttttagtagagatggggtttcaccgtgttagccaggatggtcttgatttcctgacatcgtgatccactcgactcggcctcccaaagttctgggattacaggcgtgagccattgtacccagcccctctccccattcttatcactcctccctgccctgtcagcccccctttctgctttgctcatgtcctcttactcctgctttcctccttctgccccctgttccccaggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcctttgtttctgtgctttttcttattcatccaccaggtgtctccccagtccgtagctgaatttccctttcgggattgggaatggacgggtcccctcccactgcttgcagcctttgagcggtgggcttccaaggaagcagggacattaaagggccttcacaccccaccttccatttacatctcttcttggcctagggaagacaagatgatctgtcctcatacctaacttccctgaggatctcgagtgattcctggcacaggtactcatcactgggccacatgagcccagtgccctgcctgactggccattcctctgtgatgtgagccactcacctctcaagtggacttagactcaacatattctgtccacccccatccatctccctcctgtaccctctccgtgtttctcatatgctaatgcgtgccagaactcctggggacttgtgaaaaatgcagaaactaggccccattctccccccatcctccaccacgtacatttctcattctggatttgaggacgggtacagtaatcctcatttttaacaagccgtggaggagactgtaaaataggtgacccagagggactgtcagaagtattcctaaatgatgacaccttctcatctctcgtcctctgatatcccaaagtcccagtttccctttggatttgcctgaaagagtcgtgagaatgcaatatgttctgagggggctggggagaatccttttgtaagggttgggggaaggtttcctgctccgtttggaagcagggctgccttgtcaggctcttcctttcaacctatgaaggggcttctggggccgatggaggggtctgtggtctctggagtgtgagaactctggtcacaaatgtctcctgaaacatccggagcaaggctgctggaaagctgctctctgtgaggaagaacctgggggggtggggagagctcctccagggcctcccttcttgggggtctctcccagactggctggagccaggcctccctaatcccgcagtaatcattcccagccgttggctggtctaggcctcatccagagtctgtaacgctgaacggcagccatgccttccagaggcacaataccatatcagtcatacctgtaaggatgtgggttccacattcctgtctccctagaatgcctggtgggttctcaggagatcttttaggggtttccagtaggggacctttgtgaggtctctgtgaactggggatagagggatagatacagacttggctgtttgtcttgccccacccttctagcagacacccccacacagcacaaaccagaatgatgagggggaggggaagctaatactccccccagccctacccgctgcacaaacacgttctattccatacctgccttaaataccccatatcatgattccacccagtctgttcagatccctggattctagaaagcagtggggggtccctagggcctgtgcggattccctgggataggactggtctgtctacacccaactggatgttaagaatctccctgactcacaggttcggtggattgggaggaaaaaaaaaaaatttccctgagatctcaggaaaggcctggctaagccaggtccagttggatctacagccttgtcctctaattgataatgtatgtcacacttggccatgaggggacagctttggtcctctggcagcttcctctctgctgtggatgggtttaagaagaaacaactcggccgggtgcggtggcttacgcctgtaatcccagcacttttggaggccgaggcgggtggatcacgaggtcaggagtttgagaccagcctggccaatatggtgaaaccccgtctctactaaaaatacaaaaattagccgggcgtggtggtgcgcgcctctagtcccagctgctctggaggctgaggcaggagaatcgcttgaacctgggaagcggaagttgcaatgagccaagatcgtgccgctgcattctgggcgacagagcgagactccgtctcaaaaaaca

SEQ ID NO: 12890 - DNA, 69687 bp, Human
  misc_feature (1)...(69687): n = A,T,C or G
cctgatttgtgaattgaaaagattacttgaaatttggaatgtccctggaaatctaggacttctggttattcaggccaggcgcggtggctcacgcttataatcctggcactttgggaggccgaggcgggtggatcacctaaggtcaggagtttgagaccagcctggccaacgtggtgaaatgccatctctactaaaaatacaaaaattagctgggcgtggtggcgggcgcctgtaatcccagttacttgggaggctgagacaggagaatcgcttaaacctaggaggtgttcagtcggttgtagtgggccaagatcacgccattgcactccagcctgggcaataagagcgaaactctttcccccaccacccccccccaaaaaaaagaaaagaaaatggatcgggattttttttttaaacggcatttactaaacagctaagtaccttctatgagcaaggcactgtacaagagctgttggggataccaaaataatacaatctacgatctactaaagttacaagccggacagtatggtgactggatgttcagaaaagaaaccagatgacattattatggtacaccaaaaaagccccccaaaaaccgtactcaactgtcacattcttatggaatacaatttttacagattgtatacaatttgcatgtgaaattctgcttactttttgactaggtatgccactaatgggtatgtttaataaagatattttatacttcagatgtacagaccaggtccggttaattttagccaacaatgtattgttgaaaaagacgctgatattttactgcggcaaaccaccattaacataaattttaaccacagtttgagtattttattaggaataagccttgaaacttgaataggactagtattcctaacaatttaccgtttcataataaaggctgtctcactcttaagtggaaaacgtattatgtcctacttttataaactttggttgaactaaataaaacagcaacatgtacccaacgtttttagactgttttattcagtaccataaacattcactaaactatacagagctaaaatcatgcaaaagattgcaaaacaaactgccttgggaaatttccagtctaagctaaatggaccaagtataggattgaattttaagaagttggtgggaagattccagctcttgtactcacaggtaaggtcctaggattctatttgttgaagtgtctgcagaccctctccctacagcaggggcgtggagcaaatgtgcattcaggaagtgcttattagtccccccaaaacctttttcgtgacgacagacggatggaggcctcagacgactccggcagtaggaccctgaaccaaatgcctgagctgcgctcgaaaggctcgtctcgcaggagctggcgagtggcacgggcttcggtggccgggctcggggctcggggctcggggcccggggccggggggggggggggtccgtgcccagggcactctgtggctcgattcatgtccccgccctcccacctgagcacactgggcagagagcctgcggcatcgggccagtcgcgcctcctcgtccgccctgggcaggtcgctgggccccaggccgctttctacagctcctttaataaaatggacagcaggggtcctaaccagacgtgggcatcaagacaaaggaggcggccagacgcgcttgagggcctgctcgctagctcccgcccccccattccgcggtcacccggggacagaggccaggccggactgggtggagttgggactcatacgtctgcgtcccaggaaggcgccgggcgagccccagctagacgtgacgggcggggccgaacacggcagcggaccagaggcccgcggcgcaccggcgtggggcggggcaagcggagcctcccgggatgccgcgcggcagccggcttccggctgtgggtggtgcgggggacagcggcggccggaagctggctgagccggcctttggtaacgccacctgcacttccgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcggtaaagacccaggggagttggcttaggccggcgcctggagcgctcgtttgagggaagagcaggggagctgggtctatcaggtgtttgggggcggggtattggcgatggtggcgcgtccctaagttttcagtgtagaagggggtgtggctctcggagtttggggaaagaataaaggagatgggcctgtctctgagtgggaaagggctactggacgggctccatgtagtgactgagcgcctgagaggggtttgctccctagctttgtgttcggggagggtgttgggaaagcggtaaggagtagggtggctggatcttgtttggagagggagatgtggtcagggttcttgccttagtaaggaacaaatctagtgttgtgtgttcctaccagagccagaaaggaagggcccaaagctccagaattcttcctggtcctcgaaggagggaactagaatttctgctgtaggaggtacttatgcagtaatctcgttgggaggcggagactggagttggagtcttaagagttgtgtttttgcgaacatcctaagcacgttcttggttatttcaattgtagcttattggaggtgcttgggagatggggggaggcggaaacctggtaagccaactcgtgatgctgccactatgaatgctttccttgcacttttaaacaaagaaattatcaagagtgacgagtttgatgaatttagaggctagaaagtagagggttcctatttcattagattttccagagagattggattttaaggatggagatgcattaagggatctgaactttggtggaagtaagtttgcgtgaacttttagtgtattttaaaatccttttatctttcaaaaattgacgtgtaagatactttaattagtaataaagtgtgaaataatgttttcccagtgtgtgaaattgtaggcttgcatggttgtactggttcccaaatttcaccatgataccatgtgtagtattttttttctttatatttagtggacagaaattgtaatggattgatatggatactaaaggtgttgagagtgttatcacttgaacagctgtcttatgattctttccgattgaaatggattacaagtgactaatgaaaggcaagggatcttgttaggaagtgctgagaagtggtaagtcagtacaaattgaaggacattttgaggtaggattgtggttaggatggagggatagggtaagggtcttcattttaaggataaatgttagtaaaaagaataaatatgtattttgagatattaaaattatatttgcaccaccctgacacaactgtttcacttatgttattaatctgttgttcgtaggtaaaaataagcatgagtcccaaggaagcatacagtttaaagagaaacattactttctagatcaattcataacatttgcagatcgtaaggttttttagaccattttttttttccaagacagagtcttgctctgttgcccaggctggagtgcagtggcgcgatctcagctcactgcaacctccgcctcccggggttcaagcagttcacctgccttagcctcctgagtagctgggattacaggcatgtgccaccacgcccagctaatttttgtattcctagtagagacggggtttcaccatgttggccaggctggtctagaactcttgacctcgtgatccgcccacctgggcctccctaagtgctgggattacaggcatgaaccaccgctcctggcccatgtgtttgttttttatttgcaaaatgcagaccacctgtgccagaagaatgcatagacttttcttttttcttttcttttctttttctttctttttttttttttttgaggcagtgttttgctcttgttgcccaggctggagtgcaatggcgtcatctcagctcaccacaacctccgcctcccgggttcaagcaattctcctgcctcagcctcccaagtagctgggattacaggcatgtgccaccacgtccggctaattttttgtatttttagtagagatggggtttctccatgttattcaggctggtctcgaactcctgacctcaggtgatcagcacacctcggcctcccaaagtgctgggattaaaggcttgagccaccaggcccggcctctttttttttttttaaacgaaatatttgaaggacacacaagtattatacgtggcattggaaatacaaagatcagacgatatccatcttcaaatggttatagcatagggaaatagacattcatttaggacacttctaaaacagcatagaggagagtgctagagtacgttatagcaagtgttatcaccaaatgaatcttagagatcaagtctagttttcaaataaaggaggaggaaaatgagtctcaggaagatgctgtcagttgtcaatgatgaacataggccttgtgggtatttttcttttgaagaatgactttttttttcagtttgtttgacagcttacaatataatttgttacttaaccttaccattagattgagttggtcaagactagcaaatagtttcatagttgaaaaacatgctttattatttattttttatgtttattgtcctacaaatactactatattgcagtactcaatatcgattaggcatatgacaacatttttctgaaaggcaaaaaatacctaataaaatgaagcctggtttttagagtcctctatgggtcaccaaaaatgatttcaattgaactgttatgaattgcataatttaggaaagttatgagtcatatgagcttagtcatgatgatatcttgttgaagttgcagctggggtgtataagtctcactttgatttcaaaatcgttttccctttgtgttacttttaataaaagaggatgtagtgggtgggaggaaaaaatataggtcacagatgagggatgagaaagtttgtatctgaaacatgtattttcaaatttaccttgaggttattggcatggggattctccatattgcagtgctgatttcattattgacagcaccattttactcagtattttgacatctggctttctcttttgatgttaattttgcttactggctgcattcctttgaaacctaaatgcttaactgccctaactgctccaagggagatttaatgtaactctgctttatattagtctaagagataaaccatatttcaagagtagaatggagaggaattaagcagataattgtgatggggaaactggagagatccttttgactttcacaggatttcctagaacattaaatataggtttcctccaaggccaattgtggttgatttttggatccttcaccattttctatttgtgagataataagtgtatacagctggaagtgtaatgtgaagaaagtctgaaaaagattgataggaaaggaggacaggaatgggcttcattgaggtaacggaagtgaaatgaaaggcttttcatatatgggttgagcatccctaatctgaaatgctccaaaatttgaaactttttgaatgctggcatgacagcacacattacccctaacacacgattttttcactgttagtggtatattttttactgtgtagtacttatgtgtgaataggtataacaaaacgattacttattgtagcatgtaaaatcagtcaggaatgatggtgatgccagacaaccacagattatttatgtgggtggccgagacagtgacacctttgctttcgaatgcttcgttgtacacaaactttttttcatgcaaaaaaagttacttaaaaatattgtttaggccaggcgcggtggctcatgcctgtaatcccagcactttgggaggccgagctgggtggatcacgaggtcaggagatcgagaccatcctggctaacatggtgaaaccctgtctgtactaaaaatacaaaaaattagccaggtgtggtagcaggcgcctgtagtcccagctactcgggaggctgaggcaggagaatggtgtgaacctgggaggtggagcttgcagtgagccgagatcgcgccactgcactccagcctgggcgacagagcaagactccatctcaaagtaagtgaataaatgaaacataaatgaattttatatttagacttgggtcccatccccaagatacctcattatgtatatgcaaatatttcaaaatttaaaaaattctgatgaatgaaacacttctggtctcaagcattttggataagggatgctcaatctgtatctctttatttactcctaaaatcagccaaggaaatgggcatctctccgttcccccccttccttttttttttttctttgttgttacatgagttgtactggtttcacttcatttgacagtgttctgctaatgactagacgtgtatctctgacctggacttgttctctggagttcatattcagctgcccatttggcacttcaaatataacatgtccaaaattagttaccttttttttttttttgagacagagtctcactgtcacccaggctggagcgcagtggcgcaatcttggcttactgcaacctccacttcccaggttcaagtgattctcgtgcctcagcctcacgaatagctgggattacaggtgtcccccaccacgcctggctaattttttttttttttttttttgtatttttagtagagatggggtttcatcatattggacaggcctgtgttgaactcctgacctctggtgatccacctgcctcagcctcccaaagtgctgggattacagacgtgaaccactgccccagccagttacctattcttttgattacaagaatgagtagctggacacagtggcttacacctatagtcccagcactttgggaggctgaggccggcggatgacttgaggccaggagttcaagaccagcttgaccaacatggtgaaacctgtctctactaaaaatacaaaaattagccaggcgtggtggtgcgtgcctgtaatcccagctacnnnnnnnnnnnnnnnnnnnncctaacctgaaacttgcatcctggttactggtcttgctggagagtcttggctcaggttacgtcccaggtctgttgaggagctcttgatagggaattagttgaagcagctcatactctatcctcctttactggtataaatccataaaattgtttagttcccaggctctggggtccctggcctagcagagagcactgctccctttttctcattccttagtcccaacaacccgcacctgacacttactacacgtggcctgcttccctgtcctgtgtgttttggggggtgctgaagaggaaggctcctgtgtcttcagcacaaacacaataaacacttcacagcagtactggctttatgttttccatttctgatatcagaagtaggagcatgacattgatagtgtcattttgggggaacttttcgtacttcatgcagcagagcagtgaagagtgagctgagtgccttggggttctgcagtacactctcaagtagtattttaggaaaatgcaatttgctgaaaaaataaaagaaattaatgtaaaaaatccacaagctgggcgcggtggctcacgactgtcatctcagcattttggaaagctaagggggaaggatcacttgagcccaggagtttgagaccaggctgggcaacatggcaagaccttgtctctacaaaaaaatagaaacaaaaattagccaggtgcggtggcatgtgcctgtggtcccagccacccggaggattgctcatgcccaggaggttgaggctgcagtgagtggtgattgtgccctgcactctagcctgagcaacagagcgagaccctgtctcaaaaacaaaacaaaacaaaaacccacacgtttccagaaccttctcatataacactttatttacattgttcttaaatacgtgtgggacggttatatacataccactatacttatgtgtatatatgttgatatacacacaaaattatatacataatttttgtttgtttgtttttgagatggagtctcactctatcacctaggctggagtgcagtggcgtgatctcagctcactcactgcaacctctgccacccgggttcaagcgattctcctgcctcaggcttctgagtagctgggattacaggtgcctgccaccgcgcctggctaatttttgtatttttagtagagactgggttttaccatgttggccaggctggtcttgaactcccacccttgtgatccacccacctcggcctcccaaagtgctgggattacaggtgtgagccactgtgacctgccatatacataattttttaaagtttcacgattagttttagcttaaaaatgtcagctctgggcttaatgaagaaaatatggatatactttatgtcaatgcattaaagtgaatggccataaaagcttatcccagagacaaaacaattcagatataagagaagtgggagagtggaaggtttatctaatcttctgtaggcaactccacagctacaaccagaaggccattttgttacaggcctgaaagccccgttttctttttattcttctttgaaacctttagaaggaacaaagtattggctactttttaccgctgatgtcagtgttaagaatcttgtgataacatagatttactctccctgctgaaaatcactatgtggctcatcagtaacacaactagacatgatgacttaatgcaaaggaagtcctatgtaaatgagcaatgaaattgcaactgtgtataaggaacaaaatagaatatgaaactccagaatcttttgttttcatttctgtttctcccaaggctctatcattcaaaactccagaatctttcagcatgcaattgtctcctgatatcagcccctctcttgttttgttttcttttttttttttttaatcacagtgagccacaacctaggagtcttttagtggtttctacttggtttgctctgcagcctaccagcagatttcctacattccggtcttgttcccctctagcccattctccacactgcagtcataatgaaatttctttcttttttgggggggatggagtctcactctgtcacccaggttggagtgcagtggcatgatctcggctcactgccacctttgcctcctgggttcaagcgattctcatgcctcagcctcccaagtagctgagattatacgcacctgctaccacgcccagctaatcttgtatttttagcagagacagggttttgccacgttggccaggctggtctctaactcctgacctcaagtgatcgcccaccttggctttctctctctttttttttttttggattttgagacaggatctggcctcgttgcctaggctggagtgcagtggcacgatatcagctcactgcaacctctgcctcctgagctcaagccatcctcccacctcagcctcctgagcagctgggactgcaggtgtacaccaccacgcctggctaatttttgtattttattttatttatttttttggtagagacggggttttgctgtgttgcccaagcttgtcttgaactcctggggctcaagcgatctacccatcttggcctcccaaggtgctgggatgacaggcatgagccaccacagctggcctataatgaaatttccaacttacagctattgccattatccaaagcccagaatccctgatttccttccatagcccttcatggcctgaccagtgcctgactctccagcctcacacttcatattctctctgtactgctctgcactgtagcctcattgagttgctttcacgtctttaagtgttgtgttctattttttgtggaattcagcatatgttatgcccttgacctaaggcctctcctttcttttccttctctggggtgctgcctcatccttctggtcttcaaaaccgtttccctgggaaaacatctttgactcagcaggcagggatcatgcccctgctgtgtctgtgcataactttctgtggctacttctgtcttggtctgtgatgtactttataataattttggtctttcctccagtgtcacaatactggaagtctgtttctttttctctgtgttgtatccttagtgcctgaaaggtaggaggttctcaataaatatttgttaaataatcaagtaaatggagtctggtggaaaagagaaaaaataagtgtagaatgtgtgtgcaagaaaggaggggtagggggatgaaaaagataacaaaagcacataacaaaacaacaaaaagcaaaaacaacaaaaaatgcagatgacaaaaaagataacaaaatgatgactgctgtggcaacttgtagaaagtaaggaaggtgctctcattctagagagaagtaggcagccattgtagttttttaaagagagaatatgggctgggctctgtggcccacgcctgtaatcccagcactttgggaggccgaagtgggtggatcacgaggtcaagagatcaagaccatcctggccaacacagtgaaaccccttctctactaaaaatacaaaaattagctggataggtggtgtgcacctgtagtcccagctacttgggaggctgagacaggagaatcgcttgaacccaggaggcggaggttgcagtgagctgagatcacgccactgcattccagcctggcgacagagtgagactccatttcaaaaaaaaaaaaaaaagaatatggccagacactgagctgagatagacagtgcggcagtgtctggtattaactgtaataaactctactgtcagaagcaggtggtttatacttaagtttattgagagaattggatatggataagagataaactcttgggaaatggggagaaatataaattctgttgtaaagcctgtaaaaaattgagattactagtggttagaattttggaagtgaagtgcagtgaaatattgagtacctgagaggttacttgttagtgaaaacacaatagcagtagtacgtagctacagtttggctccaaaggaagaactgtttttactatagtttgtaatggcttcagaatcttcaatttgagatatccagttattaaaagagaatcaattgcagttgaaatgcattagttaagtattttaaagtgctttagcaagctacatttaaaaagtgcttattatagaaaatatacccaaaataaccaatgatgttactgtcttgtgcttattttttctagacctatttttatacatagttaagattatacaatatgaatatttctgaaatctatatttaacattataacatatgtatttttccatgttctttctttttttttttttttgagactgggtctcatcctgtcacccaggctggagtgcagtggtgctatcttggcttactgcagccttgacctcctgggctcaagtgatcctcccgcctgaaccttctgagtagctgagactacaagcacatgccaccatgcctggctaattttatttttactttttggagagatgagggtctcactattttgcccaggctggtctcgaactccttgggtcaagcaattctctcaccttgacctcccaaagtgctgggattacaggagcgagccaccgccctcagccccatgttcttaaaaaccttttgtgaacgacatttaaaatagttgcagattttttcccctgtctttggaagtgttacaacatccaaccatttcacagttactaatttaccatcattctggtttttgtccttgaaaataaggcaaggctgaataatgaacatctttgtggctaaagtttttttctttactttgagttgttaccttcctttagcttagttcagtggttttttctttttcttttttgagatggagtcttgccttgttgcccaggctggagagtagtggtgtgatctcggctcactgcaacctccgcctcccaggttcaagcagttctcttgcctcagcctaccgagtagctgggattataggcgtctgctgccatgcccagctaattttttgtatttttagtagagacagggttttgccatgttggccaggctggtcttgaactcctgacctcaggtgatccacccgcctctgcctctccaagtgctgggattacaagtgtgagccaccatgcccagccagttcagtgattttcatatttgagtgtgtcagccttgcctggaagccttgttaaacacagactattggatcccactgggcggatttctgtttgagcaggtctgaggggagacctgagcatttgcatttttaacaaattcccagttgatgatgatgctgctggtttgggaactacactttgagaactactgggctatattattgacaatgaaactataatgttgaggttaagttcctaagtcagtaggagtgattatgatcttgaatgaaactgagttcatgtaccaacctgtatcagggaaattgaagaactaaaggaccatattgcatttcagcactgagaattcgtgcagtttgtgaacatgtgagtgctgatatgtgcaaggtttttgctgagtattgtgaggcaaggatgttgtaatgaataaaaaatagccctttttggctttttttttcttcttttgagatggagtcttgctctgtcgccaggctggagtgcagtgatgtgatctcagctcactgcaacttccgcctcccaggttcaagcgattcttctgcctcagcctcatgagtagctgggactacaggtgcccgccaccacgcctggctaattttttgtattttggtagagactgggtttcaccatgtttgccaggatggtctccatctcctgaccttgtgatccccctgccttggcctcccaaagtgctgggattacaggcgtgagccaccgtgcccagcccggccttttttcccccgcctagagatggagtcttgctctgtcgcccaggctagagtgtagtggtgcaatctcagctccctgcaacatctgcctcctgggttcaagcgattctcctgcctcaaactagctgggattacaggcatgcaccaccatgcccggctaattttgtatttttagtagagacagggtttcaccatgttaatcaggctggtctggaactcctggcttcaggtgatccttggcctcccaaagtgctgggattacaggtgtgagccaccatgcatggcctcatttgggaaacttttgatatcagaatcttaggtttttcattagagattgtcagatttccatattcctctggaaggtaaaggcctaattgctagcattctggaagccagttagggtaggagggtaggagggtagggtattgggtagaggataaagaaggggtttgggaaaggtggggggtgtctcttggcagttgtatggttaaattgagtttttgttttatttagtgatatgtgttttttgggtacatgtgatattttgatacctgtgtataatatgtagtgatcaaatcagggtgattgggatacccatcatttgaaacatcttttctgtgttaggaatattacaagtcttctagctgttttgaagtatacaataaattgttaactataatttctgtactgtactatcaaatattagaacttactaatcaaactgtatttttgtaacactaaccactttctgttcatctccaccactcccacttcccttctcagcctctggtaaccaccattctgctgtctacctccacgagatccacttttttagcttccacacatgagtaagagtctttcttttaaaactggttttgtgagcatatttaacatcagtagcaataaacttgtattttaagctcctgttgctgtattttgaggaccttctaagtccattggaaggattttgaataccatagtgtctgcagtgatagttgttgaaagaaagggaaggcatcagtgcaaatatttttagacagtttttaaagagactcaagtcacccaatttgtcttctaaaaatcctgattttggaagaggcagtggagtttctgttgataaaaaatgatttatagtttgtgcttggcacttcctaatggattacatcaggaaagatttattgtctggcactctcattttaacgatactacaattgattattaggtttagatgctaataccttttttacctttatttcagagaagcttgattctttgctctcagactacgatattctctctttatctaatatccagcagcattcggtaagaaaaagagatctacagacttcaacacatgtagaaacactactaactttttcagctttgaaaaggtaatttgaattattcatggaataatgttggggcactgggggcttggtttggcaaaaacaaaaaagtaagggtatctactgaaatcttgggaaattacattttaaagatttgtaattaatttccagtataatgcttattctaaaattcatactggggctgggtgcagtggctcacgcctataatccgagcactttggggggccaagacatgtggattgcttgagctcaggagtttgcccaagctcagcctgggcaacatggcaaaaccccgtctctactaaaagtacaaaaattaggcatggtgacacgtgcctgtaatcccagctacttgggaggctgaggcaggagaatcacttgaaccagggaggtggaggctgcactagccgagatggtgccactgcactccagactgggcaacagagtgagactctgtctcaaaaaataaataaataaaataaataaagttcatactgatgagtatttttaaaaaagtaaatagatattgcagaggtgttaatgatggtaacgatgtttagaaaattctaacataatttaaattaattgaatgcttataaaaccttttgtttttggtgctactttataaccatcaatcatgtgctaaatattatctttatatatgaagagataaagattttgttcaggaccccacagcctggtggtgagctgggtctagattttactgttctatttatttatttagctaactagttacttagtttccaggattctttaacctgcttcatatttatttatttttaaaaacagggtcttgccatgttgccaaggctgatcttgaacttctgggctcaggtggtctttccatcttggcctcccaaagtgctgggattacaggtgtgagccaccatgcctggcccaaatttaatattctttctacattgagttcctcttacttcttagcataaattgatggatatgttctatttcagtagtaattttaataccacgtattgttttgcacattgaaatgttaaataattgcaggcctctttttaaagtctttaggaagctttattcagtatcaaaaaacagacacatggagaattgactgaattattctttatttatttatttttttgagagtcttgctctgtcgtccaggctggagtgcagttgtgtgatcttggctcactgcaacctctgcctcctgggttcaagcgattcttgtgcctcagcctctcaagtagctgggactacaggtgcacagcaccacgcctgggtgatttttgttatttttagtagagacagagtttcaccatgttggccaggctggtcttgaactcctcacctcaagtgatccacgatctcggcctcccaaagtgctgggattacagacaggggccactgcatctggccatctttattctttatataggacaagccttctcaactatgttaaaaaataaaaggaatatgtgcgtctggtttaaaaaacaagccatggaggatatgcaaagtttttacttctaactcagttagacttctcagacccagagaggtttcctttgtaaacttccaattttttgttttgttttgttttttgttttttgagacagagtttttgctcttgtcgcccagactggagtgcaatggcacgatcttagctcactgaagcctccacctctcgggttcaagcagttctcctgcctcagcttcccgagtagctgggattacaggagcccactgccatgctcagctaatttttgtatttttagtagagatgaggtttcaccatgttggccaggatggtcttgaactcctgacctcaggtgatccacctgcctcaggctcccaatgtgatgggattacaggtgtgagccaccgtgcccgacccaaaatattttaatgcatgttttttgcctataggtctctgtgtgtgtataggtgatatagatagcatatttacctcattttaaacagctgcataaatattcctattgcatagaattgtaacaacatactgactaatacactacagatggatattgtttaaccaaagtgatttttttaatacaacaaacagtgctctagtgagtatctttgtaaatgtgtaccttgatgaggtgtttttataggatatattcctggaaggagaattactgggtcaaggatatgtatactatgtttattgatattgctctttcctcccaaagagatttgacaaatttattcttccagcagcaatatatgagtttacctgtttcctgttatctttgccaatagtaggtttatcagcctttaactgtcacccctctaaagggcatggcattttatagttgttttgattttcattttgtgtgacattgagcatctttttatatatttgtaagtaatttgttttatatttctgtaaactgcctttttatctcttttgactatttttctattgaatttgtctttctaactactgaattgtagcagtgcttagtatattaaggagattggttcattgtcatgtggttattttaggcaaatttttaatgcaaattaatttttcctagctattgcaattatccttaggttattttttaatgacttctttttattcgattttatgtcagaatattatagtattggttattagctttcaacttacaccaaatttgagcagattggtaatattaatagctacagttaatcaggtacttattttctgtaatttactggcattttacataagttatctctaaaagtgattccttttttgaaggaacaaaaaaaaaaaaattaaggcttagacagcttagtaacttgcccaagattactcagctagtaaatgacagatacaagatttgaacaaaggttggactccaaaacttgtgttatttctgctatactggtggagagtttggtgaagaagtggatatagtagcaagaaataagtaggagcgaaggaagagtgaggaaactataaaatgaaaagaactcaaagtttagctttttgggtttctttggatttgaagtggcctgtagaatccgtattctagaggcaaaaacttccatagccttacatatttctctttcaagtttcgtagatgacattgattccctaagaaaatattaaatcgtagccacttgttatcttttctctgtgtaagaaagcagggaagtatgtaatttattttacaaagtttccatactaaatatttaatgggaaatttatctaacagtctatggaattttataccaggtgttttaaaataggttatttcctttaatccccaaaaccgttcagttattaggtgatattatttccatttgtagataaatacttaggattcaaagattgaggccaaggtcggacagtgagtaaatgaaagtaggacttaagccaagtttgtcagactccaaagcccataccctttcttttctatcatattgcgtcattaaagtttaaaacaagaacaaaaacaaagatagctgaagtaatcagtttgtatcagggctgaattaactctatgaaacccctcattacttgatggtaaatgagaagattccgtttttcgatagcagtggaaggcaaagtaatttaaaccaagatcattgcattaaatttggatgtaactattagaggttgaaaaagcatagaaacactgagaggttgtatgaagagttgaagtaacttaagaaaaaaagaaacttgtttaaaatttgccttacaagtttcatttcctttttgttataaatcaagaaattatcagctaggcgtggtgactcacacatgtaatcccagcactttgggaggccgagctggatggatcatgaggtcatgaggtcaggagatcgagaccatcctggctaacacggtgaaaccccgtctctactaaaaatacaaaaaattagccaggcgtggtagcaggcgcctgtagtcccagctatttgggaggctgaggcaggggaatggcgtgaacccaggaggtggagcttgcagttagccgagattgcgccactgcactccagcctgggcgacagagtgagactccgtctcaaaaaaaaaaaaaaatcaagaaattatcttatttttaaataacgaaaaagctgcggagtatatactgttttgatacttttttgatgttgcctgaatttttttggaaaaagttaaatgtttctcctaaaagtgaaatatatcagattacttgagaaggtctagaactgataaagaaatgaaagtgatatacctgactaaatggaccattaaaaatggttagggtaataatgttaattcaaactggttagctggtctttagttactgtaaattcttaagtcaaaagtcagaaagataaaacgttaaagaaatctgtaagaaaatgacttcacataattttgggaggataaagtaaaagaaattttgacattctgttggacgttttataactcaaaagctaatattggaaaatcaaaaaacatgaattttataatcgcttggtctttatctttagaaaagattcttaatgtagcaaatgaaaaatgcaattccactgatttctttctgaaaagaacattaagtaatgttgcaactcttagctttaaaacaaaataataagacatttataataagtatgcttttgaaagttctcagcataactggagggaaaaatcataactgagaatgtgtgggaagatatgttttaggatagcagaagaaaatgttccaaggatttacgaaataatgttctattgtcttttccctttgaccattaaaaaaccacaagcaaactaaaattaccttgttatgctcaaaaagttaaaaatatttgttgccatggagatagtcccagtctagatttctttccggtagtttaaagacttttgcaatcccatggggaagtaatatattttcagtacaacagctgacaaaatttgtttctgtgggtgagatgaataatatacctttctttgtctttggtgttcatggacacattgaaagactataaataatacttgagaaagtcttgctcaccactcctagttttcatgtaaggatggaaagtcatagaaaacaaaaagaatagtaagccaattaaagaactggactgaaactcaacaaaaagaatagtaagcccactaaagaactgaagtgtataccccctcccctctcctcccctcccttcccctcccctcccttcccctcccttccccttcccttcccctctcttccccctccccttcccctctcctccccctctcctcccctctcctccccctctcctcccctcccctcccctcccctcccctcttttcctgtcttctggtgccaatggagtctatattctaatgtctgtcttagataccttgtatttattttcctaactgtaattgtgggttacttttttgcaagatatgttgttttgaggaggaaaaaaagcacgagtactttttttttttcttattttgagcgggagtctcgcgctgtcaaccaggctggcgatctcggctcacagcaggctccgcctcccgggttcactccattctcctgcctcagcctcccaagtagctgggactataggcacccgccaccatgcctggctaatttttgtatttttagtagagatggggtttcgctgtgttagccaggatggtctcgatctcctgacctcgtgatccgcccagctcaacctcccaaagtgctgggattacaggcgtgagccactacgcacggccgcatgagtacttttaaatatagaaagcagcatttattaattttgcacagcaataagaattttctcatagtccacccagcttgatagagacagcatagtacagggttttgaaataaaccaggtttatttcccagtttcaccatttactagctgtgtaactttgagtaggttgattagcttccaagcctcaatttgtacttgtgtgaagtggggataatagatgcatagtacctaacaccaagtaggtgttcaataaatggtatataataggattagtttttgataataatttttttagataatcaggattccaacttaactacgcagtcatgtgtgtttccttattcttcagtgttttccaggagagatgaatgtataagttctttgaatatctttaccctagtgtgagtttattgtgatctgctgtttttatagctaaataaattagttcatttgtcgttacaggagatatattgctctaagtacctaataagactttagttgtaacttgcatagtgttttattaatgtcaatgcttctggctttttaagaaagtttaattatgtgaaaatgagacttaaaatttgtgtgcttagagtaaaatatgaatgcatttttcttcaggcattttaaattatacctgacatcaagtactgaacgtttttcacaaaatttcaaggtcgtggtggtggatggtaaaaacgaaagcgagtacactgtaaaatggcaggacttcttcactggacacgtggttggttagtatggagcttgttggtttgcccctgtgtctggtgtattaggtctccaaatctaacttgattgcatattcttttctggtgcaggatagtggggacggggtgtcatagaagtgctattctttgacttttctttgaggtatataagtttagaggcaggaacattctaatagaaggaaatgagtattatctaaatgtcatactagctggctggtttaatgattaaaattaaattcttcttaagtgataggaatttaacctttcttttcctcagtgactgtaagctttctttatgatattttaaacagggaagcttggagataaaatacttggtgatcctattacgtatgtatttgagaaaatttatcaaacaagcaattgcagtttactttttgacctttttctgcaatgagaaaaaaaaatgtcattgaaatccacaaatagtatagttcctaggcctgtacattctaaatcatgctttctgtctctcttagttcttcctttacctagaagtagataaaattattccagaagaaaatcttagcagttttgtttgttttgggaaagggataggtttcaagtgactaaacttgaggctaccccttaggagttgagattatctagcttctttctggagcctttgtttcttgttttgcagagctctcacagtactaggcaaattccaccctgaaggatttaatttttattgagagtaatgcatagtttcttatttgatgtaagtatttttaaataataattttttttttctcttaaggtgagcctgactctagggttctagcccacataagagatgatgatgttataatcagaatcaacacagatggggccgaatataacatagaggtaaatttatatgtgaattttttttcagtagcttatatctctgattttcaaaaagctgctcagttctgcaaaggtgaaaagtaattatacttatttctttcctcttcgtatttgaagttttttactaggaaagtagactttttaaaaaaggataatctctaagaagctgtgttatgatacaccctgtatttctaagtaccataattgagagagttacatgtgggatggataataggaagagaaaactttctttccctcctgactcattttttaattctttctcaaataataaatgtaaacatcctcagaaatgaaaagtgaagtattatttttcaatttctctgtttttctgctagacacactggaaatgctagatcaatgaaaggtggtagttcatagtctgagaagttaaagaggaagctaggaaagtcaggctgtggtcactcttccattgaaagagtagcaatagaaatcaagaccacagtggctgcattggttaagacacatatctatctgtcagatattagtctacaaaacaaaacgtttcctcataattgtgaattgaagttgattctgtgtttcctgaaaaatgagaagactctgggtggtggtggtgatatcactaaaatagatcacctgtgggaaaactgagtaagattggtcaaaatgaaatgttcaggtgtatttgagtgcttaataggggtaaaacagtctgctggagctatatatactatatgttttaattatatccaatctacatgactgttagtcctttgactgtccattattgtgaaaaagaaacctatggccttgcagtatgttatagtttgttaatgtttaagctatttaatgtcaatgttttgaggagtctggcctaccagaaagagtcagaaatttagtagaaagtaaaggaactaatattataaatgcattcattctagaataggcaaagcatcactggaatgtcttaaatttgcctgttctttcaaatcaatttattttttaagaatacctttattttaaaatatatgctcattgcaaaattcggaaaatagattatctgtacttggacagataactactattgacattttgacagacatccttccaaatttttttttctatgtgtaaatacacaaataaatatagttatacccactattttttcctgcaaaactaggaccatacaatatgtacagtttgtcttcacacatttttcgtttaacaatatgattatgaaccttttcgtgttaatatagatctaaattagggttttttttgtttgtttgtttgttttttgagacggagtcttgctctgtcacccaggctagagtgcaatggcgtgatcttggctcactataacctctgcctccccggttcaggcgattctcctgccttagcctcccaagtagctgggactgcaggtgtgcgccatgatgtccggctaattttttttcttttttttgagatggagtatcactctgtcactcaggctagagtgcactggcgtggtctcggctcactgcaacctctggctcctgggttcaggcggttctcccgccttagacccttgagtagctcagactacaggcacatgctacctcacctggctaatttttgtatttttagtagagacggggtttcaccatgttggccaggatggtctcgatctcctgacctcatgatctgccagcctcggcctctgaaaagtgctgggattataggcgtgagccactgtgcctggcctcaactgttttgtttctaacttttgaaataaaaggtattgtagtgaacagccttgggcacaccttttggtgcatgtgtttagttggaatagtctggatgataggtaatagtctgggaagttaaatgaagaaactgtaggaagctctgtctaggctgtgcgagggcttcagataaactcccatagctgagtagcttaacacaagcaaagttttttcttactctcctgtggcttgatgtgggttaggtggttctcctctactttgtggctttgacttttggacacatgtcctctgtagttctcacagaaagaaaacagagctagagaattatacaggatattaagggccaggcttggaaatggccttccgttcaatacattctagaacactttatctctgacctgctacaaaggagaatggaaaagatagtcgtaatttgagctcagaaagagaaaatagtgtggtaaatgcacagcattgtttttgctgcagtgcatatgtctgcttatttccttagaataatttattcttttttgtttttttgagactgagtctcactctgttaccaggctggagtgcagtggcgtgatctcggctcactgcagactctgcctcctgggttcaagccattctcctgcctcagcctcccgagtagctgggattacaggtgcgcaccaccacacccagctaatttttgtatttttggtagagacagggtttcacaatgttggccaggatggtctcgatctcctgacctcatgatctgccagcctcggcctctgaaagtgctgagattaaaggcgtgagccactgtgcctggccagcttattaattcttaagccaaaatatgtgtctttaggatccaagttaaatttgctcagattacatttttttttttttaagatggcatctcgccctgtcacccagactggagtgcaatggcgcgatctcggctcaccacatcctctgcctcccaggttaaagcgattctcctgcctcagtcccttgagtagctggaattacaggcgtgtgccaccatgccccgttaatttttgtagttttagtagagatggggtttcactgtgttggccaggctggtcttgaactcctgacctcgtgatctgcccatcttggcctcccaaagtgctgagattataggcatgagccaccacgcccagctagattactcatttttttcaaatacttccttttggaaaaataggaattctgtttccatccatacctttgtttcactaagtacaaaaatgagtataactaatatttcattgtaagatatttacttagccaggcacagtggctcacacttgtaatcagcactttgggaggctgaggcgggtggactgcttgagcccaggaatttgagaccagcccaggcaatatagggagaccttatctctactcctccacaaaaaaaaaaaaaaaaaaaaattagctgggcatggtggcacatgcctgtggtctcagctacttagaatgctgaagcagtaggatcagttgaattcggaaggcggagactgcagtgagctgagattgtactgctgcactccagcctgggtgacagagcgagaccctatctcacacatacacacacacaaagatgtttacttacaagtatactcatcagataccttgagggacttttgcatgaaattaataatgtttattgaaaaaatgatttactacttacaggggtgattttcatactctttataattcttttgatacttttatagttcataagtgtggtgattggctgttcacacacacatatgagatgtaccaccctagaaccttgttacaatgttagcacattaccagtctgacatgaaaaaaaataattctttacacttaccttgatgcaaaaacattgtctatctgcactaatatcttaggaatataagtgagcaggaaaaaatatatatcttatttttaacacatcatcattaaatattttgtttatgacagtcttacttggtcactcaggctgaagtgcagtggtgccatcatagctcactgcagccttgacctcctgggctcaaacaatccctcttttctgcctcctgagtagctgggactacaggtgcatgccaccatgcccaactaatttgttaaatttttgtagagtgtatcagatttttgatgaggtctcactgtgttgcccaggctgatctcaaatgtctgactgtaagcaatcctcttgcttggcctcccaaagtgctgggattacaggtgtgagccactgtgcgcagccgttaaatattttaaaccgtcactgactttaccatagcttactatttatataaataatcctgggttaaacttgcatagtgagataatatttcccccaacttttatttatttatttgagatggagtcttgctctgtcgcccaggctggagtgcagtggcgcaatctcggctcactgcagtctccgcctcccaggttcaagcatttctcctgcctcagcctcccaagtagctgggattacaggcacacgccactgtgcccggctagtttttatatttttggtagagacagggttttgccacgttggccaggctggtcttgaactcctggtctcaggtgatccacccgcgtcggcctcccaaggtgctgggattacaggcatgagccactgcatccggcctaatttttgtatttttagtagagacggggtttcaccatgttagtgaggctggtcttgaacttctgaccttgtgatctgcccacctcggcctcccaaagtgctgggatgacagacgtgagccaccatgcttggcctcccccagcttctagttttaaaaatgttcagctggtgcagtggctcatgcctgtcatcccagcactttgggaagctgaggtgggtggatcacttcaggccaggagttcgaggccagcctggccaacatggtgaaacctcgtctctactaaaaatacaaaaattagccaggcttggtggcttgcgcccgtaatcccaactgctcgggaggcctaggtgggagaatcgcttgaacctgggagacagaggttgcagtgagctgagatcgctccactgtactccaatgtgggtgacagggtgaaactctgtctcagaaaaaaataaaaaagaaaatgtgcaaatctacagaaagattaaaaagtaccctgtagttacagaaagatttttttaaaaaataccctgtagcccttaaacaatttctaacataatgtcctgttagctttctctctttttttcgtgaatcatatgaaaatcatttgcaaacatcatgacccttcacccctaaatacttctgtatgcatccttaggaataaaggcactcttttctatagctgtaataaaagtaacatacctgagaaaatgacaagaattctacaatattatctaataatcatgccatagtcaaaatctctagtcatcctcaaaatctcctttgtagattttttttggttttccagtccaggatccaatccagttttctgccttttagtcaattactcatcaaattattttttccagcaacttactagtaataatggtaatagccttagcttttattaataacaaccacttttcttttgaaatgttaatataaaactagatttattacctacataatcttcataatcttcaagttaggtattatcactactttacctaatgagggaggttatgctcagggtacttgtccaaggcacatagtgaggtatggttgaggtttgaactcagatatatctgatcccaaagccagctgtctttttctgtgctggactgactatactaggaaacaatcaatgtgaacttagaaatgtttgacccaaaagaaaaaaaatttcactcctattcataggctaaatgaactttactaaatatggaagattcctgtagcccggaagttgggttagttaacttttgagatctctgccaaccctgaaattctgtaacccttgtttcttacatctgcctcatacatggattaccaaagatgtatatgcatataatatttaacagttttattgagataaaattcacatactatattattcacccacttaatgtatacaattttgtagttttgtgtgtgtgtgtgtgtgtgtgtgtatttttgagatggagtctcactctgtcacccaggctggagtgcagtggcacgatcactgcaacctctgcctcctgggttcaagtgattctgtggcctcagcctgttgagtagctgggattacaggcgcccaccaccatgcccggctgatttttgtgtttcagtagagatggggtttcaccgtgttggtcaggctgttctcgaactcctggactcaagttatctgcccaccatggcctccccaaagtgctgagattacaggcgtgagccatcgcgcccggcagttttcgtatattgatggagttgtgcaaacaccacctcattcaattttagaacatttttatcacctgaaaaagaaacgctgtatcctttagccatacttcccccttcctccctaactcccccagctctaggcaaccagggatctactgtctatttagatttgtctgtttgggtcatctcatataaatggaattacataacatgtcttttgtgtgtggcttcaatttttttatttttttgagatggagtcttgctctgtcacccaggctggagtgcagtggcatgatctcagctcactgcaacttttgcctcctgggttcaactgattctcttgcctcagcctcccgggtagctgggattacaggctcctgccaccatgcctgactaatttttgtattttttactagagtcggggtttcactatgttggccaggctgttctcaaactcctgacctcaagtgatccacctgcctcggcctcccgaagtgctgggattaaagacatgagccaccacgcccagcctgtgtgtggcttctttcacttagaataatgtttccaaggttcatctgtgttgtagcatgtatctgtatcttatttatttttattgctgaatagtattccattgtatggataaactgcattttgtttattcattgattagttgttgatggacatttgggttgtttccactttttagctatatttacattactgcttgtgttttcatttctcttggttatatactaggagcagaattgctgggtcatatggtacttctacttttaacctttgaggacctgccagactgttttctaaagtggttttaccattttacattctcatcagcatatgtgagggttctggatttctctacatcctcaccagtatttgtctttgatcatagtcatcctagtgggtatacaggggtgtctcattgtgggggtttttttccccattggggttttgatttgcatttccctgatggagataaatatattttttgtgtgtccccccacaaactgcctggttctgatgagaccagtgttcttacagagaataactttgctttgaaacaaaacaaacaaacagccttttgacttgggtaacctttggagtatgttaattgtgatttactctggccttgtaacattgtaagtggagattttgtttaaaaactgcgttcgctgaaacaagtaataaggttcagacctattgttacaagttctgagttttctttcatataaatatgtttgttcttttgtgtggataaaacctaacgtggcaaaaaggtgtcaaacacctaagtattaaggaaactaaaatgaaaatgctgcatgaacagaaaccttgtccaattttcattactatagcaccatcacctataacagtgccagtgtacagtagatattacataatatttttgaatgaatgagtggaaaatgatatgcatttttctcttctgcatcctctgaaagatttcacaacgtgcaaagtatgtaaggctttatttatatacagataaaataatcagagtttataatctatgtatttactttcctgcatagaaactccatatgattaaaaattgagattatttattttaataacatgactaatcagtttacttaacctagaaatgaatgttatctaagaacaagcaaagaatgttagaagaatttagtgtttaggaattattattgttttccatctcagtcgtatatattttctgttttagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaaggtaagacttaaagagtgtatttcaaataagaaacaaacatactacaattgacttcagtaggggtggttgttatttgttaaaaaataacatgattgtcaagtaactatagtatttggcatgaaaataagaggtttgttccagaaattttcatcttcttttgtttataatgtaagagttgaaaactctggaaaataatgggaacaacagagattagactttaaaaaagattagggaaaagggaaatggagtgatctgagggaaaatattcctgcagatatttagaaatgataaaataatatggtggaaagacaatctttagagtttataagaaattaattggtagtaggagggacctatatatatactgcttagaatacaagaaggttatatccatcttgggacaatccatttagggtcatttaaaaaacgtaaccatcttggaattttactgcccaaaacacctctggttaggttttttgttttgttttgttttgttttgttttctttgcagcgcgatctcggctcactgcaacctttgacttccaggttcaggtgattctcctgcctcagactcctgagtagctggattataggcatgtgccaccaggcctggctaatttttgtatttttagtggagatggggtttcaccatgttggtcaggctgttctcaaactcctggcctcaagtgatctgcccacctcagcctcccaaagtgttgggattacaggcgtgcaccaacatgcccggccaaagacggttatgttattaaaattatatattagcattttaatatataaataaagaaattcttaatttatttcacaagaaagttgtcctattaaactaattttcaatgtgaatatcttgacatttttactgttacattggttaattcataaacttcttgttgtagaatatgactgacagcttcatagcccagcattaggtgactgttttactctgttgagcactatttatttatttatttatttagagatgaagtctcacttttgtcgccctggcttgagtgcaatggcacaatcttggctcactgcaacctccgcaccctgggttgaagtgattctcctgcctcagccttacaagtagctgggattacaggcgggtgccaccatatctggctaatttttgtatttttaatagagatggggtttcatcatgttggccaggctggtctcgaactcccgtcctcaggtgattcacccaccttggcctcgcaaagtgctgggattacaggcctgagccaacatgcccggccttactctgttgagcactttttaaagtttctgtattggaaaaattaaagaggcacttgtccttggttttgaattctacagtgttttaactttatgttacttttcacttttctgtcttcctccaaattattttttgttgttgttcagaatcctttagtgatattaagctcacataatgtttgtttcaaaaatatgttagatttaaagtgttaccataaaactccttgttttggtgaattttgatttaatagtgcatacaaattcatattagagcttgttcatcgagtgaaaagaagagctgacccagatcccatgaagaacacgtgtaaattattggtggtagcagatcatcgcttctacagatacatgggcagaggggaagagagtacaactacaaattacttagtaagtatttgatattgcatcgagtaattgaaaaaaaaatttgggtgggtacattccatgaaacttaatgcaaccagatctgttccagatactctgttatttccctaaaatatttgagggatattctctgaggtttttatgttactgtatggaaattatagtttcaaatttgtgacaacccattttacccttgaactaatattttctgcatgttagaatttatgcatatagggtttgggagaggttataatgtagtccttcctccttgatataagtgagttctttaaaaacatcactgctatcatggtagtgaacctgtggtgtcacatgtgaatgtaaaaatatgtatttgcatgaacccatgtttttcttttgcttatatgtatatttcagagaggaaggcgagttttgtttgtcatgttaaagacctaatcattggacttcacttgaaataggtgggactttcatggtcataactagttctagggcacagaagtgaaggaaagatgtaagaagtgatgatactggatttttaagtatgaactattatgatttttgaagtctggggaatcatttttcattgacattttttgctagtgtgacttcattcgtcatgattacttggcactgaccaaaatgttgttactgagggaataatggagaatgcagctattcatgaagcaagaagaagctggtgcagtaaagatgtctttctcattgccttgcttttcccatgctgtccattttattcataccctcccaacttctttcccttcccttccatgtcaaatggatttttttttttttttttcaacacagagtctcactgtgtcgcccaggctggagtgcagtggcacaatctcagctcactgcaacccccacctcctgggttcaagcaattctcctgcctcagcatcacaagtagctggaattacaggcgtgaaccacagcactcggccccatatcaagtgaatttattatgaggctagtaagagtcactgtgattcttgttcctaaataagagagatttttactttaaaaagcttctctcttaatctgggttttatattaaggggctcctcttattttacttctttgttcattgcactataaatatgaatataatgagagatctagtcttaaaaattgtatttttttacaacttcttaggcataacttgtttcacagttgctggaacaaacctcatcaacccagtttttgaacagtagaatattctctttgagaaaaagataggtaattagcattttgttctttctcatgtcattttccttggaaactatactgccttccttctccagttttcccaaatcagagaacaaaagaaggagggttgctgaaatgaaccttgttctttctggctgtcttcttacccattcctcagtgctgaactttttggggtgagagtgggggaatagggttggcagttgtctgccacggccccttacttgtttctggggaagacattcgaggtactcaccaagagatagagtgaagatggaattctttttagaagggaacacagttgacccaggaacagtgcgggggtgtggttagaagcactgaccttcttccctctgcagtcgaaaatcctcacgtgactttttttttttaaggctctgtcgcccaggccggagtgcagtggtgaaatcatagcttgctgcagcctctattgcccgggccaaagcaatcttcccacctcagcctcctctagctgggacaacaggtgttcacccttcctggctaagttttttgatttttagtagagatggagaatttcccaggatggtctcaaacttctaagcttaagcaatcctcctgcctcagcctcccaaggtgctgggattacaggcatgagccactatgcccggccactgtataactttgattctccaaaaatttaactactaatagtctactgttgaccagaagccttaccaataaaataagttgattaacacatttttaaaatatgtattattactgtgttcttacaatcaagtaagctagagaaaggaaaatgttatgatgaaaatcataaaaaaaaaaaaaagcccggcatggtggtgtgtgcctgtagtcttctgttactcaggaggctgaggtgagaggattgcttgagtccagaaattcaggctgtagtgagctatgatcgtgccgctgtactgcacccctggtgacagagcaagaccttgtctcttgaaaaaaaaaaaagaaaatcataaggaagagaaaaatacatttactattcactaagtggaagtggatcatcataatggtcttcatgttgagtaggctgaggaggaagaggaagagttgatcatattgtctctggtgacagaggctcaaggaaatccatatgtaagtggacacttgaagttcaaatctgttgttcaagggtcaactgtatttcaggtatactgattgacttttaaatttaatttttattattggctgaaacggtagttttaaaaaagcctgttacttgtcattttggttccatgtgcaattgagtacctgaaatttaggttaaactataccattgttttattctggtaacagcactttaagtttggggccaaaggttgggaatactctgatacagtaacatctcaatgctagtttttgcgaaagtagaaacttttgcaatggcctctaaactgagattttttctttccccatagattttatattgcattgccaggagaggtaaagagttacataatgtcttttttcttttttaaatacacacagatagagctaattgacagagttgatgacatctatcggaacacttcatgggataatgcaggttttaaaggctatggaatacagatagagcaggtatttatcaatagatatggcttatattacttaagttttgtaatgtaaatatttgtcacttgtattcaaaacctaaaaacttgtccttaacaataattgtaaataagttttctcagatgccaatgattttttatgatgaattgtgcagtatttttgatgttaattagttctagattgtgaagttttctgtccttagtctcgctttaggtagaaagccttttatgctgctgtgctttgttccttctttgaattcatggcctttatattctctgtagttttcttcccccctccgattatgcttaagtctttagttaaaactctggcatgcaccattgaatccttagtcagaaaatttactaaaaaatactgtgtacctttgcaaggctgtatttatatatacagaacctttaggttctttcctctcagatatctccttctgatttcttgtaatctgttaacagagtgtgtctagtaatgttatattaatgtcatcttaataatagctcatattaaaagttatttcaaattgctaggactaattaaaaaggcttctgacatagggtattgctttgggcagagagacattttgatatgtaaattatataaattgttatctctatttttttccaagctttttgtagtaaaccatatttttataagttatatagtatagaatttagaggttgaaaaaatttttaaaaatcattcaccatgtttataaatgttaaactttgatattacttgtataaaactaagagaattatttttcccttttcattctctttcactgttacgcattttctttttaagttattatttgaataggtaacatgtacacagtacaaaagccagtgaaaagtaagtctctgcagcctgtttattgtcaaaccagttcctttccccaaagacattcatgtcactagtttcatatgtatctttctagagatgtcgtatgcaggtatagtgtatgtatatgtctgtatttgacacaacggtgctatgcagtacacttttacaccttgctttttcatttcacagtatgttggagagtacttcatgttcatgcatgtaaagctgcttcacttgttttattataaatagctgcatcatgtttgagtttcagggaacctgtaaattttctttttgctttaggcatttggaaccagttgaagaaacaggaataatataggagattaaaacattaacttctttacatctgatgaaggatggattggagggtgtggtttagatgtgtatcatggtgggcttctaagtagttctatcccagatttgaccttgaccagccaccatcaaaactgcagagtccaccccagtaaacttaccacacagtggcagaggagaccagaatgggccttctctgcaggcaggcaggcaggcaggcaggcagagagactcacagaaactctgagctgagcatggtttccttctttatctcacacttactaatgggagcctttgttacttttttttttcttctttgcaggtttaatatgaatttgtctgaaatgcctgtataaggagaagactctattcttagccttttattcctttgatgcacaaagagatgtatattttattattctttcctgagttgtcgactgtagtcgtaataaatattttaggctcctgtaacccaagttcttattttttcaaaataaacatggaggatatgaaaatttaagagtacatttataatattataaataattcattgacatatgttttccataccatatgcttctctgtttgtttcaaacattgaatattggtactgaagaatttatgaattttggttttaaaatgttttttttctagaacgattctttttttgaacagataaaataatgcagtattcagagccttctgacttattttggaagtgttctaagtatatgatctctttaagtatagattcgcattctcaagtctccacaagaggtaaaacctggtgaaaagcactacaacatggcaaaaagttacccaaatgaagaaaaggatgcttgggatgtgaagatgttgctagaggtaggtcttagaatcctggatatggtgctaacaccactttgtcatttctgatatgtggattgtatgtgttttaatgaaggagcatgttagaaaagatggacacccagaagcagtctcctccagctgatccagcagtaaccccatcccgtgtagcagcatagacaacaaataacaaaaactctatgaaaaagaaaaacgctataaagcaatgctttttttttttttttttttttttttttttttttgagacggagtctcgctcttgtcgcccaggctggagtgcaatggcgggatcttggctcaccgcaacctccatctcccaggttcaagagattctcctgcctcagcctcccaagtagctaggattataggcatgcaccaccacggccggctaatttttgtatttttagtagagacagggtttctccatgttggtcaggctggtcttgaactcccgacctcagatgatccgtctgcctcggcctcccaaagtgctgggattacaagtgtgagccaccatgcccggccaaagcagtgcgtcttaaccttaatatctttgaggatctaatgagacaatcagtggatcttctctagaaaataacatggatacccaatatatagagtttttgcacactgtttcattagttctgcacacttagttcagctctctctgaagcttatcaatttatcttttagggcagtaattatcaaacaggttatgaacatgtattggagagtagaaatatagcttggagatctgaaagttctctacaggaatttaaaatttttgtgtttttattctggcgattaatctaaagatggctaacttaatcattttatgtcatttggagtcttgccgtataacagggtgctgccatgtgattccagtgtcttgagtttgtgtgtgctattactttggtgtagaatgactttatatgaagcgatagtttttatcttttaatgtgttggcaagtttattagtttcttgttgttgctttaattatcacaagtggagcagcttagaacaacacttatttatcccatagtttgcatgggctagtccaggtatggtgtggctcatctggattcttgtttagggtctcatgaggctgaaatcaagttttcaaagcttcaatagaattaaaggatattataactattcatccagatggagaagcataatgtgcagcacctgtgtggtactcattcataccttgtctaatttgatctgctgagcaccctgagaggttggttgagacagcatccttgtgaggaggctcagcaagtgttactgtttattccagctgacatgacaaagcagcataggctgggggacttaaacaacagaagtttgggttttcacagttctggaagctggaagtccaaaatcaaggggtcagcagggttgatttcttctgaggccaaggtacttgtggtgtagatgctgtcttctccctgtgttctcacatggtccttccctcagtgtgtgtgtatattctgatctccttatcaggacaccagccatattggattaaggcccacccatatgacctcagtgtaccttaattacctccttaagggccctgtttccagatagagtcacattctggggtactgttgagggttaggacttcaacatttgaattgtggggtggcacaattcagccagtagcaggaagattaaatgacttgtctgattagtcatacaactggtgatggcagaggttgaattgagcacagatctcctgactcctagaacagctgaaccactgcgcctgtctgcttttctgtgagcctccagacagcccatggcaggggaggaaccaaagagaaaaatgacttatgttgacagatggtcctctccagttttcttccctaagcctcctagaatattcttagaagcctcatccttttaccacggaactatcagaatccccatgtaaccacacttcattcctcatatagggctctctggcctctcatttaaagcattttaaacattgagggttttggctaggcatggtggttcatgcctgtaatcccagcactttgggaggctgaggatgaggcagtggattgtttgagcccaggagttcaaggctagcttgggcaacatgttgtacaaaaaatacaaaaattagccgggcatggtgaggcacgcctttggtaccagcttcttgggaggctgaggtgggaggttcacttgagcctgggaggtcgaggctgcagtgagctgtgattgcgtcactgcattccagcctaggtgacacagcgagaccctgtctcaagcaaaataaatcaaacccccccccaaattaaggtttttttaaacttggagacgctggacggttatggtagaggtttttaaagtaatgtatgaagcccttttaaattaagaaaaaaaaaatcctctcaaacctgcagtgttgatttaaatggatgtaaaatctttattttagtaacataaaactgggtatgtatgcttttctataagtgtatatttatataaatgacaatatattatgaagctcaaaaaagtttaagattaaaatttctataaaaccaattgaatccttgaaatacttgagagggatctgttttggcctggagtgctgcaatccccttatcgaattggagcatctctagtcctgggctgtatgtcttcagaacagccctcggaggagcagtgagttagttctgaagagctggagcaagctcccgaactattcccttttgtgtcccttgtcagatgacagtgtgtgcctctcacctgtgcaggtggagaagcactttagggaaagagcaaagcactgcacgaggttgtgattgctggtgctgagctgcatgccatcatagttctgttctggaatgtttagttgatttagattacatcttttagtctgatgtaattgttaatctaagaatgcttttttttttttttttttttttggtctttcaaagcaatttagctttgatatagctgaggaagcatctaaagtttgcttggcacaccttttcacataccaagattttgatatgggaactcttggattagcttatgttggctctcccagagcaaacagccatggaggtgtttgtccaaagggtaagtttttccatttcttgtgtgaatatgctgctgggattattaagatgattggattatattataattctgtatttaataagcaatttatctctgtttccttttgactttagcttattatagcccagttgggaagaaaaatatctatttgaatagtggtttgacgagcacaaagaattatggtaaaaccatccttacaaaggtatgttcttttatttctaaaagaatagtgttagagtttattgtagtagaacctcagttatatatttatgtaggtatttttttaaaaaatgtaatatatactgttttttaaatttctgcctaaataaaatttatgtatttttgtgggatatatgaaaattaaagcataaagaagaaaataaaaatggcctgtcagccttcttttgaaacatgtgaggaccactgcttttctcgaaccctctgtcctggacccctctgacctgcagcaactcttagagctccctgtctcctagtcctgcagtgcagctgtcattcaaggcatcccacaccctcttattttcagaaccccatggtctccctctttctcagtgccatcattttggtgtagtgtatcttgcaggagcttcctaagaaaacgtagatgacctgcatattgttgggatttcatatatctgaaaatgtctttattccactcttaagcctgattgataattttggctgagtatattcttagttctcatgttctctatggtcttctgtgcatgttgcttctaaagaatctgaagtcattttgagttcttatctttgtttgtcacctgtttttttctctggaatatcttaagatcttgtttttctccagctatgtctgttaaaatgtgtttgactacaaataacagaaaattaaataagcagtggtttaaataaggggtttatttgtctcagtcaacaagaagttcagggatagcattttctgggtggtacagcaactcagaggtaccctcagtggctcaagaacaagcaggaagtctttgtcctcatggatgtcacctcatggttttaagatggttctcttctgtgttggagaaaggaggagaaagagaacatggctagcctagtctggcccttctaaaaagcttctctggaggccccatcctggcttttgtttatatgttactggacagcactgggtcccgtggctgcccttagcctcaacggaatgtggaaagctggctattttagctgagtatattgctgtcctgggcaaaattagggctcattaagtaaggaagaaggggagagagatgttggtaggacatattagtatctgatatactgatttttaatttttatttaatttttattttttttgagacagagtcttgctctgtggcccagtctggagggcagtggcaccatcttggctcactgtaacctctgccttctgggttcaagcagttctcctgcttcagcctcctgagtagttgggattacaagcacctgtcaccacgcctggctaatttttgtatttttgttttagagacagggtttcaccatgttggccaggctggtctcatgaacccctgacctcaagtgatccactcaccttggcttcctaaagggctggttggtatactgattttttgactatgatgttatacttggtgtagggtatgggaaaacatttgcaaaagacacatctgagaaaagactgctatctgaaatatacaaagaggccgggcatggtggctcattcctataatcttcggcactttgggaggccgaggcaggagaatcacttgagcccaggagtttgaaactaacctgggcaagatggtcagaccctgtctctacaaaattaaaaataaataaataaataaaaatttccatatgtataaagaactgttaaaattcaacaataagaaaatgaacaacctaatttaaaaacagacaaaagagcagaacagatacctccaaagatatacagatagcagagaagcatatgaaaagatgctcagcgtcatatgtcattaggaaattgcaaattaacaatgaagctggttgtaggggtacatgcctgtagtcccagttgcttgggaggctgaggtgggaggattgctcgagcccaggagtttgagacccatcctgggcaacattagtgagatcctatttctataaaaaactttaagaaacccaacaacaatgtgctattactagtagcttattagaatggctaaaatcccaaacactggcaacacaattccaacaaggctatggagcaacaggaactctcattaattgctagtgggaatgcaaaaatggaacagccactttggaaggcagttggcagtttcttttctttttcttttttcttttttttttttttttggagacggagtttcactcttgtcacccaggctggagtgcaatggcgccatctcggctcactgcaacctctgcctcccaggtttaagcaattctgcctcagtctcctgagtagctgggattacaggtgcccgctgccactcccagctaatttttgtatttttagtagagatggggtttcaccatgttgtccaggctggtctcgaactcctgacctcaggtgatccgcctgcttcagcctcccaaagtgctgggattacgggtgtgagccactacgcccagccataagaatgtttatggcagcttaattcataattgataaaacttggaagcaaccaagatatcctttagttggtaaatggataaactggcacatccataaaatgagaaaaaaataaaaagctattaagccatgaaaagacatagaggaaccttaaaagcatactactaagtaaaataagccagtctgaaaggctacatactatatgattccaaatatatgacattctagaaaagacaaaaccatgcagactataaaatgatcagtgattgctagatgctgggggagggagggatgaataggtggagagcagggtaattactctgtatgatacttcaacagtcagtataagacattatgcatttgttgaaacacatagaatatacagcacaaagagtggaccctaacataaactgtggactttgggtgatttaaaaacaggtggtggcaggagcctatagtcccagctacgcgggaggatcacttgaggccaagagttagaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctggagtgcagtggcgtgatctccgctcactgcaacctccgcctcccagattcaagcaattctcctgcctctttctcctgagcagctgggattacaggcatgcgccatcacgaccagctaattttgtatttttagtagagatggggtttcttcatgttggtcaggctggctctcaggtgatccgtctgcctcggcctcccaaactgctggattacaggcgtgagccaccgtgcttggccttaatttctaaatttatttttttcttatggtactttgttttaggggaaaaaatctctcaaactgtgttttccctctattctcacatcacaaccatcatcatcaacacagaagacttgtgtgaccagaccaaacgtgtggggatttccccctacatatcaagcagtagacatcagctaggtgtcctccaattcaattcaaacactctccacccggaaatagtatcagatctcacagtttgagggcccagtcccacaagactgactgttccctcctccccaccagttacaagtctgagcctccagaacttctgaccaactggcttcaagttggggtttccacattctcctctttgggtctgattaatttgcttaagtggctcacagaactcagggaaaagcttaacttagtttatgggtttattacataggatattttaaaggatacaaagaagctgggtgcggtggctcacgcctgtaatcccagcactttgggaggccgaggtgggtagatacctgaggtcaggagtttgagaccagcctgaccaacatggtgaaacctcgtctctactaaaaatacaaaaattagccaggtgtggtggtgcatgcctataatctcagccactcgggaggctgaggcaggagaagtgcttgaacctgggaggcagagattgcagtgagctgagattgcgccactgtactggtcaacagagggagtctttgtctcaaaaaataaaaaaaaaagaaaggatacaaagaaatagccaaatgaagggatacatagggcgaggtctggaagggtcccgagtacaggagcttctgtccccatggagttgggatgtacctccctcctggcacacgaatgagttttgcaccttcctgtcaacctccatgtattcaaaatgctctctggaagctctctgaatcctgttttttgagattttatggaggcttcattacataagcacgaatgacaactgtgtagaaatgtgattggacaaaatgggtatgttctcatactaaccgactgagtggggaagcccaccaaggcctgtccagattctccttgacctctctgtgcagcattcctccctccacagtaaagggcaggaccctctctagaatgagaatgagaatgaggatctctggacccacaatcagattagagtcttgccttggatcaggtaaaaggaggacaggagaaggtcagagagagagattctgtttcctgaggattgctcctgagccctaaagcaccccaacattataacagaagaccgtaaccagggctacggagggttgtaagccaggagccatggacagaaacatacatgtgtgtacagtagctcacgcttttacttttttggagtcacaacttcttaatggcttgatttcatgacatattttctttggtcttccagaactttcctcttaaaaaaacacagcaaaaaaacaaaatttgatttgaaatttttgagatttttttttaagagtcattagcaaatccactaatgaattttccccaagcagttaggagatatttctcttcattacacctttgggatttgagtgcttttgctaaaaatttaagttttttttcccactacggttttaatatgaacatgtggaaagacttcttgtatagaaaaatgacttgcaaaatattattttttcaggttctatggagtgatttcccccccttaggaaaaaagaactcaggaattttaagtttatatgtatatatatttattttattttattttatttatttattttaagacagactctcactcttttgcccaggctgggggttcagtggcctatctcggctcacagcaacctccgcctcctgggttcaagcaattcttctggctcagcctcccaaatagctgcgattacaggcgcccaccacaatgcctggctaggttttatatttttagtagagacagggtttcaccatgttggccagtctggtctggaactcctgacctcaagtgatccagctgccttggcctcccaaagtgctggaattccaggcgtgagccactgtgcctggcctttaagtttgatattttattcagataaatatggaaaaaaaattttagctttattggcaaaatttattattcatatagaaatcatctgataatctgatagattaagtacagccctgcaactggattctaataaaccaagtcctctaggtcattaagattgttattggacatgaattcagtcattgagaaaataaaacattgttttgttgttcctcagttgtggtttttgttttttttttaagatagagtttcactcttgttgcctaggctggagtgcaatggcatgatctcagctcactgcaacctccgcctcctgggttcaagtgattttcctgtctcagcctcccgagtagccgggattacaggcgtgcgccaccacacccagctaattttttgtatttttagtagagatggggttttactatgttggccaggctggtctcgaactcctgacctcaggcgatcaacccaccttggcctcccaaagtgctgggattacaggtgtgagccactgcgcctatccgtactgttttttttaccccttgctttttttttcctttctgctgagatgctttaggttttaacagacatgtgattgggccgaggggcatgtgaggaggctggacaattaactacagttagcttattgcatttatcagcaccagattgtgtgtggttgaaatggccaaggtttgatgttttgttatgaatgttccagtatatcttataaattacattttcttaaattgatttgttactacttacaataatgtttgatagtattaaataaaatcctacttattctgttaaattcatataattggtagaagaatcatagtccggttattactcttttttgagacaaagtcttactctgtcacccaggctggagtgcagtggtgtgatcatagatcactgtagcctcagcctcctgggttcaggtgatactctcacctcagcctcccaagtagctgggaccacaggtgtgcaccaccatgcctggctaatttttttttttttttttttgagacgaagtctcgccctgtctcccaggctggagtgcaatggcgtgatctcagctcactgcaacctccgccccctgggttcaagcagttctcctgcctcagcctcccgagtagttgagattacaggcgcgtgcctccatgcccagctaatttttgtatttttagtagagacagggtttcaccatgttggccaggctggtctcgaactcctgacctcgtgatccacctgcctcagcctcccaaagtgctgggattacaggcgtgagccaccatgcctagcccacctggttaatattttttattatttttgtagagatagggtctccctgtgttacccaggctggcctcaaactcctagagtaaagtaatcctcccatctcagcctcctaaagtgctggtattataagcatgcagttcttattctcttgttgatctgattataaggctctatttaagacagcataggcccaactggcagaagtaggtgatggctggatattgagaaataatgttttctttgcatgatccttaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataaggtatgtgtgtgtcgagaattttttatgtggtttggaaagaggctgtgtataatgatcataatgagagctcagaaacgtattccattcctaggcgtttccctagggatggatgtgcaaattacaaagtaccttgaaacgtggttgtgtgttttggggtgaagcacggttcatctaaatctggttaaaactatcatttggactttgttgtcaagcttaatggtgtagatttgagctctaggaaaaattactaataataatggctttttttggagttctggatttcagggtctggtgggctcaggctttatgttaaaaatttgtcatttcatttacaagttgtcattcattttaactctacaatttacatgtacagtttacacgtttttattaacttttgcagttaaacacatagtttgcctgactacaagcctcatgggagaaaggcccttccttgtctgtcttattcatagctctatcttattcatagctctatctccagtgcctagtaggagtatctggcatgtaacaaatatttgttgaataattaatggaatcatttactattgggggtttctgatagagaatactagttgatttgtgatactgtaaaacactttcagagactttaagagtgccgtgactaactcttagagtctgaactaaaagttgtgttaataaatatctggttctttcattttatttgaagttaaacagcataaagcagtgtgaggaaaacaatagttgcactgctgagttaaagagggtcggtggggagagcttaaaggagtctgattctaatcacaaaagattgtgaagtatttgtcctgactcctattttgagcttggctgtgggctaatgtgcaagccttccctggacacagagggcaagattacttctgcttttccctggctctgacaccctgctttctgaaatttctgcctcctgttctttttgtgatctttgattgttgcatctcatttttttttggctttttatgtatattttctgcatctcattttctttggctgttatgtgtaaacagttcctctgttactttgcatgttatgttttatttttcctctgcttgacaacttgtgccagagaaacatttttctacccctttttgtctactcttccaacctgtcaaactgttgaattttccttctcttttcatagtctctgcatttctaatcatgttcactatagttcagtgctgcccaatagaactttctgctgcggggcgggggatgttttgtgtctgctctgcccagtatagtagccactagcccagtggagcaattgaaatgtggctagaaactgaggaactgaattgtaaattctattttatttaaatttttaataatgtttgcctgtgatgggagacgggaatgggcattaactgtaaaaggacatgagtgagattactggaaggatggaaatgtcctaaaattgacttatagcaatggtttcaacacttggtaaagttattagaaatcactgagttatatacttgaaatggatcaattttgtgatatgtgaaatatgtcttaataaagttgttaataagccaacaaacaaaaacagcagtgtgggagcagaggaaaagtagcgcggatgtagaggagctgtgaagtcataagttgattattgttgaagctggtgaggggcacgggggcattcatgataccatcctgtctacttcatagatgcttgaatatttctgtaatagaaactgtaaaatatgtgactaggaacaaaatttaagtagccacatatggttggtggctaccatattgcatactgtttctctaagtaataggtcatatgcttcttggttatgaggatagtgtcagaacttgggagcaaaatgttttactttgcagactgcctgggtggacatgcatgctgctgactcttcctgctgccagttctggggctcttcaaaacagccctgtaagaacttgccagtgaggcatggtggctcacacctgtaatcccagcactttgagaggccgaggtgggcagatcacttgagcctaggagttcaggatcagcctggacaacatgtgaaactccatctctacagaaaatacaaaaattagctgggcatagaagcacatgcttgtagtcccagctactcaggaggctaaggtaggaggaacccggggagttcaaggcggcagtgagccaaggttgtgctactacactccagcctggatgacagagtgagactttatctcaaaaaaaggaaaaagaaaaaaaagaacttgctaatgagaatggggcctgggaagaactttttttttctggagctgccagtctgtatcaatgaagaacaatttatttattttgtcctgagcacatcatatttagtctgtgtttttctagtttggttgcccaagtaggagtccccttgtaagaagataatgtgcatcttctatgttttatttatttattattatttattatgattttttgagtggagtctcactctgtcgcccaggctggagtgcagtggtgtgatctctgctcactgcaacctccacctcccaggttcaagcgattctcctgccttagcctcctgagtagctggggttacaggtgcatgccaccacacctggccaatttttgtagttttagtaggatggggtttcaccatgttggccaggttggtcaactgactggtcaacaaactcctgacctcaggtgatccacctgcctcgacctctcaaagtgctgggattacaggcatgagctgctgtgcccagcctatgttttaaatgaattccttaataaaaatatttttaactgatgaaaagggcttacaggacaaaaataaagtagttccttgacctagaaagacagaacccatcaccctctactaggcaagcctatgaagagcagtttgccacaggtggacttctctgtggacagatgacattagtgaaaaggaatgtaggacctttgagattgtaacttcttaggaaggtttgctgaacggaagaggaagtcttatgacaaggatgcaaacagaagctgccagatcttcagggatgtgtaggcagaaagccagagttgcgggttggtccttttatcgttagtgctctccagctgcttgggagttgtaactctgacaaatcagtgaagaggtcttcttatctgttcactgtgaattttaactccattttaacctgataaaatggaacccagagatacatgatgttgatgaataaacccaccaaaatgacaactgcctgaggccccgattagaataaccagaccccttagacatctgtactgtaacgacagatttgggccgggcgcggtggctcacgcctgtaatcccagcactttggagaccgaggtgggcagatcatgaggtcaagagatcgagaccatcctggtcaacatggtgaaaccctgtttctacaaaaaatacaaaaattagctgggcgtggtggcatgcacctgtagtcctagctactcaggaggctgaggcagaagaatcacttgaacccgggaggcggaggttacaataagccaagattgtgcctctgtagtccagcctggtgacagagcaagactccatctaaaaaaaaaaaaaaaaaaaaaaaaaaacagatttgaagatgttttttaaaaagccagttagtatttctgtgtaagatgaggtctttgctatctttctgaaagtagctcctttggtgtctgatttggtggttacaggcacctttggagggtctcatacacttggctctcaggggcttcatgattgttgtctggggtgaaagtgaagccattttggcatctgcagagcactttggagaccccgacctaagaagtaactatgctcagttttccctaagcctcttctttttttgataacttcaggaggtctggaaaatgaccgcagttttagagctcctgataaaaccctcagccttaaaagggagttatcctagtggttctgtactccagggtgggaaggtagtgtagagactttttgagacactggtcttgctggttgatgaaaatgtttaggtaacaattggggatttaatttatataaaatgtactattatgcctattactaagctcaaatatttaaacaactttaaacttggatcatccatataagtagccaaagaaggagaagaaaccccttctcctgcatttctgaattgttttgtctgggacaacattaacctacagaggttcttaattcttgtcactgcatgagtggcatgcctgaggtgaggagatttcaagtctgatggagctacgagctctctgttgtgctattctgcttgtccttaagtgggctttgactgggatgtttggtctcagtatttgtatagcttgcttaccttcgtaagaagaattatagatccttaaccaagttcacatcagccatttagcattctatggagggaggttcccagttccatatcagtggcctttggaggagactgtggtggccttgccataactccagggtggctctgatggtggttttacattaagagtttgtctctagagaagacacaaacattgcatgggaatacatttttatgatattattttgggtccttattgccttttttctctcaagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcaggtgaggagtctctccacagggattttgggaagttggtataacaagatgtccaaaataagagaagactgaacttgcaggggctttagaatcaactgaaaggggtgtgagtgtgtttgtttacatctacctcttttgcccttcacagcaagaaattgctttctgggcctggcacggtggctcactcctgtcatcccagcactctgggaggctgaggtgggagaaatgcttgagaacagcctgggcaacatagtgagacactatctcttaaaaaacaaaaaacaaataagaaaagaagaagctttctggaaagcagtgtgacattatgtaacaaaatccttgaccttgcatgctccttggtttagcagtcctatagttaaaagaatcttttttttttttttttttcctgagacagagtcttgctctgtcgccaggctggagtgcagtggcgcgatcttggcttactgcaatctttgtctcccgggttcaagtgattcccctgccttagcctcctgagtagtgggactacaggcacgcaccaccatgcccggctaattttttgtattagtagagacgaggtttcactacggtggccaggatggtctccaactcctgaccttgtgatccatccaccttggcctcccaaagtgctgggattacaggtgtgaggcaccgtgcctggcaaaataatcttttttatttaatttaatttatttatttattttgagacggcgtctcgctctgttgccaggctggagtgcagtggcgcgatctcagcgcactgcaatctccgcctcccaggttcaagcgattcccctgcctcagcctccccaataactgggactacaggtacgcaccatcacgcctggctgattttttgtattttagtagagacggagttttagcatgttggccaggatggtctcgatctcctgacttcatgatctgcccaccttggcctcccaaagtgctgggattacagaggggagccaccgtgcctggcctttattttctttttgagacagggtctcagtctgttgcccaagatggagtgcagtggcatgatcatggctcactgcagcctcaacctcccaggctcaatcagtccttccacctcagcctcccggatagacaggactacaggtgtgtgccacctggctaattttttttgtattttttatagagatggggttttgccatgttgcccaagcttgttgtaaagtcctgggctcaagtgatccacccttctaagcctcctaaagtgtggagattctaggtatgaggcaccatgcctggcccaaataatcttttatttcttttttttttttttttgagacggagtcttgctctgtcgcccaggctggagtgcagtggcgtgatcttggctcactgcaacctccgcctcctgggttcaagccattcccctgcctcagcctccccagtagctgggattacagtgtgcaccaccacgcccagctaatttttgtgtttttagtagagatggggtttcaccatgttggccaggctggtctcgaactcctgacttcgtgatctgcctgcctcagcctcccaaagtgttgggattacaggcgtgagccactgctcctggctgcccaaagaatcttttgggcaacagagataagatttaacaagggtataagatttaacaaggtttttttatggctacatcctaatagcaaaattttggaaacaatcaaaatgacagtcttgggatatgaatgttatcatgattctatatactggaatagtgtggaggaagtaggttacaagttagaaagttacccaggttttcattttttatatacactgatagaccagtgcctggcttagaagtaaaagggttaaacttcagttttctggtgaataattgagatttaactggatacagtgcatattaacgctgtaaatactgatggggagtagagttctggctgccgagtgtcttagctatggattgccttgtggccccaccttgtcttttttttttttccttgtctttttttttttttttgagagagtctcgccctgttgaccaggctggagtgcagtggcgcgatcttggctcaccgcaacctctgccttccaggttcaagctattctcctgccttagcctcccgagtagctgggattacaggcatgtagcaccatgcccggctaattttttgtatctttagtagagacggagtttcaccatgttggccaggctggtctcaaacccctaacctcgtggtccacctgcctcatcttttttttttttttttttttttttgagacagaatttctctcttgttgcctaggctggagtgcagtggtgcgatctcggctcactgcaacctctgtctccggggtccaggcgattctcctgcctcagccttctaagtagctgggattacaggagcgcaccaccacgcccagctaatttttgtatttttagtagagatggggtttcaccatgttggccaggctcatctcgaactctcctgacctcaggtgatccacccacctcggcctcccaaagtgttgggttgggattataggtgtgagccacctcgcccagcccatcttgtcttttttaaattaatgcgttaaatgaatgaaaaccaagggcaccaagatgtttcacaggtgattgctgtgttcccattcttttctcctatagtgtggcatttatgtgacctcacgcacattaggaagggacaaagtgtgtgcaggtagctctagcagcggagatgtctgatgatgtaggagtgggtgacggagccaggaggtcttccccggtgatcttcaggtcactgtaacgtaactgtagcgtttgatttgatatggggccataatttgaattgctctgttcctgtctgctgttcttctccagtgacaggaacagtccttgctgtaaaaactgtcagtttgagactgcccagaagaagtgccaggaggcgattaatgctacttgcaaaggcgtgtcctactgcacaggttcgtgttcttgttgcttccttggaatgctgtgggtcaagtgtgtgtgtgtctttgaaaaacaagattatgttttgttcagatgagagacaccttatttttaatctcatatgccgggttgagtttctggcactccttagtttgtgacacttggctttggtgggtttaagacctgtttctatttctctttcatttccatcactctcctctttctcctcacagacatccactctactgtggttaatatttgcctggatatgtgtatatccttgaaagatcatatagtgttattttgtgcatgtatgtgtttttaatgtgccaaaatgatattctaccttaaatttacttttaaaaaattcagtatcatgttttaaagaattacccatattgtgctacagataatataacaaggtttttaatggctacatcctaatagcaaaattttggaaacaatcaaaatgacaatcttgggataatgaatgttatcatgaatctatgcactggaatagtgtggaggaagcaggatacaagttagaagggtaaccagtttttctatatgtatctatatgtatttcactgttggggacacctacatattgtttagttatatgattggctgtgttttacttacaagtcaccaagtggtagctacttccattgccttcatccccttgatattccagataggacacagatcacatcctcctacgtcccttcaggaacctgtgtgtttctctgggtactgaggagtgtcattgtgtagtcacagaggcaggatgtgctggtctctagagcaccactgctaggttgcctgtgtctgaggactccttatcctgacgttctggccaacgcttggaattaccctgctgtcctattagcatgatgagtataaagtaatctcttgttcttacttttttttttaacagcccttgtcctaatgcacttacttacatttttcttgagcatctctttatatttttcagctattcagatttctcctgtgaatagccagttcatatatttggttcattttttaaaaattgggtttcatgttatttcactactgtgaatttggaggagttcttatgtaatcatccatttgggcatacgtctcctatctgttgccattctcagaacagaaatctttaacgtaatcaaatccatcattttgttgtgtgtgtgtattttttaaacacatggttcagaaaagccatggcggatggttaaaaagatattttccacagctgcttctattagcttcataagttgtccttttacattcaggacttgaatctttctggagctaacctttccaggtgtccagtatcttttgttcggtcaattgttgctttaaaaatttcaaagctatgttattactaggtatataaacggacatatctctacatctttatctgctgttccttaccagtatataatgttccttttttacccttgcgatgttttttgacttaaattgtcaaaaagcaatattcagtttgctattctagtttttttgttcctctgatatatctatctgtcccattcttatatttttcaaaatttgtctctcttggttggttggtttgattttgtaatagctttattgatacataattcacactcatgtagtttgcccatttaaagtgtacagtttaatgatttttagtatattcagatttatgcagtcatcacaattaattttagaacatttacattactccagaaagaaaccctgtatcctttagctatgatcctccaatccccccattccccacaactcagagcaaccactaaccaccctattctttatggagttgtctgttttgaacatttcatataaatggaattatacaatatggtttcgtgaccacatattgtatgactggcttctttcactgaacatagcatttttaaggttcatgtatgttgtagcatgtatcagtacttcatgtacttttattgctgggtaaattccattgcatggatatgccacattttgtttattcattcattggttgatagacatttgggttgcttccacttttttgctataacaaataatgctgctgtgaacatttatctatgagtttttgtgtggacagttcctttggatattattcaggaatagaatttctgggtcatgtggtaactatgcttaatcttttgaggagctgtcagactgttttccaaaatggctacaccattttacagtctcagcagcattgtatgagggtcccagcttctccatatcctcaccaacacttgttatcttttttattgtaactatcctaggttttgtgataaggatgcaaacagaaagctggaggtcttcagggacctagtgaatgaagttgtgtcctattttggcttgattttggttttccgtgtgcatagtatgacatgttgcccatgtttttatcttttgggatctgtcactatcacattactttgccaaatgttaggaacctgatggcccggcacagtggctcacacctgtaatcctagcactttgggaggccgaggtgggcagatcacgagatcaggagatcgagaccatcctggctaacacggtgaaaccctgtgtctactaaaagatacaaaaaattagctgggcgtggtggcgggcgcctgtagtcccagctacttgggaggctgaggcaggagaatggcgtgaacccgggaggcggagcttgcagtgagccgagatcacgccactgcactccagcctgggcaacagagcaagactccatctcaaaaaaaaaccaaaaaaacaaatgttaggaacctgaatatctaaatcaagctttaaagaagcatttgctagctatgctcaatgtttcatcttcactgtaataataaaatagattgagaaaaatgctttcttttaaataaacgtaagtaaaacaatttgaaaacgtttgttcttatcaaacagccttttgttcccttgatattttatacaaaatagtagatagcagaggataagttcctgataaggaatcagtattttctagcaggaaaagctagagaacaacaacctcaaaaaaaaaaaaaaaaaagaagaagaaagaaaaaaagcaattagcatttcacaaccagcagcagcagcatcacctgggagcttattagaaatggaaattgtcagtcccctccctggatctactgcatcaaaaaatgtgggaagggaggccagcagtctgtgctgtgtaaccttctgtcaggtgatttccatgcatgctaaactttggggaccatgctagatagatgataccattttcagaattattttcctacctgtctaatactctgactttagtcttttaagaacagatgctcaacagatatttattgagcattttttaatgtatcagggcagtatcatataccaaaaatacaataatgatccacaatataaaccttccctgagctcactggacatcatactttcagtaatagtttgttaaatgactgttgacatgatgaatgcccagtgctcatgaaaggttttatgagaaccagaggcaaagtgcctggttatctgttgggtacttaataaaccatcacttttgtttgaaactggccagattttctgtacattttgtgttactgctctgaaaccctctaagtcagaattcttttgattggcttcattcttcagctgaaaggccagtccagagctgtggatatatagtccattgctttcataaagtgttttttttctcctcctctatttgtgttgacttttagctacttgtgctattcattttccagaatgattcactcattccatcctgtctctcccagtttaactttctttggtgggttttctttggcattattggcctgggcacagtggctcatgcctatcattccagcacttggaaggccaaggtgggaggatcccttgagcccagcagttttacaccagcatggtcaacacagggagatctcgtctctcaaaaaaaaagaaagaaaattagccaggtatggtggcgtacgcctgaaatcctaggtacttgtgaggctgaggcaggaggattgccggaacctaggagtttgaggctgcagtaagctatgatcacacccctgccttccagcctgggtgacagactgagaccctgtctcaaaagaaaaataaaaagaataattgatttatttaagaaatatttgtagtatacctataatatgatagggattggagataacttaatagatttgatcattgctgtcatggggctttccagtctagtagagggaaaacagaaaataacattaaatatatatatataaattgcaaaacatatgcaatgaaggagagaaggagtgtgatagtgcataatggaagtgggaggccacatcaacttagcatcctcagggatatctcagaaaacctttgagacaaaacttaatccataagaaaagccagctaattgccccaaaagagtggaaacaccagcattccaggtagaaggaatagtatctgttaatattgaaggaactgaatggaggttgtcatagccaaagcagtgggctgtgggagagttgtgtgcgatgaagtcagggccagatagggaaggccgtggagttcttttaagccttcatacaaagtttgcaatttattctaagtaatagcacataggatattcttttatatatgactgtgagatgcagaagtggagaccatgcattctaactggggcttgggaggccagggactcatgcagcctagcctggcacatagccaggcactcccatttaaatgctgattgctggtgagatgcaggctcttgtcctagctctgtaggtcactttttgcttttgcaaggtaagatgctcacttgtatgagaaacagcgtattatgcacctgtagaactggtggacctgtgactcattctttttgttatgactggtgtttgcttccaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatggtgagcagttttattcccagtccagcagcaggagaaaacatggcctttgtctgccaggctcccttcctccatttggaggttgtgcgaatgacagcagtggtgagatccaagccgaggatgaggggatggggaagggcagggtggtgtctggagacagccatctctgcatgcagatccaccatacctgggagacctatcctgttggtgtttcttcttgctgcagtttcaggccatatggcaggctttgaggtgggagaggagggaattttgttgggggtgagtgggtgggtaggtagaggtgtgtcctagccttcctctgctccatatcatacaaaccacaaaagcagcagtagctatctacattacattggcatggaactaggatactcctgcaacaactccaccagagagagctgattccaggacctaaccccactagatgaggatttttgcagttatcaagaaggctgggtctgctcccctctgatctcttagagcagcctggggcaggagcctctctcctgctggcctgtcagttttccttaggtttctgtgctattttggaacccctgggtttgagggcatcctcatggactggtcagggactggctggactctgcttcccaccccacttaaaccatgggagtcgatgagggagttctcttgctttcaaaatagacagagagccaggtgtggtgactcacacctgtaatcccatcactttgggaggccgaggtgggcagatcacttgaggtcaggagtttgagagcagcttggtcaacatggcaaaacgctgtctctactaaaaataaaaaaaattagccgggtgtggtagcgtacacctgtaatcccagctgctagggaggctgaggcaggagaattgcttgaacccagggggcggaggttgctgtgagctgagattgcgccgctacactctagcctgggcaacagagcgagactccatttcaaataaataaataaataagtaaaaaataaaataaataaaagacaaagaacccggtagttaaataaaatcactgggttggaagctcaccatccatacagtggagtgaggaactcttccaagttcaataatgtgtaggtaaagaagataggttgagggcagtgtctcacatctataatcccagcactttgggaggccaaggtgggtggatcacttgagctcaggagttgtttgagaccagcctgggcaacattgtgaaacctcacctcttaaaaaaaaaaaaaaaaaggtaacacgtagcagatgccaaataaatctgttgtgttgaatgccaagaggcttggggtgctctggaaggacagagcccgacacagtaaaagtccaagaaatattttataaattagtgaatgatgaaaaggttttctttttttttttttttgagatggagtctcactctcgcccaggctggagtgcagtggcgcgatctcaggtcaccgcagcctccgcctcccgggttcaagtgattctcgtgcctcagcctcctgagtagctgggactacaggcaagcaccaccacatctggctaattttttttatttttagtagagatggggtcttgccatgttggccaggctgttctcgaactcctggcctcaagtgatctgtccgccttggcctcccaaagtgctgggattacaagcgagagccactgctcccggccttttctgaaaaggttttctttttgcttgtttttgtgttctagttgatttctttttctcctaagtatggtttaattttctggcatttctgccattcttatgtatgcccacatggctcacagatgcccggtgttttatcctgtgacctgtcagagctgttcttgggaggagttgtggagctttggctgcagggctcatgctcctggggtcactgagctccccacccaagggtggacagttgtgtcccagctgctctcgctttcagggagccagtgtgggccctgaggggcacactttagactgaaaaaccaaggattgaagtcagcagggtgacaagaaagttgggacaaagggaagcatttagaagagcattgtgaggggcttgaaggggagagaatagttagactttgaagagaggtcttgaatctagaatggatttttctctgcatttttttttaaaccttgtggcctctgtcactgaaggctgaggagtgtgacctcagaaactactccttggtgggggctatggatagtattagctatttaaataaaaaataaatgtgatttcttacctctttgggagcatggtcagggaggaaagaggaggcaggaggagaggcaggtctcagaacaatccagctgtcaatgcgtgttctctgttccagaaactgacaactcctgcaaggtgtgctgcagggacctttctggccgctgtgtgccctatgtcgatgctgaacaaaagaacttatttttgaggaaaggaaagccctgtacagtaggattttgtgacatgaatgtgagtatttatgtacagctttttctgtaacagccagataggaagtttttattttgtaagtacttgattttgcagatgaaaacaaatcaaaacacaagtggggctacatccttctggcccattgttatctacgggtattacttaggaggagaagacggagtgctttcaggtccctgcctgtagtttccttctgtggtgggaggctttgagcccagagactgagaaggactggggtggggactttatggtaaagttggttggtttcaggcagtgggtcctaattatgttttcctagattacttacagaactgactaagattgcaaaattattcagggtgtgattttgaaacaggtgctgaatgagtaggaaagacctagaaggctacttgacttacttaagccagacccttttgttctctagagaagcataatttttctcatgcagaatgatgggagagggttttaagatttacgaggcttcacagggagtctggctgtgttgttcactgtccactgtgtatgtgtagagtccttactggaatgcctcatctttagcaaactggtttccttgatttttgtctcctggtaattctaaatcacttgtaaaaatggagtaattatgaaagtgttaatgacagatgttctactttcttgggtactcattacgcggaagttattgccttgtgtcaaagatgggaaaacgtttgattttaatgaagccctttacatgtcagttatttttataaagctacattgcttctgaatacattgtgtttgggaatgatgctgtatgtatgttttttcttcatagggcaaatgtgagaaacgagtacaggatgtaattgaacgattttgggatttcattgaccagctgagcatcaatacttttggtaggtgatttccccagattacttactgagagctgagtcaatttctgtgatgacattagaaaagtgtgctttcagagtgatgtgctttaattctgcagtagaaggtggaactattcacagctttagttatgaaacaactttgttggctagaataaaatgaactcatagatagtctgtccccgtggagcttggatgcacagattttctgacaagggaaataaagtcaaaatactggcttccttctttacccaaaaatatccatgtgattagcataagcatagtttaatgctatagactgaatcctgattgatgtaagagtgtttatttgactgaatgctatatactgaatcctgcttgatgtaaaagtgagcctcatattttgcagaagcagggtatatcatgttgtcacgagtccataatttaatcacaaaaataatatccaggtaacaaaaactttgtcttcttaagcatttactagtagtagcattccatattaatctgttgacacagctactccaggtaacatgttgaatattctgcaatctcttcctgtcagccagtatatgagggctatttctttaaaagcacttggtatggagagatggtgtggtgtaatacaggcagcacagacattctgctctcggtagtatgtctagccagcagctctggcatttgacacaatggtaatatcctaagagcatttcactttagatttgtgaagtacttggtcaagacattaactgtttggaattgttcacaggaaagtttttagcagacaacatcgttgggtctgtcctggttttctccttgatattttggattcctttcagcattcttgtccattgtgtggtaagtcatcaacttttaagtaattaaatgttttatttaaattttgatcaactccaaccatgtaatctctggaaaaggtaaaacttgttcttagcaaagtttggcctgatatttccaatagctttttttgttgttattcctaggggaacatgtcttgtagaaagcttaactaatggtcttttaaaaaaaatactatttttgtgtgttggtgttttaatatataaatttcttaggaattttatacttttaagcataggagactgtttaactggatttgtccaggtcctttgatgagtaaagcccttattgaagagcattttcaggctgacttcgttgcaatagagcaaatatcaaacatcggcatttcagatgttccccatatatcatgtagattattggcagcagatggctatgtcttcagccttctgcacaaataggatgtagggactggggcccagctgtcatatagagtatttacatcttccccaaaaaataagagtaagcagtcttttctgttctcattcagaatcagtaacagctacaagttgaattgggctttgactaaggaactcctggtcctttataaatttgaggccctttttcataaatgttcttacgaatccattcacttgcatctgtggggaatggggatttgtctgctgtagagatgagaaagtcacacccaggcttccagacttgttttcccaaactctttcatagtggccttcctatgagcatttaaaaattccagcacaactctgatgacaaaggagtttttcctactgcctccttcctttcctttcctgctggcttctcctgcctaggggccatctcacagagcagctcttcctcagggtggtgagcatgatgggtataggaagatctctagggagcacttgtgctgaagaaagctgaaggtgacgtgcttgaagctttgacagatgtctctggatgacagtgccatccatcacgattgcttctattggaggatggaacctattttgtttacagggaagttgcacatgtggacaaggcacgacccttgatttcagagcaaagcctccgataggagggagggccatggcttgtttttggtcatagaatgcattgatggcacccagacaggaagcctagtcctggattcttggtccttgccctctgtcacctattatgcttcagccacaggcagggatggggcagcagatggccatgtggttagccttctgcagaagtaggatgtagggattgaggcccagttcctccagcagagcatggtccacagaaactgtggagacagctaagagagtgaggccatgggccggggcagtgcgaagaatgctgcaggcccagccacctgggtcttcctaccagttgcccttccagtcagtgcggtcctggtgtacccagcatctgggacatttgtcatttcatgcacaggaagatgcctttattattcccctgcccacagagggataaatttctcagaaaacatagcacttaaaccttgcctctttctgtacttaacgccaaaatgtatttcctttgagtgcaaaggaaacacttctagactggtggcataactaaagcttgggtgagaaatggattgtcatctgttgagcctgctatcactttctacaactcaggttctaagttcttcagttagtgttaggaatagcctgtgatgaaatagtactcactaactgaattgtatttgtagggaatgaccttcttgctgtttctttctaggataagaaattggataaacagtatgaatctctgtctctgtttcaccccagtgtaagtataccatatgaaagaaacataatcttcgcctggtctgaggccctgttaggcaaagaccttcacctgacccagcaagagctttcactggctgatggaaggtcatgttgcagcaggaagggtctaggttggaatgtttacccttctgacaacagtgatggtgaacttcgattagttgcatggatggacatttaaagagctgtgctgtccccttcccaagccataaggagtgatttagccattcaacacttagttaatattttgagttcaatttctctcttgggatcttaccttgagaggtttgaatcctcttttgggtcttcaaatggtaagtaagttttcaggatgcttgaaagctagtaattactgtttttgccattaaaagtaatggcattaattacttttgcaccaacctagtattttttagtcacttaggttgagtgagcctcacctagcacttttttcttagcatcacagtgccaacagaataagaggctgtttgatgggtaagggtggagctgtgaggacctccgattcatcttttattcctatcaatcaattgaacccatgtctttgcagaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagtttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctagaagggagagaaatcggttaaaggtgggtaactggccacgtgtggtagctcacccctgtcattccaacactttggggccgaggattactggaagacaggagtttgagaccctgtctctacaaaaaattttaaaaatacaaaaattagctgggtgtggtggcaaacacctgtattcccacctacttgggaggcgaagatgggaggatcacttaagcccaggagttggaggctacagtgaggtatcattgcaccactgagttccagcctgggtgatagactgtctccccccacagcgcgcgcgcgcgcacacacacacacacacacacacacacacacacacacacacacacaaaaaggccggggagggagggtataacttttctaaatgccagtgtgtaccattctctcatttgtggccctgcgacagaaatatcaccagcccctttcattgtaggcatctgaccagaggtgtcttggactacagtagcactgatgtgctatttacgtaggtgtttgaacacacagagaaccctgactagtgctatagtgctgtctccatattatagaattgagtttcatgaaagtcactcaccattaagtgagctgggacctcattccaggtcttctgaatcatatgacatgattctcaggttatttgaaagaaccttaacaggtaaatatggcctattaacgtaatcagcaaaaatgaaaaatttggtattaggagtgttcaggggccccatgagtcaatattgtttttgactctaggcaggtttttaggcagaaagaacttctaccatctaacctagaacagtaattgctgggacacaggagtccagtctccctcccattgccctgaact

SEQ ID NO: 12891 - DNA, 18472 bp, Human
  misc_feature (1)...(18472): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaccgcctgacaaaaagatattcacgaaaacaacaaagagacagagacaagggcccggaaaaggcaggaacagagaaagaaaagaaaaaaccaaaaaaaaaaggagcggcaagacaggaacaagcgcgaaaagacaaaaaaaaacgcgacagacgagacggaacgagcaaggacaagacagaccaaaaagaaacaaacgcccaacaaaaagagagaaaaaaggccaacaaaaaacagaaagagacgaaaacaagaacagcacaaacgagggggaggaggggagagaagaagccagaaggcgacacagaggagcgagaacacaaagagaaaaaagggccgagcgccggaagagggcgcaaaaaagaaaacgggccaaggggggggaggccgccccagcgggcccccgtccggccccgcccccgcccccgcgcccaaagaggaggaaaacccagcgcaaagaggccggcgaaaggcgcaggcgaaaaccagcggggcgcagagagcagagagccctgcgggcacccccccagaaacaagcgccaggaatccagacggaaaaaaaagagggggggcggcgggggagcccggtaattagtgtaaaccctttgtctgcctttgaaacccacagcttctcactcgctgcggcttcctccgcctggagcgcgggcggggagggcctgtggggagggcggccagacccctgatccccgcggcccgggaccggggagggcggtatctcccagttccacgtgttagtgacggcgcccccaatgtccccaggtccggacaggccgagatgacgccgagccccctgttgctgctcctgctgccgccgctgctgctgggggccttcccaccggccgccgccgcccgaggtgagttctggcgcccagcccggccagcctggcctccgccagcgccgcccccttcccgcccggccctgaaccctgccacagtgcccgcctggcacgcgccatgccccgcccctgccgccccgctcgccaggcccccttccttccagggccccctcacccatgggctgtccacagcacccaccggggctcccctagctggctggaggggttcccctcatgcgtgcttgctggccaggtgggctttagtcctggctccccaggacatgctcctggtcttgcaaacactttcatactcgtacctgcagtccagggcagctaatcacctgtggattcttggggagtgggcggtttgtggccacagtggacccgataaggactctgggaacctgcagagacccccacggaaggcaggatgggctgtgggagatattggtaatatacttggtgtctgggactgaaactgacccccagacccccagtcccccagccgacctagccgtgtgccctgggcctgcccagctctaggcaggcagtgccgggcggttgtgtggacaagtccccagagccgtgacgcaccccaggactgcgtgcctctgggcacacgctgtgctggcctggtacgtgctcatggcaccgacatctaagtggcagccatgccctgggacccagccccagcaaggacatccggagccgatgggtgacgtgtgcccgcagactcatgcccgccatgttccaggatccgggcacagcgctggctgcccccatggctaggcgggacctgtggccaggccggccctttgggcgtgttgaccactcaggattgtccgcgctgtgtccaccagtcctgaggcttcgcacccctcccctgccgcccagcaagcgcgccgcatccaacctggccttatatgggcacgttcgggtgctgggtggcgggcggtgaccaggtgggccttatgccacagcacccccccctaccccccgcctgcccacatgggcctggctgagcggctgctctgagggcccggcagcgtcctgggctgtgtgggcactcaggccatactgggcgagcccctaccatggccagcggcctggacttgcattctctttgatctgtttggcctccccaatccctacacctgcctgtcctctggccactcggccagggaggctctggaggcctctgtcctgccatgtttcctggctggggctgaagctgactggtggatggccacggtcagccatggcagtgggcggcagagcccgcctcttcgtggagacgccccagcggccacccccttcgccttcgtcctcctcagctgcggccttggggctgaggatatccagccctggctttgcgtggcaaaggccctggcggcactggggagctgggatcaagctgctttccaagggcaggggcctctgtggtttgggtggaggtggggaggaggttcttccggactgtgctgattttcctagcgtggactagggcgcgaggtccatccaagtgtgtttctcctgctctgaacagcccactgtgcaccttcgttaggccaaggaccagcatgcagagggcttgggttatttttgaaaagccatttcccgctgggtcataagttctggaatcggcacatcgctacactcagatcatattttaaaagttcctcttttcccaaactttcacaatcttggtggatttgtcttaaactgctttttttttttccaatttgaaaaaatataggaattggctttctccctttccattttatttctcacagtgggaacttgagaggttctgcatgaaatgtctttcacaaataactctgaaggaagtcgtttcagggctttctgagaagtgccacctttgaacttttgcaagcatggccttgggggccagctctgagtggcctgcctaggaggccactcccctgtcctctgcacccggccagctgcggtgggcaagctgagccctgacccaggtgggcagggtgcctgtccaggggtgccccatgcctggggggtagcggggtcagtgtcggctccctgtgggggcaagagtctgaagggttgtgattcggggaagcaatagccgtgggtgtacggtgctgacctcggcccccagccaggcctcagggccttcctccctcgccccaggcccttccgggcagtggctggcccgtgtgcagcgggctgaggtggacgtgtgggagctgggcccagcccctgcaaggtggggaatcgggccagccgccccgtttccatctcggggccccactcctggaagggaaaataaatcactgtccccttggggggagggagggagccgtgaacaaagtcgcctttggctgggcctggaaacgccgaccgcagactcctttatccattgtgcgggaatcaatgggcctccgggctccctttcagccgcaggccccgcgctgcggccctgtcaggggaaatgttggtttttccccagtcgtggcctccagcccctggcttgcccagccctggctcaggaactgcggccgtgctgggagaggcgggctgtgcccgcagactggaccccggctgctgcatgctggccctctgtgcggcccgggcttgctgctcggcccagggtggactcctttgccccatcagggcctccgccagtgactccaggcctggtgtgtccaggtgacagcctcagcgggtcagcacaggagggagagggatacccacacccctctccccagaggccccctccagggctgcactccctgcctgcctgccactctccctggcggccatccctggagctgctggtcaagccccagggtgcctggctgccctctgcaggcggctccaaggtgggccgcagccccagagccatgatccaggatggctggggcaggggtgaagcaggggatgggagaggaggggcttcacgggccaaggcatacctagcaggagaggtgggtaccagtccccttggagcaagtcagcgtgggtgggggtctccttccaggtcattgcccctgtgtggggcaggggggtgctgcccatcttggcagaaggctcaattacttcttgcctggtgctgttaaggggctgaggggtgaacattggctgagcagtgacaggaaagagggagccgggctgttgcccttgtgtgtggcgtggggcccgctgggcacggtgacaccctctgggcttctaagactgagccccaggacagcctggtggccccgtggagagcttgggttccttgtccaggcccaccagccagtggcttcaaggccctctacactccctgtagccttcctgccctgttcccagtggtgactgcagggcttggtgtggagcgcagtaccatgcaccagggtgcctgacgcaggcatcactgtgtgtcctggagggtctgggcggctgtgccctgtggcctgcaggggcctggggagctgcagcggacaggcccggtgccctcctgtccccagctctgtccttgagaagtccgccatgtgagtgggagcaagggcccctgacctggtggtgcccggtgtgcctgggctgctccgtggttggggcagccccacctgggggccaagagccctggcaggggacagagcatcagctcacccctgatctctggcctcaggggttctgggctcaggaaatgttcttgttgatgcttctgaagtggggaagggctgccaaggtctgcaggcagagcccctctggggagttccgggcaggggaggcctggggactgcagcccggcaggctggggttttgaggtgggggtgggggccacgtgaagctgggtgggcctggtgaggtctggactgggatgggtacggaggaatctttgcctgttttagtgctgtacaaggttctctccagggcgtgggactgcctgatgatgctctggtgcccgctgtgtgccctggtgtgtcgaggagggggagcagtgccctggggctggggttgcagaaggttcccccgaatgcttccagggctgggcagcatggtgggccacatgctgcatgcagcttgctggggcacagcctgtggggtagccacctgtgctgcaggcccccagttcccccgcacgtcctgtgggtctgctccccgagggccgcctcgctagctggtgactgtgtgtgccctgggtctgtgtatgcaggtgcacatgtatgtgcctgagcgtcccggggctggggcagagcctggccctggcacctgatgggcagcaggctgcgtggcggtcacctgttctctggctcctgggggcggccactcttgcacttggcttcctgaggaggggactgggccctggcactgactctggggtttcccactcactcctgccctgggtgcccctgggggcctggcacagccacatagcggccatctgtgatgggggcactgtgtctcttctcggtaaccgggtggggggaccaccggctgcagaaggctcagcacctggattggctctgcaccccactaggggttcgacacagtgtgtcctgattcccctcccctcccttctggtcaaggtgagcccccttcccccaggccactcagcttctccaggaggacttggggcctggccacccccaccccgtggccaggtcctgggtcaggccagagaattcctccagctggaaactttgggccatgcagggccccccagttcgcaggcatcctcactccactctggcctcgttggctgccaggacgctcttggtccagctcctccatgcgggaacttgggtagccggtcagggttggggttgagggggccacacagccagctcctcagcggtcagctccacctgcccctccctccccagcgcacactggctccgtctgtccccacagacgccccaccctgctgtgttgttgaccagcatcagcccctgccgcagtgagtgctccttccttgggaagcccccgttgtccctactgggtcaggagtcccgtccgacctgggcaggtgctgcctcgggctctgtagaggggtggataccactggcctgggctgtagaggcgtcctgggaggtgcagggtgcactggaaagttggaggaggccgtttccagccagtgtcctggtcctagctcgtgtcttctcccaacagaggggtcatgacgctgcacgtgtgtccctgcctgggtgtctctccctgtgctgagggctgtgttctggggaagcaccccctccttgctccctgtaggagccaggccccatggggaggagccacctggccacaggagggaagccgggcagccccagccctgcatcctctgtacctgccctggccggcccccacacccacaccgttctccctacgaatgtccactgagtatctgctgtatgccaggcctcgggacaccacgagcacgggagaggggcttgggtgtgggtttggaccacgtggccaggacgggcccttccagaagagatattggagcccccgaggagctacggggtgaggggtgtcggagagggcacttcagatggggcaggtgttcggggagctgatatgagggcctgtgaagacggggaagggcaggccgcagggggttcctgcctccgtccctccagactgcagcttcttcccctccatcccagggcctgcccacctccaccctccctgggccctgggaaagaggagcctctgtctggggacagtgtgtgtgtgacaaagcgtgtaggcagagcggcctctgggccttgctgctgtgggaagcccctgctcctcctccttccctagttgtgttttttacagctgggcaggggtggggggggcggcgggaggatttggaggcatccgccttcttggcgcactgcctccgagtctagtcctccatacctgacagcagtgaggccctgtctcagactcagtttactctcatgtctcgctcccatgtggcccttggtgtcctgcctgtgctgggggcctctcggctgtggctaagtgtgtgtgcagggcaggggctgtgctggaggaggaggctggggggtgtcttggcagggtgcacggccccggaggtggcacagtgctgctgtcatgccccggcgggggttccctgtgtttcttcctggctgcagtgcgaggcagccggtcttcccaccaggtgcctgtgccctcaggtcctgactcagtttccccataggctgcgtgggttggacgcccgtccaggtggcgtggtgccctggccgctgtcctggtgtgatcattccccaggaatctggggggatgggcttcctcctgggcaggccctcctgcggggggtcttgggccggcaacagcagggggtccggggagcccaggtgggggtgggataggcctggcgagggggagggaggctgtttgctttaggataagcctggctcctctggcccagctgcctctgcccgtgcctacagcgcttgcaggccggccctgggggccacgcttccggccatccagcggtcatttgtctctgccccctttctcagtggtgaccacaggcgggggtcccgcctccctgtctgtgcctgtcatcctgcacctcccgcatgcctttggggacccttacctcaccaagccttgcttgtatctgcctggggcagggtgggggctgggaaaccttcccgaagtgtagctggggctttcagcctctgaggtgggctccctccccagatgtggggggctgggtcagtgtgctcccacccaggacagggccaggcactcgctctcttgcttcttctggacagttgtgtgggtgaacacttgtgtgcacccatgaacatgcacgtgtgaggcctgtgcccaggtagccagccaggaggcccaggcacccctgcaggctgtgggccacaggggctgggctggccaggggccttggccactcccccttggtcccgggaggccctgtgggtggtgggatttcaggcagcgacaggtgctggtggggtcaacctggggtgcgtctgggacctgggccggctgggaaggggtcaggaggccccagtgctgtgggccctgcagccgcttcctccccgggacaaatttgccagagctgcccccagccctgggcagctcacagaaccacactgagggggtggtgggctggcagccccccacagccgccgtctcatttcctctccggggagctgcagggagggtagggaaggaggggcttcagggctggggcccatggcctgggtgggagggtcctgagttgagggagagacgtgagtcagagaagagacccccacatgttttctcagagaggccaaggactgggatgggccgggtgagccagggctgagaagaatccctccctccagagcctcagcccaccctttgtgtttctgggcacagcagggaggcgccgtgtctccactcccagccccagcggccaatgatgcctgtgggctcagaacctagaggccctgggcaacgccccctgtgctatcagcactgattgggaggcctccagagaggtgatagggattctctgtgagggtccctgtccccagacttgggggtcagaatgggagctgctccctgagtgtctgaagacgccagtgggagacgtcacagggccactgttaactgtgtattggaggaacacgcggccccaggccccatcgagatggcctggagcagctgctacctcttggtgttctgcacgcagcctggacgctcccagacagcagtggctgcagtgcgggatggacactgtcacccatgggctggcgagagatgccctgggaactgtggggtgcctgcggccgcctctccgacatggagagcagtgagtgggctgtggtcgccgctgcaggacttgggagcagcacgtggggagtggggcacgcagggccctcctttcccaggagctccatccaggtacaggccctgcggtgccccgagtttctgaggcctgcagggtctgtgtgttctaggttcatcttcctggccggcttggcactgcccactggggctggtcacacacacacagaaccctggccctgccttccagcccagaggcacccaggcaggggatggggtggggtggggactgaggcaggggatggggtggggacccaggcaggggatggggtggggacccacccagggaatggggcgatggggcaagggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtggggtgggatggggacccaggcaggggatggggtggggcggggacccaggcaggggatggggtgggttcctttctgccaggaaaggaggcctctgccaggaaaggagggctcggcttctccacatagggtgggatggtgcaggtggccatgtggagccgcagcctttctgctcctgtgggtttcacaggtggtgggaggacatactggctgccccccagacaggagcggcagtgcccgtggtcagcccgagctacgtctctccagaggcttgctctctgaccccagggccttggggtcatgccccctcaaggctaaggtgcctggcagggtacggcccttgggggtgggcagacagacctgggcatctgtggtccctgaactcaggtctgatattgacacagacgtgggtgctgcacagactctcatccacacattgcacaggctcaggcagcccgccgtgctcggttgcttgtggatagctgtggggtcgctggcccatgcccaggcccggctgggccctgggctgatggttgggtgggaattaggtgaggggcctggggctctttgggacccaccaggccccccatccccctactgcccttgtccttggggggccactgtcccctctgacctcgggtgtacggctgcttcctgtatgaccagaaggagactctgcccttttggttggtggttttcgagagttaccaagcgcagctgttttgcatcctctggggaccctgctcccttctcgtgtctcaaagagccagcctctggggccacggggctgccccggccatgagaggctgctgacgtggtgtttgctgggccagtgctcagggctttggtgcatgtgggcagctgaggcctgggtcaggggcactgcacctcggcccctctgctcatcttgggcaggtgacccaggtggagctcaggcccgaggtctgtgctgggccgtgggtccccttttgaccgcccccccggctccggaccccaagcccctcctcgctgactgttcctcggtcccacccgcaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggtgtgcaggagggcggacggggacacacctggggcccgagagtcagccagcccccggcagaaagccttccttcggtgccctgccccacctcagctggctgcacctctgccaccatcccccaggtatcctgtcccgttcctgtccccgtcaggctccagcctcggggccttcctcccagcggagggcggagggtggagggcgggagccgaaggcagtggtcccacagaagggctggggcccgaggccttggcagggtgtgccggccgtcggctgtgactttgaggctcgggtttcggagttcagaggagccgccgggatgcgtggcctttctgttctcttctgcgcctggggcccgggcgctgggcttggacaggtgtccagagagacacgccctccatacctagggacccggcaccccgcctgctccgctgggctcctgggtgtggggccctcgggtggagctcctgggagctgggctggcccgtttcttttttttttttaattctactttaagttttagggtacatgtgcccgttttctgaatacaggagcctggcccaggccccagcagggtctgggggtgcggcctgagacagcctggtcctgggctcagtgaaggagcggctgtcacagggtggatggaggggacattccacagcacgccctgcccctcggcattgtgtggaatgggaaaactggctgtcccccacccccaccccacagtcctttcaaaggggacgatgaccgggtggtatgagagtctcgtctgttcaccagccctcggccccttgatgtaggctagggttactgcagctgctggccgggcccggctccctcctcccccggggcctgcagaccccccggagccagaatgggggccggccctccagccccacccgtgcccatcagggtcacctgcgcccagtgtgggccagcggcccttgcccagctgtccctgggattctgggctgtgggtgtgtggcgcagccccctgcctgggtgtccagggctgtcccggctggggctgggggagctagaggccacgggggagttgggggagctcctcagggcccccctcacctgccctccctgtgcacctccgtctctctgcagatgacattagcccagggaaggagagcctggggcccgacagctcctctgggggtcaagaggaccccgccagccagcagtggggtgagcagggggtgacgggggtggggggcgtccgtctgtcccggccccttggctgcatccccgtcctctgacctccacgccaccccaccccgcagcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccgtgagtgtggccccgggcgctggcgggcggggggtgctggtgggcgggggcgctggcgggcgggggtgctggtgggcgggggcgctggtgggcgggggcactggcagggcttgggggtggtgggctgggggtgctggtgggcccagggtgctggcggggtagagtccggcgcggcccaggagccatgcccgcgtgccacgttcccacagagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgcaagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctccaggctggtgtttctgcccatgtctacatgcacgtgtgcatgctcgtgtgtgctcacatttgtgcctgtgtgtcaggcctggtctccagaaccagcagcctaaccctcttggagtcccctcgctgggccagagccacaggggctgagaactgcacctcccggcgggagagtttgggtatactgggcttcggtggtgttgggcgtgagcactgcccacatgcctggccaggcctgcgtcctgcacccctgtcccagcggcgccctctctgtgtcctggggctggcacctatggccctcagtgcagggcctggccactccccagcccctcctcaggctttggtgggtggccctacaggaggcagcagactggcctcagagctggggatggggccaggctcaggtcacctctgacctcagggctccgtccgagtgccctcccagccaccctgcggtgctgcgacggtggccgaccccatcttacccggtcagcaggaggggtggggctgccagctccacccggggcccttgcctgccgggggttccgttagcctcgtaagaaaaggcacgggggcccctcgtgcattcagcaaagcgtgaggcccactgcgtccccggagcctggtcctgctggcgtgcagcgcgcttcctgacccgctctggttctgagagcttttccctggaggaagctcaccctgcctggcttcaaagacgacaggtgggctctggggagaggtgtcagggacctctccccaactggagcttctggggaccccatggctttcaagatgtcccctttttgttctctgtcctccccagggtagaccctacttctctcccctgaggaagtcctgactccttggacggtgacagcttcaggcatggccctggtaagggctgcgtgtggctgatgggtactgtgggaggcctggccaccctgactgggggacagtgggggctccacgcggcccacagctggcagccaaacagatgttccccagacaggacaggctgcaggccgacgcctggtcgggtttcagtctggagtaggggagggtggaagggagacctcaggcgtctggccaccttgggcagcagggaggcctcaggcagcgggtcatggggttgcagaggacaggctgcccctccccagggagtgggcggagggatgggcagtccgagagggctgtcccctagagcctctgaaggagacactgggaccgcagaccccacgcctgcaccctgcctgctgtgaggtccaggcccccactcagggccacccttgacttgtggtccagcccatcttgcgcctgcccacaggaggtgctgactagtgctgtgtggtcctcaacggacaggtctggcacagcctagcctctgggtcttgggctctggactttgtcatgctgtggccacgttggatgccaggctgggcagggggaccccaaggagtcaggacagacccatctcctgcctatggggccccagccacccccgggccaatagcctggagctcagacccctcagtccttccctagccttcctcaggggctgcctggagcccctgctttctcccctgcgacttccagacccttcccccttggccgtccagtcccgagagccttgctcccgcccccacgcccctctgttcggcggtctccagcctgagcctgccggggccctgccctgtggacgcctggcctgtgttcctggctgtctcttgcctggccctgccccgtggactcctgtccccgtggctcctgtccccccaccagccacacggccatcccgatgccgtttcccgcatctccgtcacggcagcacgcgtctgtgccctgcgccggctccctcgtcacatctgcacgtccacactcccaagaacaaaattgcgttcccctcccctccacgtgcaggaggcctgggagcacagaggccccgtgtgcttcgaggacttgaggcaggaggcgggcagaggcgcccagggcgtgagtgtggccagcagga

SEQ ID NO: 12892 - DNA, 49559 bp, Human
agtctacccatatgcaaaatgggtatgataagccttgtattgccagattgttggcacaacaggagctcaataaataaaggactctcaagtggcttaggtctgcgggccagtgaggcgcggttcccattgggcatggagtggggggcggctggagcctgcgcgctcctggcttggtttgcggaatatctttattaacgagcacttcaaggtaagccggcgatggaaaccagatgtgggatcgcgcggtcggcggcggagcaaggaccagagatactaagggggtagggtgggggtaagaattagcccagatgagattgggagcagaagcgcgaccccccaggtatattttttctttgggagaccttagatgcagaaagttgacatctgacccacattccttggttcacggtgctcaggccctctttaattttaccttgcacttttacctctcaccctactcccagactccctagaggtacgttctcgcttaacgattttctcagcggtttaaggaaggctgctctcgctggtctccttcaacttgaaccattccacagccgggggccagtttcccctctgcatctacgctgtccgcacggccttccaggtcggtggagggactagcctgagcagaggttccagggcgcgacggctatttcccagctgtgtgacctggaccaggtggccgcccctctctgagcctccgttagctcatcagaaaattgggggcgccaatctctagcacggttgtcatgaagcgaaatcgaggggctgcacgcgcaaagttttttcccttgctgtggcggtgccaggggccttgaggctcgcagtggtggtgaaaccacaacctatcaaaaccaagcagttcgttttacagtcgggggcagtgaggccagaaagggaagagacggtctcacccctctccccgacccctgaccccaaggagtgaacaggtgacagcgcgactatcgggcaaggtcagggggtctccagagtccgctctctgtacttcgcctggcaggaaatcccctcgcctgggcgcagacgtggggcgtgaacggtgcggcctctagacgggagcgcagagggcagcgctctaaagcttctgaagccgggcccagcccagggcttctccagggcttgagggagcacagattccgctacatcccagcccagcgcccttacagcagagggaaatagttaacaagacgtgcaagtgaccatgcactggacgacgaaggcttgtgtgtgtgttaatctcccgtaggaacgggaatggggaggaaggttggaaacctaggaaaaggtgccagcgggaaggcccgcagcggcgcccgcgagctcgcgcgcaggagtccgtaggactcgcttgcatccgcaggcccgtggtccccctggcttcgaatgtcaaaacctgttaggtttattttggggggcttttttttaacctgtcattaaaatttgcatttccctttgccctaaggcaaagctccgacaccccgccaattctcagcctagcctcgggagccctggggatcctggcacctccccagccccgcctagaatcggaaaagccctcgggcgcctccgggttgaatccccgctagcgagttagtagcatctccttaagagtggagaggagggggcaggggccagtggaaggagagaggaggaggggacgagagagggggaaaggaagaagcaaggcagggaaaaaaatttacttattttttttttccgctgcaaaaccttaagagggtttgggagatctggtcaactttccgaaacatctgaatctttttactgccctccgttctttccctcggctagctgtggggagggaggaaagagagagagggagagagagaggaaggggggggagggaggggaagagagagagaggagggagagagaggagagagacagagaaagaagagggggagagagagagaggccggcgtggaggggaggagggagagcgagcaggccgggcaaggagtgcacagccacagcctcctcgcctccccaaactcccagccaaggcgcgcggtggcgtcctcgcgccctcgctcgcgtccccgcccgccgcctgcgcaagccaggcatgaatgctgagacttgcgtctcttactgcgagtcgccggccgctgccatggacgcctactacagcccggtgtcgcagagtcgggagggctcgtcgccttttagggcatttcccggaggcgacaagttcggcacaactttcctgtcggccgccgccaaagcacagggattcggggacgccaagagccgggcccgttacggcgctgggcagcaggacctggcgacacccctggagagtggagctggggcgcggggctcctttaacaagttccagccccagccgtcgaccccgcagccccagccgtcgccgcagccgcagccgcagcagcagcagccgcagccccagccgcccgcgcaaccgcatctttacttgcagcgaggcgcctgcaagacgcccccggacggcagcctcaaactccaggaaggcagcagcggccacagcgcggccttgcaggttccctgctacggtgagtgcacgtgcgggtcacctggtgctggggaccacggggtgcttggcttccgcatcccttgaaactggtggcttgcgggaggtatgagttggcgggctgggggcggggtggtgactctggtcggtaaacgggatcgatcgctgcgagggagccaagggatctgttctgtctccttcttgtccgccggcctaggcacggagcgtttcggctgttaaactcgacttggagtttgtttttcccggtcccttcggcatttccccaaaccgctcgctttgcgctgcccgctgggcgggatttgaagcggatgcttcttaccggcccagggcgtgcggcggcaaggagtctccgcgcagcgctctggcgctgggctgcggggctgcggggcggtgctgcggggctgcggggctgcggggctgcggggctgcggggctgcggggctgcggggctgcgggacagcaggactgcagaggcctcgctcctcgccggctgggaggctcctcgggcggcgccgccgcaggtgagagcgccgcaggtgcggagccaggcgggaagcccggagcgtggttggccgaaagctcacgggaaatccaggcgcactggcgcaacacagtgcggagccagagaccctagggtcccaggggacactgtggtctggaaagacccgagtcctgggaccctgagcgctactggcagtggggatgcgggcaggccagttcccctggagcttctccctcggcgattcttggaggcggcaggcctctgaacaatggtttaggacagagtaggaagggagacaggaagtcccgagtcccaggtggcccagagctgtggcaagagagaagggtctgggtcctgatttgagcccacggggaacccgggggagctggcctaaatgacctccaagctgccttgaacgcagccacaggaggcaggcctgggccccccagagcacagccaccattgcccgggagagagagacactcaaggacgtctctagccagagcagctcagtagcctaggccttctcttcttccagagaatcggggttcctgaaccccaaagcggaaggggaagcaaagacgcagaaagggaaaaaccttctctgggccaggagtcctgagcacatacccggaggccttggccttcaggtccggccctggtgggaagagttgggggcagggaatttgccctgatccaggctgatggagaggcactaggcctggggacagaggctgggacacggcggaggccttggtggctagaataactttgggaaaacagccgatggcagatattttctcgtattcaggttccttctttcacaggcgcagaactagttcatagatggctgctgacaaacattcacagtcatatgcttgtctacaattgcactctacacacacacacgcagagagcatcttctttaggagccgatgtggtcataccccaagaacacatgcccatgtggcctcgaatgagccacatactcccaaacccataggacagaactgagagaagatttagaaagattcagtggcccttccccacttcctccaccttcctcttcacctccagttggaatgagatcaggcattcagatcacagacccccaaggctccacacacagacacccacagctccacatgcaggcacacacagttccacacacagacacccactgctccacacacagacacccacagctccacacacggacacccacagctccacacacggacacacacagctccacacatggacacacacagctccacacacagacacacacagctccgcacatggacacacacagctctcatacaggcactctttccgtgctaagccagcagagactctcagccctgtccgtactggctgtccttcccagcccagggatgcaggccccagctcgtccctgtcattcaggactattaggtgagggcaggtcgcagactaggggacccatggaggttcatcctgcatagccagggagctcatgctctctctccactgcattgaattttcatattttaatgaaaattaccagtgagacctctgaagaggctgatacattaggcaagaagagagcctaaggagctccccacctcttggttaaatgccttcaggtccagagggaaggcggagaggcctggcctcccctgagccctctctctgtgtcctgctgggcccccacagccagcctggcccttcctctacttgcactagcctttggagctgacggaaagggccagccacttgacccgctactgcccctaacccgtggcagtgtgacctgacagcaaacaccttcccaaaccccggtttcctcatctgcatcctggggtgataacagaaaggccttactgggtcataaatgtgcctctgcagagacagcaagaggcaagagcaagagcccccgctacccctgcccctcccaacccccacccacatttccatccctatctatctccgagccgctgggaactcgagagcacccaattctgaggacagggcaagtccctgccactgctctgggtcataaactgcaggctgggaccaaaggcagcctgtaactaccggcaggacgccactccatgctgcctaagatggaggcactgctcggggcaaagccacaaacaataaacagcaagtcagtgtttgttctttccctctctcagcagctgagtctccccagccaggagatgtctggtccttctaggaaagggattgggcgcgttaggtctaagatggagaaactgaggatacaaaagatgaggctctgcccttaacagaagtagccaggaggagggactctggagtgggatccctaccctgccagcaagcaggaaaactgaggcatgcattgacaacgattctctcccacagttgtgagagtgtatatactcaaaagcggagaaatggagttcaaggaaaaatccttagacgctcccaggagcattgggaaagtcggaggcaggggcggccttggtgccagtactggcgctggctgatctccgtcttcaggcaggcagctgagacctggcaaccattcctagccctggaggtcggggcgaaagctgttctttcacgtgtgtaactacacctaacaaaagggggaagctcggaggcctcttcctgggcctcaacttctgggcccactcccggcagagtccaattgcctctcggcaaggaaggtgccccgggcagctgagcctgggccaagccgagggagtgcggggcggggaagccgcctccagtctctgctggccgggtctggaccgggttgcggaaagagttggtgagagaaaccctcccgggctgcaagcgtccctaccccagcttgggccttcctttccccagatgtgctaaaagaacgacgattaaggcggctccgcagtgtcctttgggtgcggagaccgcgtttttacgaaagagcccccaccgagccctcttctgttgcaacccaagacttcaccattctcccctccagactctgggtccgctctttggcctcctgaattccttgcccgagtccagggcgggccgcctgggccacaggagacatgtcgggttggagatccgacgtttctcagcgacgcagagagcctccctgtactcagggcagggactccggcgcctcgcccccaaactccggatccgaccgccggagctgcagccggcgcgtactggtcctagtctacctgtcccgagacgcggggccgctgcgggaagctgcccctcttctcccttccctttcgctttcgattcggtggcgacaggtttttgttgaaagcagattgttacctctccgtccacccacccgcaaaagcagcgctctcagcgccaaggtctggggaggcgcgggccaggttggagcccctggggtgccgcctaggggcccagtcccgatttttcgaattagactcagtggttaaataccagagggtatttatttcccctgcaccgacacaatccatgcaccacgaaatgtgtaaattctgccggggtcgtatttgaatttagttagagaactggggtgtgttttgtatacaagagacgacccaaagaaggcagaaacgaaaacccgacagaagcagcaacagctgctgtgggtgactgtggggtgatcgcaggaaaactcgagcctgggactgaagcctgctcaggaaggggcgactgttgtttaattttggagggagggatggcgaaggaagatgcttttaattttttactttgttaatttccatagcctgcttcaccagtctggtccaaacacaaaagttgttaaatagaaaaacagagggcctggattaaaactcaatattttaagtcaatcgacttgcacgatcttgcacaatcttttctttattataatttacatatagtgaagtgcttagctctgaggaggaaagttggaagaattgttatgtatgtgtacactgttagttaggacgaccatctcgataaagaaacagaccatttacatgtttccttaaacgttgtaaaacgttaaagcaaaaacattttttgtaagttgttttaagaaaatttcagaagatacttcggagcaccggggaccccattttgttcctgacagcagtgtttcttgaatagggtgacacttcagccagggcatttgcgcggtcccgattctaatgcgaagttccaagcggctgcgccaggaacctcgccgcgaccgccgggctaagccggagtcaccaagccctgagccgcacgcgctgcgacgccggcacgcagtaggaaaacagattaaaacgccctacagaaaatctcggcgaagtcccggaggactctggtttctaagatcagctgggcgcactttctccgggacgtcccttcttctcggtctcagcgccttcctgccctcagccgcgcgcagctttgttttggtggcaaactgaaataagaaatggaaatatattggcctttgctgctgccagggatgagaggttgttgacgtccggcgcgtttgtccgggcttcgggcttctctgcagacccctggactggggtgcctgaggccaggagaggagggggatagttgcccggagcccccgcggctcagaggccttgggatgattcatggggggggcgcgccctgccttggtgagcctctcgccccgagggtaggcgaggtgggtgggtaggggagtgtatgccggagagaagagagaacgcttaaccagagagaacttcctgcccccggagcctcagcgtccttagccccccaaacccctgttcaggaagccgaaggacctaggcccaggcaacggtttggggtggggcggtaagagcgccgtcctgcacccggacgtcgcctgccaggcgccacctggccatgtgcgcccgcagcgcagggttctccggccatcagcacaggtcctcaccgaggtgacagtcatcggattgggaaaccaacactgcgaggacccggctatgtgatgataccgtccgggggaattcgagtggaagccgaccgtcctgtggtgccactagacaggtgagaagcagcccttccaaacagggccctttgctggaaggaggaggcacctctttccagccagtgagccttcccagctgcaaccggggtcttctctaatatcagttaccgcggcctccagaggtgcagcccggcacacctcttctctgcagatgtataaaccggggacacccccatctccattcaagatgctccttcctcacccagtagaggggtgcggagtaaacccgggacaacaacttgcgtgctgcctggaagcaggtccctcagaaaggatgacaaaaatttggtgatgcggaagaagcttccactgtgtccaggaaagggcagcggccccctagttgcaccggccctggccccggcccccacccccagcacgttctgtcaccttaacaaagaccggcttctccacctgaccccaacccgcaccagccagcgccgaggaaagagaggaatggaagggagttgtggctcagcggcgaggaagagccacgcagaggcaaggctctgaggagccaaggctggggtgtgtagggtggtactcagggccgcggaccggttcggatttggactccagaggcagttggaagggtcaccgtggcgctccgcggctcccagggtgccgttttggtgaggagggggtcactgggagatacgggcggggtaagaggggccaccggctgccaagtacctatctttcccggtgaaggcgccgcttgtactcgggaccgcttggtcaaggctgctgggcactggcgccgctgcacattgggggcagagagggagccagtgcttgcttcatcggattcttaaagcagattctttaagagtggattttcattctgaactggaggcccagcatggatgttggccccacgcacctcgtagagggacaggacctggtgacccaggtcagagcagaacaactggctctccagggctctgaaggccacaacagagaaggctgggaagctgtgggaggtttggaccatgacactgatgtccagcgcggcacacgtggggaccggggcccacagttgcggtgtagatcaccccagcctccacctttgcattctctactcctccatggccttggagaagtatgttctgctccggggtctgaattttagctgtatgaaatgcaggagtgttgacaatttccaaagaccctcttggagtttctgtgctggtagcagtctgggcccaccttcaccccctttgtcttccctcctcacccccacacgcatttttgtccaggagaaactggggtaaggtgggtggaaaaggcttccctggaggctaacacaggtcctgagtggggagccatcacaggacacaaagccggctagaggtcctacagggccatggtggaatgcaggttctgggctcaggactgggatgcaaatagggagggggtaagcaagtgtctttgtgaccaggctcaagctgaggccccgggctcatggcccctgtgtccactcatcttccctatcccagtatttatggagcaccttccctgggcggaccttctcctaggaggtagaacatgccaagtccctgcctcctgtgttacggcttatgtccttccaagtgttttgtacagttgggcttaacaaatgttcgctggctggaagaatgaatgaagaactggtgtctcctgcagtgttgcccccacatggttaagtgcacccaggagccagcttaggtgtttgtgtgagcgtgtgcacagcatgaatgtgagcggtgtgtgccgtgcccattctctctgggtccacgtcctgctatctgagtgtttcagggcgaggccgagggtttgtgtgtagtccggtgaaaggcatgtctgtcctctggcacttgtgtctgtgtcccccagtgtgcgagcctcaggtgtgcaagggtgagtacccgtgtgcacggctctggagcttctctgggtctgtgggtggcatagcctctgcctccagaggcgcccccagggagaatgactaagcgcccttgcatcatggcctgtggccttcctgcccctggtcatggctcccaggagcagctgactcaccgagtggcaggcagaatctccctgtggcaagtccccggtggggcccaaccaccccccgcgtcatcctggggccctcgaacatggtccatccagcccacccacactgcggcgaggccgtctgacaagccaccagctctggaatataccctctgtcccgtgtggctcactgcggaagagacgtgtccttggcactgtctgtgcccactgctgaccccatttagcacatgagcaaactgaggcccaaggggaaatggacccccacagccaggttagtaggagggcaggaacccaccgagttctcctccttccactacaatgggtggaaaggcagaaagtgttggggaatccaatccactcacccgctctcttgttggatgcgactcctgcaataagtccagtaagttgcactctctctgtgcatcaaatagggcagatgcttgcagttctgcctcagtctccttagaagtaaagcagaccccgccatgagctcctgggcattagaggacagcaggagagcacccgtggaatccctggtgggattgcagggacctgactctaatgcagccccaccaggctgggactcctgctctctgcccagctccccaagctgggttttcttttcctaagttcttgaaaaccacaagccagggtcagctgaggccagatgaccaactcctcccactgtgtaggactgtccaccaggccctgagggcctttggttacatcgaggaaactggtacctcccctgaccctgcagcacacacacaatgggtcatggtgacatgttggggggtctcactcaaggttggaagagatggcagtcatctcctggcccacatgtcttatttcacagacaaaggggactgagaggcttgattccatttacgcaaggctcaccaaactttgcctgtcactatgccaagccttgtggggtattctgggaagctctggatgcagcccctgccttcaggtccagaggcagagacagacaagtgaccttgaaattccagttcagtgggatgggccctgagatggggaaagccctgactcaggctctgaggagaaggtcaggctggcttgccctggggcgtgcaggcgccaccagggtttggtagcttactggaagccacttaaggggagggtgcaggaaagttgggggaagttgggatttgtccaggccaatgagttttctctagtggctggaaatcctgaggcttcttctctcttgactttctccttttctccctccatgctttctcttggtttttctatggaaatagtcatgtataacagcccccttacttctctagtgccactccatttctccctgtgttgaatggcactttggccctgtcccacctgggaggggagtatgaggaggatgtgatgatggagagaggtagtgtgtctgccccgtacatcctgcaccaccaggttctctgccccacccctcacactataccctttgagggtgctaggatattgcaaatgatagtggtggggttctgatcaggttttagagtgtgtatgtagagtttggggtcctcctggatatgtgagcctccccgatgtctctatgtggccacaaggatccattcacacctggctcacatcccagcatggagatgggacaactccagctccatggcctctgacttcaaggagggagctcactttcaaatggggaagacaaacatgcacatagctctactgcatggctcccctgttgtggcctcagcctccccatctctgaaccttcttcatgggactcagtggtttcagaggccttggggttctgtgatattcaccaagaggggtgaattggccctccagaatcctcaagatgcctcaggaccccacactcttccccattcattgtaccaggaaagggggaaggctggtccagtctgccaaaggttaagagtctgggatgccaggcctggctcctggcctgagttttcccatctacaggacagagacaataatgggttttaaggcaaagaaggcttagagttggctgctgctgcagaaccatgagacagcccagaacaactgagcgtccctgcctgtgcgccaggcagtacaccagtgctgcttatgcatgatttcacttaatcaccatcacaatcctatgagattggtactattatcatccccatttcgtggatgaaaactgaggttcatggaagataagtaactcgtccacagtgagacagccaggaaggaagagtcgagtcttgctggccgagggctccaagaaacctaaaaggcatcctgttctagaatgatcctgattagacttgagataaccctaattccatcccagatgatgtggagatgaaagacagggtcttacaaacatggcccccagggcacggtgcagtggctcatgcccgtaatcccagcattttgggaggcctaggcgggcggatcacaaagtcaggagattgagaccatcctggctaacacggtgaaaccctgtctctaccaaaaatacaaaaaattagccgggcgtggtggcgggcgcctgtagtcccagctacttgggagactgaggcaggagaatggtgtgaacccgggaggcggagcttgcagtgagccgagatcctgccactgcactccagcctgggtgacagagcaagatccatctcacaaaaaaaaaaaaaaaaaaaaaaaccatggcccccaaagcgttcttctcagcttcacaaccggggatgcagaagacaagtagtgtcaggagtaaatttcggcacctgtcaggttgaagttctacacctgactctgtgaccttgggcacagcttcctcacctgtaccaggtgaaaacagtgtcccaggcatggcatagggcctcatagctggtatgaggaatgactgcatgagtttccagaagtttcaggaacatgagagaacctctgatcaaggtagggtggagctgaggagcatctgtgggaacagtgccctctaggaaacatgagagaccgcaggaggctttgtctgttttgattccaactttccccagagcctggagctagtctatatagtagatgctcaataaatgtctgttgctgagtgaatgaatgaagggatcttacaggaggggaacatgctaggaactctgtaagtctttccactctctcttcgttcatccttcctttgaatggaggcctggggtgagagcctgctttgtcgttctcttgcattctggtagaaaattattgattttttttttttgcagggtttcctgtggggtgtaggagcagcgaggctctgggtagctctatttagcacaagtcttggtcttctccaactctagcagtcggaggagtaccccttttcctcactgctcctcttttgggtctcaccccactggccacaggcctgcggtctgactgccacagcccccggggtcggctctagtcaaatggttttctcccttcatccccaactctcctcctcaggtctcccccattccctacagtgagttccgtgtcctgcccgctggcacccccattcctgccacctgcccagggtgctgcctgagagctgctgaggttcctcccttagtcccccattcactcatcctccaccctgggattctgagactcacctgcaagggatgcagccctctcttctggccaggatgccatctgacctcacccgggttcccagcagggcatccggctccaaggcctgggctcttcccagcacacccatgattccgtccacccgtcccaccccggcatatgcaatctgagggcacttgaacatccatggtcccctgagtctcaccaaaggcctaggtggaggaattgaatctccattttacagatggaagccaaagttcaaagagggggaacagctcagaaggaatgcatggaggagtgtgcgcctggcaaaagctcctccttacatccaacacatccttcagcctggcacttctgtgtcaggcagggaccagagtgtttggcagtgaatgaactggctcctgccctcagagagcccatagcctggttagaatgtgctacatgccatgggaatccccagggaaggtgaatggattggggcttcctgagcatggacattcgaagtggaccttgaaagttgaataggagctcaccagctgaaggagatgaaagaggccctctagactcaggaaacagcacaaactaagtcttcgggtaagggaagaacatgaagcaagtgtgtggagtgcaggggcatgatgcatgccggtgaggtgggctgaggaatggcaggggcacagctgaagagagctttttattttattttattttattattttttgagacaaggtctcactcggtcacccaggctggagtgcagtggcgcaatctcagctcactgcaacctctgcctcccaggcttaagtgatcctcccacctcagcctcccaagtagctgggactacaggctcgtcaccacgcccagttaacttttgtatttttagtagagacagggtttctccatgctgcccaggctggtcttgaactcctagactcaagtgatcctcccgcctcagcctcccaaattgctgggattacaagcataagccaccgcgcctggcccctgggccatttattttctaccaaagggttcagactttggggaagccactggagggctctgagcaaaacagtgagaccccaggctgagtgttctttgcatggttcagtatggcctttgctttttgcattcaaaatctttattttaattaagaatgaactttttattgtggtaaaatatacatagcataaaatgctaccattttaacatctacaagtgaacctttcagtggcattaagtacacccacaatattgtgtaaccatcaccactgtttccagaactttttcatcatcccaaacagaaactccatacctattaaacgggaacgccatcacacccttgaccccccacccaagtgacctctattctactctctctctgtggattttcctactgtaggtaccttttttttttttttttttttttgagacagagtttcactcttgttgcccaggctggaatgaaatggtgcaatctcagctcactgcaatctccacctcccgggttcaagcgattctcttgcctcagcctcccaagtagctgggattacaggcacccaccaccacacctgcctaatttttgtgtttttagtagagatggggttttgccacattggccaggctggtcttgaactcctgacctcaggtgatccacccgcctcagcctcccaaagtgctgggattacaggtgtgagccaccgcacctggccttaggtacctcttataggtggaatcatacagtattctcctttggcgtctggccatttgtgtatctcctttggagaagtgtattcaagtactttgcccatttttgaatggggttgtttgtttccttgttcttcagtcataggaattctggatattaattccttttcagatacatgatttgcgaatatttcttctcattctatggattgtcctttcactccctggatactgtcctttgatgcacagaagttttacattttgatgaagaagtacaatttttcaatttctttattttgttgtctgtgcttttggtgtcatattcaagaaatcgtcaataactccagtgtcaggaggattttcgcctatgtcttcttttaagagctttatagtttagctcttaggtttaggtctttgatgactttaattttgaatatgacgtaacataaggctctccaacttcattcttccttatggggatatccacttttcccagcaccatttgtagaaaagatggcccttttctcatcgaccggtcttgggacctttgttgaaaatcaattgcgcatgtatttgagagtttacatctggtctctattctgttgcatttgtctatctggcccctgaatgatcttctgatgtgaagtccaggattgcagaatgtacaaggacccttgtaggccatccgttcatctccttgcctgcaggccagtgaccaacaggtcacagaaattcagctcaaggacacatttgttttccgggacctggagctggtgagaaggggtggagggcagagccaaaggcaaggactctagagccacagtcttggccctggccaggcccctggatattcgggggcccctctgccccttcagttgaccatcccatgaggacgtggcctttggggaaattcttttgtgctctgagggtctatacacccacctcctgagatgcgcacatctgggaccacttcctttattaagatgattccagaatccttccagcggagcttggagaagctccaagaaggaagcatccagtggctccatgctgttggccccatgcatattttgaagattttctgttagattcccaaaagaggcacttgcaactccctgtcccctaccctaggccatccagtgaatggcacaaccaggggctggggctccagggactagacagcagagtccaaggggagcacagctgcagagaagtagctgtccccggctccccttcctaggaacttccccggcctaggtgactaaacagaggcctgcttgagcctggtcttccagccatgtgccctaaggcataatttctagggttcttggaaaatcatggaaactgttcattccacaattgggctacacaggctgcttgatgcttcagatgcctttggtttggagaagcccatgaagctcaggacctggaaacagatttcagcccacatagctgagtgaccttgggcaaattagttgacctctttgcctcagtttctttacctgtaaagtggggataagaatcatgtctacctgttagtgatagggtgaggcttaaataaggtaaaataggcaaggacaaagccaggtgtggttgctcacatctgtaatcccagcactttgggaggccgaggcaggtggattgcctgaggtcaggagtttgagaccagcctggccaacatagtgaaaccctgtctctactaaaaatacaaaaaattagctgggcgtggtggtgggcgcctgtaatcccagctactagggaggctgaggcaggagaatcacttgaacccaggaggcagaggttgcagtgagccgagaccacaccattgcactccagcctgggcaagaagagcgaaactctgtctctaaataaataaataaataaataaataaataggtaaggatcttagaacagttcctggagcatagtaagtgctcagtcaatgttagctgttatgattgataagattttgctggaaccttgactctatcagactggccggaaaccttgacaggcagttaaagttgactgggatgcatagagttggaaaatgaagaaattattactgaatctatgattactgtgtggttgacattgtcttttaaaacatggatgagtgatgggaggggcgggggctgccatctctacctaacgcagcgggggcaggcttcaaggagggacaaaggccacccaggcccctcaggcccctcctccccataggctgctgcacctcgtacacatgtgtcatgagctggggaataactctctccctgctgaatgtgttttctgtgtttatttgacccagaacttcagcctgtccccagggcaggggttctgctgtgttcctctctgatcagcacagggctgagcacagagaatcgggctcagggaatgtcaggcaacctctgcacccttcctgggccccagcttcctgggccccatctgcaattaagaaagcacctggtgggcattgcccttggccacacctggactgagactttttgtggaaacccactgggagatattagtatcctcaatttgaagatgaggaaggtgaggctgtcccgctgtgaattgaacccagatctcctgaagccaaagagcctttttcctcccctgcccagggggctcatgcccactgcctggatgccctcatgcctatgtgcccatcagacttgaccagcatgtgagagctctgtagacggtggagggggtgcactgggaggggttttcagcacactgcatgttgtacgtgggctacaccatcttcgcccatctactgaaatgatgaccatgtcccctgaccgcccagacaccactccctcctccctccagagccatcctgagaaccaggccagcccagcccaggacccccatgtgatacgtgggagcagctcctgtgggtaaagaaggaggagacaaacccttctaaacagaacgagtaatagcctcctcactagcccagtgttggcgaagccaggggcaagaggccagtttggaaatattacttgtaccatgtggcaggtggacagtgagggccaggcctcctcagggaatgtatgtgcccaagctctgctgtattaatgcatcccccaggatttagccccatgagagaagattccacagagcccagttttgtgctacacaaagtatcctctcaggagatctatcccgttgcaggggatccatcctgccaagaagtagtaacaggtggaaaagagatgtatttgtctcacgttcgctgtggattaaggtttgcttggtagaagggacacaccatgcattatatatatatttttttttctttttttaagatggggttttgccatgttggccaggctggtctcgaactcctgacctcaggtgatccgcccacctcagcctcccaaagtgctgggattacaagtgtgagacactgcacctggccacatcatgcattttaaagaagagacttttttgaattttttattttgttcagatgagcagaagtcaatgaaaaaaccattttcttccttccttccctccctccctccctccctccctgcctgcctgcttccttccttccttccttccttccttccttccttccttccttccttccttccttccttccttccttccttccttctctcagacagggtctcactatcacccaggctggaattcaatggctaaatcatggcccactgcagccacaacctcctgggctcaagcagttctcctgcttcagcctcctgagtagctgggactacaggcttgtgccaccacgcccagctaatttaaaaattttttttatagagatgggggtcttactgtgttgcccaggctggtctcaaactcctgagctcaggcagtctgcccacgttggcttcccaaagtgctgggattacaggcatgagctaccatgcggggccaaaagaaccatttttaactaacatgttaattgtgaatgctgaaacattgattatttatattttatccttactatatgtgataggcaaaatcctgggaacccatctactccaaatcccagtcatttatacaaaaacaccaaccaaaacttttaggtataattatcctttagatattttgaattgttaactattttatagttgtaaatgtggattttttaaaaagcaaatattgaagaatctttcccattcttatcaactttaaggaagttgatgactttcttaaagtacaaactaggactgggcatggtggctcatgcctgtattccagcactttgggaggctgaggtgagacaattgcttgaatccaggagtttgagaccagcctgggcaacatagtgacacctcgtctctacaaaaaaaaaaaaaaaaaaaaattttaattagccagctgtgatgttgtgtgcccatagtaccagctactcaggaggctgaggagggaggattgcttgagcccaggaggttgaggctacagtgagctgtgattgtaccactgtgctccagcctaggcaacagaaaaaaaaaaagcaatcttataattaattgagccattactttccctttctcatccaaggggagaaaagccttgttgctttttcagtttgtaagtgattctctagattggaatgagtatatttgggccaggcgaggtggctcacacctgtaatcccagcactttgggaggccgaggagggtggatctcgaggtcaggagttcaagaccagcctggccaagatggtgaaaccccacctctactaaaagtacaaaaattagccaggtgcagtgaccagtgctggtaatcccagctactcgggaggctgaggcagaagaatggcttgaacctggggggcagaggttgcagttagccgagatggcatcaatgcactccagcctgggtgacagagcgagactccgtctctataaataaatacataaataaaaattaaagaaggagcacatttgagaaagaaaagatttgatgttggtgaaagcagcacattctttctgggatcatatgctgcttctgcaggctaagaaattcaattgtttggccaggcgcaatggctcatgcctgtaatcctagcacttcgggaggctgaggcgggcggattgcttgagctcatgagttcaagaccagccgggacaacaagagtgaaaccctgtctctactaaaacacaaaaagccaggtgtggcggcatgtgcctgtagcctcagctacacggaaggctgaggcaggagaatcgcttgaacccagaaggcggaggttgcagtgagccgagatcgcaccactgcacttcagcctgggcagcagagcaagaccctgtctccaaaaaaagaaagaaagaaagaaagaaattcaattgtttaagattagctcaattcagcacgtacttgggtgccagacagtgacaacaggcagggcaagtgataacgctgcctcgtaacacccctcccctgcccttggcgagggcacagtctaaaggcagaggctgccatgaatccactctttaaaagtttttttaagtctatataaccaaataaatttaacatttgatttttacagcagttgccaatgtttcaccccatttatagtctttgttatatgtatgtgaaatgggcccttcattgaaagggaccctgggagctacttttgacagaggtttatggttcataaatgtcattctgggagctgccgctcgggaaacctgaactggagaggatgcacctggggaaggaagcaggtgggggtgacacagttgcaggctgagcaacgttgccctggctgtcagctgccacggccaaattcatccccagatcataactgtgttaatatatcatggcaacgtcccattgatagagtgggtgccgtgtgtgggtcaggggatatgccgtcttgcactctacttcagtcagacctcacagccattctgggatgtggatgttctcagcctcatcttacagatgaggaaactgaagcacacaaaggtcaagtcacttttccaaggatacccttctgtggcagaaccacaaggtggcttgggagcctccttaataatctcctttagtcggctcccatttctttcatggggaaaactggcattccctagtcttatgtgaagcgttagctaaacacagcttcaacagacctctccaacaacattgctgcttcaaaacacctcctctacagagatctggagtcgccccaaggctgggctaggtgcccctgccctggtcaccaccctgcactgtaaccatggcccctgtcactgaggcgagccatttgaaggaagggactgtgttttactgggctttatattttcaccacctggaactttgcccagtgcatagctggtgctccaggaatgctgttgaatgaatcaatgtagcaaataagtggcagagccaggggccaagcccaggcctgtcctaccccaaagacttctcaatcatttcattttgcctcgtgcaggatctaagctcctccatctcgccagcctccggatgaaagtgatattacagtgtcttggtgaaggtggtggagctgcaggattctttctgctacagaagggaaacagaggcttgggggaattaagtgagagatgtcttgggacacgcccagggccacatggtttagggggcttgagagggacaatgggcagacagaccacagggctggatgcaggaggtgcagggttcaagtcctggcccttccattatcaggcagtatgaccttgctctgggcctccgcatcttggctgtgaagggagggtctggtccagtggggtctctgaaccctgcggacgtattgctgggataggggagagcatgggagactctgtttctctggcagtgggtcctgccggggacagggtctcatccaaccacccacgccatgagatggagcttggggatgggacgaggagccgggaaacttctagcctccttgaggagagaagctgacaggggcacttagagcccagactgaagctggaacacccatcccaccccaggaggcatcaggaagtgatctccaagtgttagatcatacatgggcttctcatggagaccctgaagcttggtttaccctagtcctttgagatagaaatgaccccagtggctcagcaatgcccccttagaacaaaatgaagcctgcctgacccctccatgttagaaagataactcatcaccaccttgaaaggcagtggacttggcatgggaccatccagtctgcccctcctagctatgtgatcttgagcaagttattcatcttcactggacctcagttttctcatctgtgaaacagagataccaacactgacctcatgggatctggggagggtcagaggagatagtgggtgggtcagggcaacacgaatacaaggcattacattattgctgtcatggttgtaatcagccctggttggagagctcctgtctaaggagcttggtaatttgggatttgccctatttggggtgaggggatggtatcttggtatcttgttttaccataaaatgcaacatgccttgccgagccttccttgactggcaatacccaattcaagagccactccattgcagaggccttctccgaccttttcaaccaaaattgaccgctcctttctgtgggccctgccgtgtctgggaaacaagacttttgccctggggaccctggaacacttgaccgtgcttgtccctcatccatctcttccactaggccatgattcctaagggaagctctgaatgaatcagtaaggcaagacacagggtgggggagagaacaggaaagacaaattccagacacaagctgggggatggaggggacccaggccttggcagaggggccatgggggctgagggctggacaaagtttagggttctttctttccaccatttcttttttttatacaaggaaactttactcatttggactaactgtaggacagttgaaattacagtagactcaaaaattaaagtactttttaaacttttaagttccaacagtagcttgaccttggtctcctacagctctcagaagagctgcttaaaggagccccatgttctaattgggtcacagtggcttccacgggagtgagggcttccagagggctggggagcaatgtgtgctcccagagttggcatttgtcttgtgatttttattgcaacgtacaaggccccttgtagaattatgaatggtggtggtgatgaggggaaggcggggaggttgccaggtaaactcatccaggtcctgttcaaatgattacatatgccagcttcacaagaggggttcctagggaaggtgccttctttccattagtccacataccttttcttttaaaaacctttttattttgatacagtattacacttaaagttataagtggactacaaagaattcccagatgccttttatgctgactccccaaatggtgatgttttgccatatttgcattattttcaatctctctgggtctctctctgtgtctctctctgtgcatatgctctgtttatgtatgtattgatatacatgcatacgatatacagctgtatcatttaacagtaagttgcaggctgggcgcagtggctcatgcctgtaatcccagcactttgggaggtcgaggaaggtggatcacctgaggtcaggagttcgagaccagcctggccaacatagggaatcacttgaacccgggaggcagaggttgcagttagtcaagattgtgccactgcactctagcctgggcaacagagcaagactttgtctaaaaacaaacaaacaaaaaaagagtaagttgcagacatatgactcatatgcctctttgcctctaagtacttcagtgtgtgtaggccctgaaacaaggcactggtccacatctgaggtcccagatggtcaatgaagttgatcttcagcagagcagtttgatcaggggcagccttgaaggttgttgcaagggggccaatctcttgaggcagctgagagcagccattctcctgtgacttcctcccttcctccttgaccctgtctcctgtctgcctgtcccagtcccacccacagcatccaccccaggagggcccagtaggcatgctccaggcatgagattcaagtctcagctctgcctcttaccagttttttgttttcttttcttttcttttttttttttttgagacaggtctctgcctctgtcacccaggctagatggaactctggggtcaagtgactctcccacctcggcctcccaaaatgttgggattacaggcatgaaccaccacccctggaccttcttaacagttattgattcttagcaaggcatttaccccctctggcctcagtttctggggctataaaatggaaacctggcggttgtaaagaggctggaaccctactggtggcataatagatgccctagtactttgtaaagtacaaagcccagttcctggttttgtttagtttgtttgtttgttttttgtttttgcgagagcccagcattaatcccttttcgttcctggactctgggaagcccactccatctctagactaagagaaaaacagtcctccccactcacccctgccattgcaggaagaactgagagagcttctgtgtgagggcggagcagtggaggacggggtggcagaccctgcctcggcggatgcctgcctcgggaagaacccacggggaagctggtaacaagtctgccagccacatggaaagccgctgggccaaacgacaggggtgtcctagggagcttttgcaaggcaaaggcttttgcaagttagtcagtttcctgagcacccactgtgcgccaccctctctggagggccaaggaatccccatgggtctccaaagggaggccacttaaggaatgaaaaagagcccaggtctcagcctgtctgtcactcagtcactagtgacactggtgggtcccttctctcggcgcctcactttgaccgtctgtccaatgaggatgctggggccacagtgtgggaattctgaggagactggaatgaggcaggaatgtgaaaatacccagaactaggggaggaaagacccctgcaaggaaggccagcgacccgccccatccatctctttgtcccttgtagtgctggaatggtggcagacgcgtagtagggctgaattactgcttgagtggcaaatcctcccagctaggacctgggtcttcaaacaaacgtctagaaacctcattaggcactggggccccaggatcatcaccttccgtccagtgactttattggaactgcagtgcctcctggtggccagcatgcacaactgcagtcttgatcttggcctgctgggagttgggccctggaacctgaatgcttagccttctgggtaagcagccagggccggggactcctcttcagtcttggcttcccacagggctgtgcccctccatctcctcttctcatacccctccctggcaggaattcatgcaatgttgttgagctgagcaaacagaaggcaagaggtttgtccagggccagggagctgccggggtcatctttggtccttcctgccctgcgctgtggctggtttcctcgacccccctcatcctgaaaggtcccttcttccgactccatgcagcagcctcctgacacaagcagtgtgtgcaggggaccaaggacctcctgtgtctggagcccagctccagggcctggggccttttcctgcagacacactggccaccctcagctgtgcctgcagagctgccccagccaaaccagaggcagaaggagcccagaggagtctccctcaacccaggcacacacaggcatttgcattaattccaggggtgtgtcctgagcccttactcacacgaggcccaggccccagcagtacatctgggaggcccactctgaccagctcacagtctagggagggagcaggcccatgagccggtgctgtaaagcaggggattcagtgtttaagaggcaagggaggtcctggaggaagaagggtggcccttggctgagctttgaaagcccaggagagggaattcacagcagaagaaaacaaaaaataaaatgttccatagttaaaaaataaaaaaaaaaaaaggaaagacaagatctcactttcatccatcgtgctggcaaagattttaaaaacactataatgaccattattggctctgaagtgggaggggacaccgtggtagctgaggacattacatgtttctggaagacaacttggccgtgtttctcagagaccctcagatatgtggataattgaacttcatatttctagttcttggagcttctcctaagggaatcgccatgcatgtattgagagatttaaatcacagacctgctatgatttcaaacaagtagaaacctgtgagcccaacagaaaaggatggattaaataaaatagtgattgttctcgctacgtaaccattaaggatggtgtggtagaagaatatagaacagcatggaaaggggtacggaatatggttagattttactaaaatgtttataggctgggcacggtggctcacgcctgtaatcccagcactttgggaggcccaggaaggcagatcatctgaggtcaggagttcgagaccagcctggccaacatggcgaaaccctgtctctactaagagtacaaaaattagccgggcgtggtgctgggtgcctgtaatcccagctactcaggaggctgcggcaggagaatagcttgaaccggggaggcggaggttgcactgagccaagattgcaccactgcactccagcctgggcgacaacagcgagactccatctcaaaaaaaaacacaaaagtttacaaagtaatgttttctctgtgtgtgtttgtgtgtgtgtgtgtatgtgtatgtgtgtgagtgattttcttttggtctgtcttgatttttttttaatcttccatatagaacatagattacatttgtaatgcgaaagaaaagtcacaaaagttacagagaaagctatccaggtgaaagtagtagttagccacagacaggagaggcagagagacatgctaggtagaaggaagggtgcccgcaggagtgcggaagcctgaagatactcgtgcagtgcgctgcagagcggaagcaggtctctgaacctcaagctagatggaaggctggcgtgtaagtccgtgagtctggtggggaccagtcctgccttcgggaccctgaatgccacataagcctgatgtacagggttggcagatttagcaaaaagcaagcaagcaaacaacaaaaccaggttactcagtcaaatctgcatttgaataatgaataatttgtaggataaaagtatttcttgtgccatatttgggatatacttatattgtttaaagtgttaactgtttatctaaaattccagtttaactgagtctctccaagtggtgcttgtctcttgcttcccataatcccacagcacagagcccagcccgctctcagagcatgcaccatccaggattctaatcactgctttcagatatttcaacctgttcctgggaaaacaaatagaaaattaattcagaccagccccgccccgccccccaaaaaaagaaaagaaacaaaattaacccatagacccatattgccacttctggaaacttgtagtattttctgaggacaaatgctccactcccttcctctttttgatcaaaatgagatttatttgatataaattgaacatctttgcatgtgttaaaacgctatcctttcttagcatcatctcattcatttgttcatcaaatgtttactgagcatctactgcatgccagctatgatactaggtgttacacagcagggtaaacaaagcacacatgttcagatatattccctgctccatgggagggagagagagagagacaataaacaaggggaaaacagaagaacaaataaatacctaatattggcgcggtggtccatgcctgtaatcccagcactttgggagaccaagacgggtggatcatttgaggccaggagttcaagaccagcctgggcaacatgaggaaaccccgtctctactaaaaatacaaaaatgagcggggtgtggtggcccatgcctgtagtcctggctactcaggaggccgaggtccgacaatcgtttgaatctaggaggtgaggttgcagtgagccgagatcgaaccactgcactccagcctgggtggcaaagcgagactctgtctcaaaaaaagaaacaacgtgcagaataaagactatcaggaaggatcttccatttatggaaatatcatcctttatttaaccaatcccctattgttgaatattttgattactgtcggttttcctacatattaaactatgacatgatgaacgttctctctagtgaatgcttaccatcatttattgagtaaattcctagaagtgagatttctgggtgaaggcatataaacttttaatttagtttttgttttatatatatgaacacaattttgtattttctttttagttacattttttaaaatttgaaaacaacatgctgtaaattttttttttttttttttgagatggagttttgctcttgttgcccaggctaaagtgcaatggcatgatctcagttcagtgtaatctgcacctcccgtgttcaagcgattctcctgcctcaccctcccaagtagctgggattataggtggctgccaccatgcccgacgaatttttgtatttttagtagagatggggtttcaccgtgttggccaggctggtctcaaactcctgacctcaggtgatccaccatccgcctctgcctctcaaagtgctaagattacaggcgcaagccaccacgcccagctgtaaaaaactttttggtatatacttttatgagttttaacacactcatgtatagattcatgtattcactgccacagtcaggatacagaatagttccatcacaccagtgcaagccctttgtaaacaaaccttccccctcctcctacacctggcaaccagtgatctgttgcctagagtccccgtagttttgcctttcccagaattcatgtgctagctgagtgcagttgcacttcatgtaaatttgagactggctttgtttacagaccctaaggccacctttcagattcatccatgtcattgtcaacagttctttcttttcactgtggagtcgatccatggcctggatagaccacagcttgcgtctccattcccctgtcaaaggacacttgggggtgtctccatttcggggtgattctgaatagagctgctgcagacatttgcctatgggtttgggttcctctcctcttaaaataagtcattatttctgtagggtaaatacctaggagtgggattgctgggtcatgaggtcagtgttagtttaactagataagacaccgcccaagtgtttgcactgtgatggatgggagttccgggtgctccatacatcgccgtaacttggcatcatcaggtcttattcccactgtgataggcacatagtggtatctcattgtgcttttaatttgcatttccatagtgggtaatgaggttgagcatatttcatgcttatttgctccctgtagatcttcttgggtgaagtgtctgctagaatattttgcccactttttgttaaatattactattaactacactccacactttattcagatttcactggcttcccccaatgtccttttactgttccagcattccccccagaacacattgattacacttagtcctcatggttccttggcctcctctagtctggggcagtttctcagactttccttatttcgagagcatttcagggcttgggttggtggctgtgggtgagcaggatggcctgtgccactggctagcctgaggactgccatttccaccccaccctctgctgaagattggcagccccttgagggccgggacactgtctgtctctgcaaacagctgtgccccgtgcatgtgtgctgaaatctaagcccagtcactactacccctttggcattatttattgggactggagctaaattagggacattcaagttgagctctggacagaccccagtgtcagatgaggtggggtggggacgtgatcaatggctaaactttaacctccgccctcacccccacaggaccgtttggacagcagtgggtttagtcagtgccctttcaatagcatgaaagggcctcatgctggcctgttttttttaaggagattacatcggtgtgtgcactccgccacagggtgtgtggggccagctcacccgagaacagagcaagcggcatgtcccccacaaagcagatgtttggaggaaaaatagatgtaatcaaaaccatggaggataaaatgactgagaccccttagcgccatatgcatgggcctgtgcacggctccacacaggcccacaccacccatgtccacacccacccacgcggatctgcacccacacacaactgcccacggggacacacatcccacttgtgtgcctgcgcttgaccacacaagcatgcacactccacaaacctatccacaagcaactacacatatgttccccacacccactcacaatggcagacttgtgccacaggccctcgggtgtacatctgtacatacagatgctaccagcaccctctccctaaaatggctctagaaggtcattctttaaatcacggccaaaaaaaaaaagaaagaaagaaaaaagaaaaatcagtcacctttggaaacctctcaagggttttcctgttttaaaaaggtaaaactagattagagtgatgccattgggttgaaccaggacagatgggtagaggttaagggaacgaagcaaggctttccacttcatgcatttctccagctgaaatccaacagccaggggttcccagcactagaaacgacagctcccagtggtacgggggtccccccagggggagttccagcagaggttgaagggctcagtggctcccgattgagaatacaaccttgaactgaatgcttcccacttcatcaaaagcagtctatggcaataatgctgacctaggattgtttgaagagcactggataccatgatggccacactgcgtgcacaacaccctccgtggagcaggcattgctctcagtgatgtaggttcactacttgattgatggctctaagtagtcaggggtttacttccagatcaagactgggaagctgcagattgggactacgttgtcttggaccccatagcctcagccctgggacaaactcatcatgggaggggcatcagcatagagcctttccgggtccacaaggagctgctccagggaggatgtgagaagtccaacccctggcgggtggcctggacccacgctgggcgctgttgctgctcagccttatgccagcacgaggtgccccaaggctctgaagaaggcttgcccagcatccaggcaaactgagagctccctggcggtcttctctaccccagtgtggtggcagggtgggtgtggagccagttcctggcagatcctggactgggtttctggaccttggtttcaattctggagccgcctctatgaagcccgtctctgcttctccttctgtcccttgctctctgcatggagacatcgctcaaggtctgtctgggtctttcttctctcctgtctcccgcagtgacctttgctgtttgtgctgtcagccttgaatggtggcattcgtcattgcgtgccctttttcaatgtatcccacccgactttctccccagtgggtaggaggatgaggcggttggttcatttactcgagagacattttctgcacatgctctatagaacatcggctcaccaaaggtgcacacagatacctggacagagcgagagctcagtgatgtttgttagttagaaattgttcatttattcctcagcaacctcttactgcatctctgccacctgacctatcctgtgctgagcctcaggctgagaagggacaaacggcatgaggtcccagcccctggggaactgacattctataggaggagctggacattcggggcttgatgagattacgagtcagcaaacataggcagtcagtggagagggtgagcagaggatggaaaacagtcacaatctgggagggcttcctggaggagcattggatcttggaggtcagctggaaggaggaacatgccaggcaggggcccgagatggggacttgggggaccaaggtcagtggtttcctttggtcaggagcagtcagcctgagccatgggacttctattttcagcagccgtcttgctgaggagggcaccttgcggggagtcagatctgaccagcacccaggccttcagctaccatgctgacactccagccagcccggggtcatctccctggagagcaatctgctggctttgcccagggcccagccccactcctcatatcatccctgccaccctctgtctcacacaggccggagaaactcagggccacccgaggaacagcagtgggaactgcagaaggaagggagactcagaggggtggcagtagcctcccaatgtccgcagggacagggctgtcatggggaagggcgctggggggttagaactggaatcagtgaaccagacctacaggagacagacatgggctgggtctaaagatgagtagttctgctgtcctgggggcagtgagctccctgctaccctagactggaaccagcgccaggtggagatgctgcagggtggcgagaggtggacatagacagcctgagcttggggtcttaggactcagactctgagagggctgtgcttgttattctgaccagttgagtggagctgcagaacttcagggaatttttctttgttgtctaaatgaggaacccagcctcagaatttaaagcaagctgactcaagacaggttagaaggcttgcttccttcttccttgaggaaccaggagcagcgctcccctgaattccttccatctctgacacaggcacaccctccccctctcctcccctccccaggtcctcagggacagtcctggctgctggtgagcaagggaggagggaccctcaactaccccgctctccctatttgtaggtgagactccagagatgaaatgggtcatctgaagtcctgagaagagcgggggccgaggccagggctcccaactcttggcctggtggtcttcgcacaccctgtgccacctctatctctgcctgctcacttggtctcagtgggcagctggaggtgggcaaaactggacccttacttgtcaccatgaagactggaccttctgccacttcccctgaaaggccaagagctggctcagtgctgagaggctgcccccaggccacatcctcactccctcatcctcaagggctggtcctgccccccacaagatggacagagcaggacgccttggtcatatgaggcccctgggttccttctgcccctacctctctccctgggaataaggcctaagaccccaggggagggagtagagggcaggccaggagctgagaggctgtgctctgtccggaattggggcatgtttccttctctctctggcctcagtttccccccagttaaaactaggagttcaggctggtccataccaactctcagttcctgtaacatggagctcccattgctgtgcagggtggtcccaatccccagcaagcgtctatggggctgtgagatggggcctggggatcagagctcagggctcagtgctcacctccctcagcccctcatctggcttccaggaagttgcaaaacagggatggttatttttgtgaggctgggtggggtttctaaaaaaaaaaaaaaaaaacctaaaacataaaatgtatttgtctgccaggaagataaatatctttgctgaaagctcttggcccagctgccagctgcagtttgcagaatgttgtcactgaagccatggctgtctgcatgtgcctgggctcacacaggtgtcatgcgtgatgccgctgggccggtcgtgcacccccatggcgtctgcactgccagtggccctcaggagcagcctcctgaagctgctttcaggcctactctgggcactcacctctatgccctttccttgatgccttggagagggaggcgagaatgccacaggccaaatgtccctctcagcttccccagtgtgcacagaaagccaggaatgagacgagtctgaagcttcagccctcaggatctggatggagtcagaagacctggactagaggcatcattctgacacttaatgcccatcgcttggacctatttccagaagaagaaaccgcgggtcagagtggctgatgctcacacctaccacacgtgcttgttgtgatgatcaaagctcgtgcacgtgaaaggtcgtgtcaaatgctccccaaacgtcttattaattgtgtttgttctttcactcaacaagttccttttccccaagttacagacaaggaatacagttctcgaggagttcacacccacatctgcagacacccagttggctgcccttccctaggcatctgtgcacgccctgcacatgctcctgtgcccaagggcctgcatgcttggaggacttctccagggtcggagtcctctaatgttcacagggtctgtgggtttgcaagtccagactagaaatgtgaatatcaataatggcaaaactacatagctagcacactagcctctttatttcccacagctaccctatgaggaagatcctagaagtatcttcatccccattttatagagggggaaactgaggcacatagcgggtaggtaagctctcctgagcacacagctggggagtcatggccataggattcatggcggggctatcaagagtccatgacctaaaccaggggtccttagcccccaggctgtggaccagtaccgatccatggcctgttagtaaccgggccgcacacaggaggtgagcggcaggtgagcaagcattactgcaagttctggctcctgtcagatcagcggtgccattagattctcacagaggcgtgaatcctactgtgaaccatgcatgtgagggatctaggttgcgtgctccttaagagaatctgatgcctgatgatttgaggtggaacagtttcatccccaaaccatgccccaccacaaccttctccacccatggaaaaaattatcttccacaaaaccagtccctggtgccaaaaaggtagggactgttgtcccaaaccctctgccaggaggtgagtgtgtctgcctaggaagctcaccaggctgtgtggtggtaaagtggcttcttgcctcactctcccaccccagcctccacctcttctttcttgatgtgtatgggttgactcgtccttgcagtcctgagctaggaatgtgccggtgggtggggggtccatctgccagacgcagtggctgggagctgtgctcatgtacacccacccaggcccggggtcagcgtgctggggatgaaggtgcccgggcagcctcagtaaacagtgggcaggagctgcttgtaacaggaaatgtggcccatgcctcaatcccatgcacccccaaggaagaaagacccttctcttgaacaataggtgagaccagtgtgcagggttggggggcagggaaggaggtgttgactcctcagcactggactcttggggcagagtctccacagctcctgctgaactcctggtgggactaggccaggaaaggaggggcactcctgtctgcctcaatgctgggtcctcctcaccccaagccccactgggccagacatggctgctgaatgagtttcccttccacccagggaggccatggcactggggtcagaattctcgggccccagaaaagtcctgatgcagggaatccctctagagagaggagctcagggtcagtgaggtggggattaaaggtcacagaggtcagattggctgccttaggttcacataacattgttgctggaagggacctagtctaagatgatggtgaagaggctcagattggggaagagatttgcccaaggtcacacagcaagttaatggcaagccagaattagaagccaagtctcctgacctcgcatccaatgagctctaagaggaaaaaggcagggggtggctacccgagtgccccactctccccctgacattccccttctcttgcttggttcaaccattggtttctgactttgtttcctcctccctcagctaaagagagctccctgggtgagccagagttaccccctgactctgacactgtggggatggacagcagctacctgagtgtcaaggaggctggggtgaaggggccccaggaccgggccagctcagacctccccagcccattggagaaggccgactcggagagcaacaagggcaagaagcggcggaaccggaccaccttcaccagctaccagctggaggagctggagaaggtcttccagaagacccactacccagacgtgtatgcgcgggaacagctggccatgaggacagacctcactgaggcccgcgtgcaggtcagtgagggccacctgggagtgaggctggtaaagcagagcctgtccctgggctcttggctgcagttgaggtctcctgactgcccaccaaccacaccatggctttcctttcctcagttcattgagaacctgaaagtgggggctcctagcctgcccctcatgcccctgtcccaactagagcgactctgcttttatcctctttaatattgggcttctgcactgtggtggggggttgcaaaggaaggagggcctccagcagaggggcaggaaggctgctgctggctgtttctgggctttacacagtgtgagagtcctggctctttcacacagagaagggttacttgtccctgctctagaaggcctatctcttagacaggaaacaggacaaacatgaagacaatgtccacagcatcccaatgggcagaaacagagaacagtttagctcttccttctgcctagatggctgcatccccctccatttttcaagtcccaactcatacctcctctgagaagtcttcctgaccactgtggctaaagcagtagcccccctattaccagccaacaaccaaaacacccaacccagtacaatacagtggaacccaacactcaacccaactcattgcaacccaacagaacacaacccaatagaactcaactcaacacaacacaacacagtggaactcaacacactcaacccaactcagtgcaacccaacacaacacaacccaatagaactcaactcaacccagcacaacacaatggaactgaacacactcaacccaactcaacccattccaacacaacacaacccaatataacacattccaatggaactcaacctaacacaacacaacacaatggaacctgacacactcaactcaactcagtgcaaccgaatagaactcaacccaacccaacacaacacaacccaatagaactcaactcaacccaacacaacacaatggaactcaacatactaaacctaatgcagccccttccaacacaacacaacccaatataacacattccaacagaactcaacctaacacaacacaacacaatggaacctgacacactcaacccactcaacacaacccaatagaactcaacccaacccaacacaacagaagcaaaccagctcaccttttgttacactgtcctattttatcttcttaaaaattttttaaattttttttgttttctttttagagacagggtctcattctatcacccaggctggagtgcaataagatgattatagctcactgcagcctcaaactcctaggctaaagtgatcatcccacctcaacctcccaaagtgctagaattataggcatgagccaccatgcctgggcccattttatcttttgggtatttttgtttattttttttaaagagactgggtctctctctgtcacccagcgtggagtacagtggtgtgatcatggctcactgtagccttaacttcgtgggctcaatggatcctcccgcctcagtttcctgagtagctgggaccacaggcatacaccaccacgcctgggataagtttttttattttttgtagagatagggtcttgctttgttgtccatgttggtctcaaactcctggcctcaagtaatccctcacctcagcctcccatactgctgggattataggcatgagacactgtgcccaactcctattttgtcttctttacaggattgttgactggcttacgttattttacttgtttgtcccctcctactaaactgtgatttccttgagatcaagcactgattgttcatcactgtattcccaccaattagagaaagccaaacgcagagcatcaagtctaaaaaataagtatccgtggatcaatcaacccttgtccagagagctgtatctgccccgaccagcatgaattcacagcaaagaaaggatcagaaagaaagaaaagacccatgagtagccaaaatacaggtgacaaaattcacacactcaagtttaagtttcaatttaacacaaaataaatgtcataatcagtccgcttttccaacccaaagcatgttggaaatagcaaataaaacgttgccacatagcagtttttccctctccagtgggccagaaaaatcaatagcttcagaacaaagagaaatctttttttttttttttttttaatcagcaaagcgccatgcagctcagtgggctgagcccttcaatgttaggacagagatgccccaaccctgcaatcctcagcaggccccagggactcttgaattaactcatgaaagcatcttcagcagcattgttctaaggcatcagtaaaagattcatcagttacaaccattttctgtttaagaaggcagaggcatctctaatagagtctacaaactttttttccaaaatggctaatgtggaaaaggactagtggttatcagtaaatatgtagctgttcagaaactgcagctaccagaagtgatgctgaagagctgcacggttgagttgctgtaagttccctgagggcagcctgccattttttttttatttttttattttttgagacaggatctcactgtgtcacccaggttggagtgcagtggtgtgatcttggctcactgcggcctccacctcctgggttcaagcgattctcatgcctcagcctcccaagtagctgtgactacaggcatgcaccactacacccagctaattttttttattttttggtagagatggaggtttcaccatgttggccaggttggtcttgaactcatgacctcaagtggtgcacctgctttggtctcccaaagtgctgagattacaggcgtgagccaccatgcccagcccagactgcctttttttttttagacagagtcttgttctgtcgcccaggctggagtgcagtggtgcaatcttggctcactgcaacctctgcctcccgggttcaagcgattctcctgcctcagcctcctgagtagctgggattacaggtgtgcaccaccacacccggctaatttttgtatatttaatagagatggggtttcaccatgttggttggctggtcttcaactcctgacctcaggtgatccacccacctcagcctcccaaagtgctgggattacaggcatgagccactgcacctggcaagactgccattttattcccctccagtgcctaatgaatgtttgatgaaggatgacagggcagctggggctttcctgtgaatccagaagccctcacacacccagatctcacttgaatttggacaaccagccactcacatgaccttacatgcctgagtttggacaggaatcctagcatctagcctgatctccagcaaatggattggggaggacccacaggtgtaggtagagaaaggggcatagctggttatgggacagccctgtaggtgctgtgttggtgtgggataaacctgttccttttctgtgcagtatgtgtgtacatttgtgtttgcatatgtgggttgcatgcatgcttcctaacaaacatatgggagtgcccgggagtagaattcactaagtactgaaagaagaatgacgccttgagtacaaaacatgaaaacaaaggcgcacagagcatttttcagttgccaccatacaactaaaacagagtgttctctgcacacacacatgcgcgcgcacacacacacacttatacctacttccaaaatggagttgaggtagcttacaattaaagatttatttgttcaatctaaaaacaagaacaatggcatgaaatgcagaggtaatgtggtaaaaaaaaatttaggctaaggttcatggttgccattgagcacaaacttcaacttggagcttcctggcagccaaggcagaaagggaaactctgacgtgctgcatatcttatcacctagtgggaggaccacagaactatagaacggtagtgctggaaatgatcaccccatcttcccatttgatagacgaggaagaagaggcccataggtgggaagtcataacctgaagttaacagcagccactcagtagcagcactgcgactggaatccgggactcctgagtcgcagcctagtgcttctttgactttagtttgctgtacaaggacacatgccagattgttcagaggcttttctttgtataaaggcagcagggtgggtgggatcttcatgtgcgtcagacctctgggttgagccctaagcctggcagtgccctggggggggtaagggggtggtgatggaaccccctgcctgcctctgctgtgtttgttcagggcccatactcagctggtggcaagccaggtgcctggcgtagagtggtggtggggacagggacggggcaatgggggccccaagatggacttttcctgggaagaagcctagggtttggccctgctccagggggctgcaggggcctctctctgctgtctgggattccaatctctgcagctggtgtctgaagacaataagacagaggcctccccgccctgggccaccccgccctggccccagatgggctgcggttagcgaggcctccgccaagacagttggttccttgcacagcccggtcctcgggagaggcctgtgctgagtgggcccaggctggggtggtcctgaggtatgacattcagaccgggagaacagtggggacctcgtggttggctgtcctcctggggctgcacagtggagacaggcctgcggtgcagagcttggaggcacaggaacgggcgtgggggttggtgtggcatctggaagggagctctcggagcccctggggcgccaggggtcagaaatggatggacactccaagcctcaggacctgcagatgtgagcatagaaggggtcgtgaggatacccttgctgcctccaatttactggggaggatattgaggaccggccaggctcacctagctcatgtctggatctgggcagaaaagccagaactgggtgcgcagggtaaggccccaggacaaaggaacaggagaagaaggagggaggaggtgggcagccctgctcccaccggtcgctcacccgcctctcaccatttccatcttcagccctcaaataaatccctcagcctgaccttcttccactcctgttccaaagacggtgctagctctgctggcctctcccccgcctggtcatctgtcttccccagataacccacatctcctcctccctcacactcagctccagcgagcccgcgccccacattccactcccccacatggctcctccctccactctagacccctttgccaggcgctggccacctccttccctcttcggggtccctccccgcccatccctggatcctctgttccagagcctgtagggacatcttccacttccacagtcccaccatggggacctggaacccacagagacacaaggagaaccccaacagtcacagtgacaaaaagaaaaagagaagccatctctctccgtgcctccagtggcttctcccctccccccagcttcccccacagaaaaccctgggaggctgaggaaggagcggaaagacggagctaagcctgcaggaaattaaacatgaaatgaaaacaagctcctctgattcattctctcatcctggccccagtctcccatcccaggccactgataaagagggatcccatttcagcagcacagagaggagaccccatctgtccttggctcccagtgggcagccagggcctggaccctaggaatccctggaggaaaaggggccctgggaggccagggcaggggctgagaccccaaactggggagagggtccgtttctaaggaagaggcttctcctcccccagtcaatgtgtgtgcacacatgcacgtgcgtgtagccacactagtgggtacactcgtgcacgcacacacatgcttaggattagggaggggaaagtgagttggtacaggagtggagaaacataataatgtacacccctgctcacccccaccctcctcacagtaacatgagatacatccccatcttccttgacctctttcctctagcaaaagacagtgagaaaggtcaggagctgtaaagaaacaaatgggaagtactctaaacattcttggactgcatttcccatctatctcccctgctgcgactatgaggtaccattcgccatgcagaaactgaggcccttggcaataccagtgctcctatgagcctgtccattggccagctacactggatgcccaaagaggccaggcagcgtctgtgaggaagcacgtccacacctccttctcccctcctcgcagtggttcctaggaagctcaaaggctctgaggcagaggaattttgagagctgactcctatatttagctcagcagctgcattggtcgtgatggatggagaaatgtttccacctggagagcagggactggacctcaggaaagttggctttcttgatgcctgggcctggaagggcctggcaaggctccttatggctctgcagctgaggctgttgtcatggctctgttctcccggtctgcagcgtgctgtctgaggtgtgcccacttgcatctgagtctgcaaagccagcagacaggtgcacatcaagctggcagaggcctccctctgaggagcaccacggtccatctctgaatcagcctaaagccattcctggcctggaagctgatccctcctcactctccctctctcacccaccccgtccccatcaccccttctccagatcctaagtcatgggccaggggtagggcagctcttgctcttgagccttgggaaagttctcagccttccagaaatgctcgtgcaaaggaaaaggacccaatactccccgtcaccaaaaaccccagtgctcacagctgactcagagacctcccctcccccgttgggctcccaatcaggccaacatcccatccacttgtgctcagtgacgggttggcctccacttcctctcaccatcaggccacgcttctacacaagattttatagcaactgcctctacagacagcaccaagggaaaaacccttcacttggcagtcaaggccccctgcgatctgactctgtttctttctctcccaccgcttccttcaaattgacctctttaggtttttggagtatgccttgctgtttctaaacctaggccttggctttcctcctttcagccaaccattcaaggcccagctcctgtccctcctccaggaagtcttccctgactgcctctgttgcccagcagagcccctgttctccctttaacacaggggagttctgagctgggagactgtctccaacaagaaggctgcagacaggatgcagggaggaaggcattctgaatctggaccaataagccttagagagccatgaaccttttggaaaactgtggcaaaactgtgtgtgattgtctaggagaacacatctggaggagcatttgtagcttttatcagcttctccacaggagtctgcttagatgactgctaagatgaccagtgacttgttttataggtggtgacacttggctgctctagattctcaagcttagaaaaataaaagttctggctcaggatcacgcccatggctagtgggggtaagataccttcccagctcagagtggatgattctagattgtcagctcttgaggacaaagaccaaggttgatatttatgtgtggccgcaccgcttcccaaacgcactgcaactgatggggggctcaagggaacagtttgcactgcctgaaagtgaggcctccaggcgggcatctcaccctggtgacaatggctttttcgcgtcttgtaggtctggttccagaaccgaagggccaagtggaggaagcgggagcgttttgggcagatgcagcaggttcgaacccacttctccactgcatatgagctgcccctcctcacccgagctgagaactacgcccaggtaagtcccgccctgagctgccgccaccgatccccagcccctggtgctctgagaatgagccccttggaggagagcccaggcaccccgagatgacttatggctccaggctgcccttccgtctcattccaggggtgtgcctgtttataccagagtgtgggaggcccagggttaatctatccaactaatcattgaaccaggcttggctgaactttagggaagggaaggttggggcagtgagaacggctctttcctccactagctttggccacttttgctgtgggcatcggaaccaaggcaggcagaaggccaccaggccctcagataccgctcggagggtctcttcagaaagcgagctctgaaatctccaggactcgtggccaagttggaatgagcttgggattctgagtccggggacttaggttatctttccagctccaggtctttctcactttaggcaagtctcaaatctctgagcctcagtttcttcacctgtaccttggacatggtaaaagcatctgctcagctctgttgtcaggcagttgtaaggtctaaattcaatcatgcaaaagtattttgtgaattgtacagtttcaaaaagcttgtgtgcctgtgctcagcttctggggccctgtcctcccctccccccagagcattttccctaggtgtctgtcagccagtcccctgttctagtgtgagatgcaagggatgagaagtattgagtcacatcaggcacatgggatgcttagagagatgtgtttttggccaagtccaagtcctctcctgacccccactcagcctgcccagcagaagcggctgctccctacctgctcaggcctcattctggcatggcctccacctcagctcccaacctggccctgctcagcagccagccagtagcacgggcgcccctgcctcctttacttctccctgacctggttctgtgctagcaaatggtctctggctctccaaccagaccagccctctgttccctctcccccagcccaggattcatggggcaggagggcagggcacaggcctggaggtgaggctgaggaatatggggtgtctcacacaggcaccatcagcatcagctcgcactatgttcttccattctctttctcccctctccctccctaaactcagcctccctctgtcctcccaggatggaactctagctccctccttggctttgagctctgctgcctgagcgcacagctggagggagaacccaacacagggccctgttcacccctcctacccccacctcacctacagcaccacatagtgtgtgctcagacctcttctgagagggggtgatggaggccaaccggtcccccttcccctgcaccgcagagagaaatgtggttccctccaggatgggggctgagctctttctccctgctttaaaatgcctccctcgagtgtgctccagacacatgcaggagggcaggccagcagaagcccacatgaggttaccaggaatcccgtgtgcataagctgagaggttcccgggtctcccccacaccctaattctacctccttatacgtgcctagaaggtagaggaagatgggagccccaggtgaacgttggggagggaagggaagcccagtggcacagatggaagataagatggccaactcatccctgcgcatgccctcgcccctttggcacgaggaggtccggtctcagatctggctgtccactcctgaggcagccccttccatcctgagttagttctgaagcctcctagttcaggccctggaacctcagccactgacccttggtttctgagaggtttaggtccctgccgcccacctcacccaacccctccatcttccctgctactggtgggggcccaagggaacctgcgaggccaaagctctccgagttgaggtctgctcaccttgctcaggtgcctatggatgtgaggggcctggggaggagctggaggtgaatgagacacagctgccatccgcagatggaggccaagtctacagttgagtctaaaaataggaagccagctggggggtgctggggtgtcacccttccactggacccttaatgaagcctgaggtcactctttagaactgaatttccctctgctgctagcctggccctgggaacagagatgccaaggtgtaaaagccacccccacaggggtatctggatgtccatcaaggctaaacactcaagaggggcttcatgggaaggatggacagtgaggggagaggtgctctgggggaaggggcgagccccttccacaccacacctgcccgccagccggtgacatctctcccttcctctcccagattcagaacccgtcctggctcggcaacaacggggctgcctcaccagtgccagcctgcgtggtcccctgcgacccggtgcctgcctgcatgtcccctcatgcccacccccctggctctggggccagcagcgtcaccgacttcctgagtgtgtctggggctggcagtcatgtgggccagacgcacatgggcagcctgtttggagcagccagcctcagcccaggcctcaatggctacgagctcaacggcgagccggaccgcaagacctcgagcatcgcggccctccgcatgaaggccaaggagcacagtgcggccatttcctgggccacatgacagggcacccctgccccgtccccacctcgggacaccatgggccacgcccatgttttccaggcccccagcctcccactcgactttcctcttaggaacctggcctgggccaggggcctgaccctcagcactttcagccgccccaagtctgaggccccgtggactgctgggagggagggggcagcaggcccctggcccctccctggcactgaggccctgacccctgctcccggccacaggcagtggagaaagccaggtggccacgtttttcagcttcgcatccatgataagctgaaagcgctttcttgctcccgcccactcctctgctctgcctagttgaccatgagtcaatgctagatttccatgcagacccagcagcctcaccagcccagtcttgtccatccttcccgctcctagtggggtcccctggtcaccaggccggtggctgtgtgtctgaagcacaggctgccctgcagagccagcctcctgccctcccatctttctctccctgaaagcacatggaatccgacctgctggggccaaggcgccggcctccacctccccccgaacagtgacgagtctgacagagcctggctgactgcatcctggctgtcccctaggctggatacacctggagagagtgggcagaggatgacaggagctggagccgaggacccctgctgccatctagcaatgccagtccccaggggagacacgggccagcccctcactggacactataggggaggagccagacctgagggaggctgagaacacagatgccacaagggctcccatggtgctagaagaaggaaaggtcctgggagagggggaggcatccgggtggggcgtgggcccgggcagtcctcccgctctccggcctgcctggcatctggtacagcggggaggtctgggcagctttgttctccatccagagcccagtcaggttccctccaggaggatgcggaggggctcgtctcttccctgccctaccctggcccctccctggggctgctcagcagtgtcccggcatggaaggactcacaacttcggaacacataagctagagcttgggggccgggtggcagagggtcaaaagctgcgtgcaggctttgctagaggacgtgtggccatgctcggcctccaggccctgctatggcctcaaactgactgtcctccctgccatatctgtcagtgtcatcgctgcccagagccttccacggcagatgggggctctgtgtccctccaggcactaggaggtgttgctcttctccacacagctttccacactccgtccttacacttcttccacagggaccaggactctctgccctctctccagcctgcggaagggctcctggcctgggctcctcggtgtggctttgctattgcaaatggggctgtcaggatgccctcctgaaaccaggcttcctgcctccaggaagcggggctctgtgcctgcctgcccgacccctgtagcttgggtctggccctgagccccagccctcacctcagctgggagtacacagtaaccgtccagaggcaggcctgtcagaccccaggtggggggtccctccagcaggcagcgccccgcattgaagcgctcgccttttctaccttctcccttgattcctgtcatggagtagggccaggcccactatgctcagggtcgtggacacagaaaggcctcctgggttgggcggagggtaaacttggtgttgttgaatgagggtctctggggttgggggtgacagtctcccgcctgcctggtgttctcatctgctctagaaaccaggctgaggaagggtctggctgtggcctcccttaatgagtcagacctctttgtgaaccgtagctctaaaatggatcttatagaggtgaaagggtcttggacattgaattaaatgttcttggaggcttggctttaagtgtttcaaatatttgaggatttggagtgacttttgggaagttttttctagttctgaggttcgctgaaatgacccagactcccccaaaatctagccagggaaaggaagaacttaaggctgggaacagtttccccatttctcccccctttccttctgaaatgctcatggctgaggaaggatgggggaggaaggaactttcaccttgggtctttctcacccatgagagaatcaggacaaagaggaggagagccaggtagctccagagtgggccaggagggagagcaagggaatcaggacaaagaggaggacagacaggtagct
